United States Patent 10,407,724 (METHODS AND COMPOSITIONS FOR SCREENING AND TREATING DEVELOPMENTAL DISORDERS) - sequence listing, part 18

SEQ ID NO: 324 - DNA, 12331 bp, Homo sapiens
tcctcctttctttgagcaaatagtcaccaagcccctttatgtgcataagatagtatattttttggaataacacatgaccctgcctccaaaagtttgtagtgggccaggcatggtggctcacgcctgtaatcccagcactttgggaggctgaagcgggcggatcacctgaggtcaggagttcaagaccagcctggccaacatggtgaaaccccgtctctactaaaaatacaaaaaattagctggaagtggtggcgggcgcctgtaatctcagctacttgggaggctgaggcaggagaattgcttgaacccaggaggcggaggttgcagtgagccgagatggcaccattgcactccagcctgggcaacgggagtgaaactctgtctcaaaagaaaaaaaaagtctgtagtgtagttgtggaaaaaaggcagaagtccaaaaaattaaatcacaacacaagagatgtcatgaggtcggtggattatgggaacgctggcaccatgtgttcacaggacaaggtggcaattgcagtggggaaggcttcatggaggaggggagtccaagccatgcctttgggatggggagggttggggtaggcagaagaggccattccaaacaagggaaccctctgccagagagagtagagagtggggagcgtttgttctgtgtttgggaaaatcgtgatcagcccgggctgggtgaacccacctgcaggccatgtgtgcagtgatcatgaagcatgggcggtagtcgtgaagagaggctggaggcagctcaggccgaatggactttctcctccagccgggagccgcctgggttcttgctttcacttcggatcagagacgctgctgcgctgcttgacactagacttgctttattcctgttgagtggaatacagcaaacaccccaataggtggagcaggctcaaagcaagaggcacatggccccccagaaattctcatgatcctgtggaggggtgagcttggtcagggcaaccaggcctggatgcaccagggttgcatctgagaggaagcaccctggtctcctctgcctcgaaaagcatagtgaggggggagcccaaccaagttggaggatgctgagctgtgcagtcgggcttccagccgtgctggcacgttctcctttcagctgaaatctgcattggtttcagctggacgtccaggcttccacccactgaggcagcgtgctgctagcctaggggagggctgctggtgttgccaaccaactggcttgtctctacacatccatcaagagcactggggccgggtgcagtggctcacacctgtaattccagcactttgggaggccaaggtaggcagattgcttgagcccaggagtttgagatcagcctggacaacatggtgagacccctgtctctaccaaaaatacaaaagacatggtggtgtgtgcctgtggtcccagctactgaggaggctgaggtaggaggatcacctgatcccaaaggtcgaggctgcagtgagccttgattgcgtcactgaactccagcctgggcaacagagtgagaccctgtctcaaaaaaaaaaaaaaaaaaaaaaaaaaagaaagaaaaagaattaaaaagaaaaaaaaaagaccattggtttactagattttttttttaggggtagcagctgcctttctcaaaagaaattctatagagaatctcccaatgtataaaacatatcaaagtagaattcttgggatgtggagggaatggggtacctggatcccacctgccagtctttaggcattcatgaggaacccttgaacctgctgaaccctgtaaaagggctttaagcagagagtgagatgacccaatacacattttagaaagatgcccgtggcagctaggtggagttgacattggacagggatgagattaggggcagggagcgagtttcaggaggctatgaaagtggtccagacatgagctgatgaggtctagacccagggcaacagcctaaggatgaaaagcaggttggattccagaaacatttctgagttagaatcagcaggaattgggggtcaattagatatgaaggatgaagtctgtgagggctggactgcctgggctgaaacataccgtaaagtgtgacagccatacaggagagaaactgctgggacaaaggataagagttgagtttggggccaggcacagtggctcatgcctgtaatcccaggactctgagactgaggtgggcggatcacctgaggtcaggagtttgagaccaccctggccaacatggtgaaatcccatctctactaaaaacacaaaaattagctgggcgtggtggtgggcgcctgtaattccagctacttgggaggttgaggcaggagaatcacttgaacctgggaggcagaggttgcagtgagctgagattgcgccactgctccagcctgggtgacagagcaagactgtctcaaaaaaaaagagagagagttgagtttgggatacatcatgttatggtgactctgggacatgtagcagttgattgaccagtagacagttaaaaatgcaagtctggatcttctctcgtggaagagaatgttggagctagaaattaaaattggggagttaccaactgattggtagacacaaaagacatgaagtagagaatgtgcatacaagagagaaagaggcctgaatcaagcacctgggtttgcaacaatttgatctttatttagctttttcattggtgtgattgttattaccattatgagataatattttatttttaaaattatttttatttttttaaagacggagtcacactctatcacacaggctgaagtgcaatggcgtgatcttggctcactgcagcctcaacctccctgtgctcaggtgatcctcccacctcagcctcccaaatagctgggactacaggtgcgtgccaccaggtctggctaagttttaaattttttgtacatatggagtctcagtatgttgcccaggctggtcttgcactcaggcggtccacctgccttggtctgccaaaatgctaggattacaagcctgagcctctgtgcccggccatgagtgaatattgtagaaagcagagacaatgtgccagatgtttggagtgaaaaggacttggctcctgttctcttaggatggacaatgctacacacaatcccaaatcacaggctataagagaggtgacccaatcctgcaggacagttcaacgtttcagatttgaaggggagtgagagagatcagaactggaggccccttgtctgagcccccgactatggtggtccacgtcactccacacgcagcaggcactgtaaatatttcaccttctctagacgacagtagttcctcgagaacaggagcgctggggtaatgcatatgaagctcttagcacagtgtctggcgctgcttcaatgatggctatatgatcaattattcttactcctttgaattcttggcaagagctggcagggaactttgtacacatcaggtacaaaaaaacccatccgcgcagtctaagatcaagaagctcttggcactctctgacagtcctcgacaaagcaattccccttctttctaacacagggtccgtaaaggagatgatccacaaggaccggctgagtggataagaagacagactggctgagcggctgaccctgccagacgacaggctgtgcctctttaccacggtgctgccgttcccaaagtcggcctcagcttggtccttggctggaagctcgtagcaaagtttctgggtcagcagacctcataggcaaggggcccctagctggccgcccccagccctgccaaggcaccaacgcaagaaagccgggggagcctcggtcgcattgctggaagatcgtctaaacatccccgctgctcggccgctaggccggcaggtgttcgggccccgctcccccggcccgccccacccccgcgcccgcgccgcgcttccctctaagaggccgggtctgagtgagcctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcagggctcacgaggaagctgtggcttgctgcgtccaagcgccgccgcttttgtgctgggcgtgggggctgcagctctgggtggaggtggaaatacctccctccaggagcacttagagctgagaaaggtggtgcgacgtagtggaaaccacgagggcttcagattcagacgtgggtttgagtcctggctctgcagggagcatgtgagcagacagttaaggtttctgagcctcagttttctcatctgcaaaatgggaacagagatgctccctccctgggctgggcgactggatatgatgagaccgctctgtgcacactcagcatgctgagcactgggctctcctttcctgtcccacaacgtggattgagaaccactatctcatagatgaagacactaagactggttaacagcaacacctatcacagatgccgtccacgtgccaggcctgtccaaggccctggggatacagctgtgaaaatgtgcaaagccccttctcccacagaacgtttgtccttgggagattcactggggctctgtgacttggatcttagcctagacttagatccatggcttatcagagggagactaacaggagggcgacgaagactcggacgctcttccgtagccctcgtggcccctgcatgtgggccggcttctgaaggggtcagcgtacttccccacgtacccaggagctagacggaaagaagtaaggagccactggtgtggctttgtgctgcctctgagagaaggtggacacgtgccagttggtggctgcgactggaggaggccggatcgggggtcctaggaatggagcctctccggacagggctggtcggggctgctgtgcttccctaggggctgaggggaccccaccggaggcttcttcatgatgggcacagcccgttaggagtctgggtgctagaaacattcagcgtctgtggccctccatgctttcctgtgtgctcctcacctgccggctgtgacacacagactgttctgtggatgctgagggtttgctgggctttacatttacaatacgtatttattctcctcacacacctcttaggtttgtgtgtgtgtgcccgagagtccctaaaggagattatagaatcatgggcccaggaaaaaaccttaactcctgcctttaggttaaaaaaacaaaacaaaacaaaacaaaacaaaacaaactcagcttcacaaagaaggcactttttaaaaatatatatatttatttatttatttttagagacaggctcttgctctgttgcccagactggagttctgtggcacgatcacagatcactgcagcctcaaactcttgggctcaaataatgctcctgcttcagtcacctgaggagctaggacaacaggtgcacaccaccatgccagctaatttttaaaatttttttgtagacacaggatcttgctgtgttgcccaggctggtctcaaactcctgggctcaagcaatcctcctgccttggcctcccaaagtgctgggagtgtgggcgtgagtcaccgcccccagctttcatgtaatgagtgccctcatgggaacttcatgaaaacacattctcttatagtttttaaattcatcatccaagagttcctgctctttgatgatgagacatacctggtagactccaaaacagagagcagacgcctagtatctttgttctggggtgtgcattaagagtacattgacctgtctgtctccagtcttgactcttttggaagagagatgctagtactgatgacaacctgcattctggctgcggtgtgcgtccacactgcacagtgtgcaccagactctcgtatggacaatgactgtccctcacatcaggcgcagatccattttagagcctcagaagtcaggagagggtggactttcaaccacgactgaaaacactgtctttcttaggacatgctgtgtgtatgacacacttacagatgtctgtgctcactgatgcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcggcaaaaaagaaaaaaaaaaaggatttattgtttcaaataactgaaaagtgtatgggcaatagtttcaggcatggctgagtccagatgctcaaatggcattgccaggaatccatctgtctcctttcctcagctttgccttcctctctgtgggcctctttaccaggcaagtcccggagctggtggcaaagatggctgcctgcagctccaactatattcctactggtttggcatctgaaacagaaagagcaagtctcctttccatgagttctagcaactgcccgtggattgattctcatgggcttggcttttatgatgagcctgttaggaaaatggagtgctctcacgggcccagccttactcataggccccgccctggaaccaggagctgggatcagacccgaacacacagacttttgaagaaaggaagggggttggttgcacagccgcgtaagggtacttaacactactgaattgtacacctaaaaatggttaagatggtcactttcggccgggcgcggtggctcatccctgtaatcccagcactttgggaggccgaggcgggtggatcaggaggtcaggagtttgagaccagcctggccaaaatggtgaaaccccgtcactactaaaaatacaaaaattagctgggtgtggtggtgagtccctgtaatcccagctactcaggaggctgaggcaggagagtcgcttgaaccttggaggcggaggttgcagtgagccgagatgattgtgccattgcactccagcctgagccacaagagcaaaattctgtctcaaaaaaaaaaaaaaaaagataatcgctttcatgttttgtgtattttactacaattaaacattttctaaagaaaaaaaggaaagaaagggggtgattttctcaaaggggaattgaggggttgttaccagaaggagaaacgaatgtgagtgagtaggcgaaaccaaccaatttccagagcgaacggagtcaggtgctgaccccaagccaatgtgtcttttctcactttaatgcctgagggatttcagagtgaacagagtgaagaaaggaggaagtggaacctcgtcatggtcctcacccacgaggtgggcgcgaggagcaggctggtactggataggctcaatgtggccacaaagcctggtgaggtcacagggactcccctcctccagccccaacccaaaaggttgcctaaggcaggtgctgcgccatgtgcaccaagcaactttctgctgccacctccaagaaagagaaggaccgggaggggatttctcccaggagagagagcacataacgctccgtcttttcacctgtctgttctcaagcaggacctaagtgtctaaggcaaccccacacccacagtgcctggcaggggcccacccatgggtacacatcgtgttctcctaagctcatgtcactccatttcagatgtcaactggacatggactcctgctgatcctccctactgtcattcactcctctcctgctccagccctgatccctgaggtctcttctacccttgcagtgtctcccctctgtggtcctcaggcaccaaggctgagccctttccctcggccctgcagtgtctcccctctgtggtcgtcagacaccaaggctgagccttttcccttggccctgcaggctcagtggggagcagggctttccctgcctggccctggaccacctccttcaacttcagcaagttagcggtctccctgtcaccagccagcctgacaccctgagacctcctcatgggcctcggccgttctcttgttctaggttattgggcccttcctcaggtccttaaactgatgcttccattcagcttctcatctccttccaaatccccagttttcttctaggctctctggctagagaaggttagagccattttgaaggcctctgacagcccccgtcttgctttgtctccacagaaggccatggtcccatgatacactcaggggtgctgttcagaatatcaggcaccgcatggcacagctacttgggaggctgaggcaggagaattgcttgtaccctggaggcggaggttgcagtgagccaaggtcacgccgctgcactctagcctgggtaacagagtgagaccccgtctcaaaaaaaaaaaaaaaagttaaatcacttgatatgcattctgaaatatttaaaggaaagtatatcaatgactgcaatgtactttgaaatgcacgatcaggctgggtgcagtggctcacacctgtaatcccagcactttgggaggccagggcgggagtttgagaccagtctggccaacatggtgaaaccccatctctattaaaaatacaaaaattacccgggtgtgatggtgatctgtagtgatctggtgcctgtgatcccagctacttgggaggctgaggcaggagaatctcttgaaccccggaggcagagatctcagcgagcagagatcgcaccattgcactccagtctggcgacagagtgagactctgtcaaaaaaaaaaaaaaaaaaaaaagaaagaaagaaaggtggcatgggtggtgctgtgtgcctgtagccccagctactcggtagccctaggtgggaggactacttgaggctgggagcttgaggctgtagtgtgctacaatcccatctgtgaataactactgcactccagcctgggcaacatagcaagacctctaaaaaaaaaggagaaagaaagatggacagaaggatagatagatggatagatgtatgttgttggggaaaagttaaatgactaacagtacctagtaactgttcacattccttgtcatgatcataaaaatcaaataataagaaattagaaaacttccataggaaatgtagctacctataatacactgccatatgaattactgggttattgctccactcaacttttagcttgtgatgaggaggtgataccagcactgagcctgcaggatgagtaagagctttgcaggtgaacaagaccagcaaaagagcctttcccacagaggacagagcgtgtgggcatgcgtgatttagtcaagggtcgcaggcatcccagggtggctggggcttgtggtattgaggttgagctgatgcagaagtcacagacctgggtttgaattgtggctctaacattctctagctgtacagcctaaacctatgtgagccgccattgaccaagtgtgaaatggagatgacaacatttacctgctaggatttttgtgggaattatatgtaaagtacccggtatagcccgtgttccaaggtgagcactcagtaagcatgagctgtcacagtgaagagcccggacagaatctgggagtgattatgcagacctcgaacaccactgaattgacctttgaatcggcctcttgtcaggaatccatatgctttcgttcttcaatcgtacactttctcaaggaaaccaagtagtcggggtggggggatatattttcattgttttcccactggggccactaagccgctgtcatcacccataaaaaacccctgcccacagtctaccgtggaccctgggtgctcgcttctcccctggacatcccagggtccacacgctgcagctcccaggggtgggagaagggacgaaagctccttctccttcactgtatttccctcaacaccagcttgctgtttgcacagaggaactctgctttccctttgattaatacacctctttgtctcactatggaaagcgtctgtccccctccagtgggggcgtgtcctcctgcaggccttggaaggcttggtggggtcccccgcccactaaacgtgaagtccgaacattcccttacatcgacaaagccttttcacacacactgtcccattcagtctcgacacaaccctgtgaggccatcaaggcaagtgctgtcctccgtggtcaccaccagagtgaaggagccaggcttgggcccaggcctccttccccagcccagggtcccttcctctacacaggtcccacctgctccttcttatcgagaagggcggtggcaggtagccactccctcagaagtgaccagagggaacaaacttgtgatactgaagggaaatcagatgctaatgcgttatgcggttgagcgcctatcagcagagattatgtgggtctctcctatagaaaggtgacaccgaggacctaccaccagccaccaccagcatgcaagggcgaggtgtcacctcccagtgggagcaggtttgcatttattaagacctgtggccagatggcagcctgtgggcatggaacaggacgaggtgggctgacctctgatggctctaccaggccgacgctgaccacgtagggaagccagttggcttattcgtggccctaaggaagtgagggctgagcagggaggtgctcaaagcgggctcctcacactggctgtctggagtcgctgtgggaagggcccaggggaagaagggttgctggggcctctgaatccccccccgatggaggcagagcctcatccattcccagagagtctctcgccacgagccccggtacagcgcaggctgaccagagaaccggagaaccgggtgggaaccggagatctgagttgaaccagtgctgggaaccatggcactgccttcgccgagccgccgcgtgcctctcttttcacctctctggcctgcatattcttttagcaaacttggggattatactacacattctgctttacactttcctttccttgatattattttattatgaacgtctttctgcgtcaatcaatatattgctaccaaagcatttttttatcataccacgtcattcctatcatgtagttttaccataacttatttagccagtgcttccattattggacttttgatggtttccacttttttattattcttactaatgttacaatgaatatttcttttaaaatatttttatgtacattgtatttccttaggataaattcctagaacttgagtcattgaatcaaaaagaatccagactttcaaggtctttgataaattggctaaattgttcttcagaaaaagtgtgccaattttctgttctacctgcagggtgtgagacagttcttagggggggagaagtcaaaacaattgtattgtctatattttgacaaattcattattaagagaaagctagagaagcaaatcacaagctctgaattcacacatcacaattctaaatgtttgttgttctaatcctcaatttcaagttcttgttaatgcatccaccatttgaatatttactttttcaaaatataggaatgtgttaatttaccaaagatcacaatcggttctttgctttttgcttattttttgagacagagtcccacttcgttgtccaggctggagtgcaatggcatgatctcggctcactgcaacctctgcctcccaggttcaaatgacactcttggctcagcctcccgagtagctggaattacaggtgcctgccactatgctcggctaatttttgtatttttagtagagacggggtttcaccatgttggtcaggctggtctcaaattcctgacctcaggtgatctgctggccttggcctcccaaagtgctgggattacaagcgtgagccactgcgcccagccacctggctaatttttgtatttttagtagagacggggtttctctatgttggccaggctggtctcgaacccctgatctcaggtgatccacccacctcggactcccaaagtgctgggattgcaggtgtgagccactgtgcccagcctgtatttccatttttaacataacaaatgtttcctgagcacctttctga

SEQ ID NO: 325 - DNA, 12897 bp, Homo sapiens
attcacagcctgctgaccaaaggcttcatcaatgaaaaggtaggttgcagagccactgagcatgaggtctgttgaaacggctcgataaaatatcaacaggcatggggttttccttcttgaactcctgggctcaagtgaacctcccacctcggcctcccaaaatgttgggattacaggcatgagccaccacgcccatcctgggttttccttctgacgaaaaagatctctgcttttcgttgagacaaaatattagctgaaaaggattgggtttccctgctgctgtccttttaggctgactctcctcaaggctgggaaagaagcaggatttgagggtgttatatttcctgatggtcaggccagtttgcctttgttggaaatttatgtggctttatgtagataacctcttttaatattatacccatttaacaggtgaacgagagggccagcaaggtttaagaatacacctaaagctgggcacggtggttcacacctgtaatcccatcactttgggaggccgaggtgggtggatcacttgaggtcaggagtttgagaccagcctggccaacatggtgaaatgacgtctgtactaaaaatacaaaaattagccaggcatggtggcatgcacgtgtaatcccagttactcgggaggctgaggcagaattgcttaagcctgggagacccaggttgcagtcagccgagattgcgccactgcacttcagcctgagtgtcagagcaagactccgtctcaaaacaaacaaacaacaacaataaaaactagtcagaggaagtggtatagctagagccccaagacacccatgatcttaaactttgtgctttaattcctgcatatttgtgtcttctggggttcaattcattgaaatacagacattcaagttatctgttaagcaatagatctggcaaagtcataggttatctattaagtaataagtctagtaaagtcatagatttcaatgatccacttctgacttaataggaaaattctgcacttatttataccttttaggaatgcaatgttgtcagtgataacattcccagcgcaacaaattatcaagtaagacaaccaatcagaattccagatttcttttcagaggttaaaggttactttcacaggacatggcataatttttttttttttttttttgagacagggtctcattctgttgcccaggctagagtgcagaggaacaatcacagctcaccacagcctccacctcctgggctcaggcaatctttccacctcagcctgcagagtagctgggatcacaggtgtgccaccacgcccagctaatttctttaattttttgtagaaacaggatctcaccatgttgcccaggctgatctcaaactcctaggattaagtaatcctcccgcctgagcttcccaaagtgttgggattacaggtgtgaaccgtcaggctcggctggcataatctttgaagcctgggtagccttacatgactcctttggttcaactagctcttctagggacaagtattataaataatacagagaactgaacaaattggtaaaagtaatgaatattcacccaagcgtccttattacacaggaaaacaagtgatgatatgtttaaggctctcagcttaattccttatccaatcagattctctgaattgtttttgcatgcagaatgggattgctgtgctactactgccaggcagaagggatggcttcctcttttttctttttcttttttttttttttttttttttttgagatgaagtcttgctgtgtcaccaggctggagtgcagtggcatgatctcagctcacttcagcctctgcctcctgggttcaagtgattctcatgtctcagcctcccgagtagctaggattacaggtgcctgccaccacacccagctaatttttatatttttagtagagatgaggtttcatcatgttggccaggctggtctcaaactcctgacttcaagtgatccacccgcctcagccacccaaagcgctgggattggtaagatgtatttttaaggataggtggcgaaattttattagttaacattttttttaaaaagcatgcctcagccgggcgcggtggctcacgcctgtaatcccagcactttgggacgccgaggcgggtggatcatgaggtcaggagatcgagaccatcctggctaacaaggtgaaaccccgtctctactaaaaatacaaaaaattagccgggcgcggtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaagcatgcctcagccaggtgtggtggcacatgcctgtggtcctagctacttgggaggctgaagtgggaggatagcttgagcccaggaggtcgaggctacagtgagccgtgatcacgccactgccctgcagccaggacaacagagcaaggctctgtctctaaaatcaaccaaataaaaagcatacctgtaagtctacttcactagaagaaatgcaaaaaatggctgaacagattctactgaatagcgctgagataaggaaacggtgtcatttctgttccactggaccagagtggggccactttcactcagattctgacaccatcgtactttgccaccgtcccctccctacactgactctcagacaccatatttcaaagtttcccctttgcagaatgactgtcttgataggtagtgagcttcctgaccctggagatatacaagcagaggctcacaagatttcctgcactggatggaaaccagaacgtgattagctctaaaatgcttttcctgagattttggattttcagctcccatccagtcataaacttcacactcatttcctcttttcaaggatcccacattgccaccatttgaaggagatgatttaaggatcctggcccaggagatcaccaaggccagaagcttcctctggcaggcccaatccttcaggtatgcccttcacgcagcctctccggcctgccatgtggctacagcccatgcagaccccggaccccatcgagaagggccgcacccatgatggtacccttgctccaagggttcctgccctgcttctcccagccagcccagaaatctgggcaccagggagaccatctttcttcatctcctgcccaccagatcccaactccagaagaaaaatgatgcagaaccaaaggtcactctttcctagagaagtgttctcaggtaaggggaggggctagaccccatactacctgagtgtgcactaagcaccaagtggcatgctctattttgtggtcaataataactttggttaaaaaataatgattcctctaaacagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttcaataagaaaaagataaacatccatttttttgttttttttggaaacagagtctcgctctgttgcccaggctggagtgcagtggtgcaatctcggctcactgcaacctccgcctcctgggttcaagcaattctcctgcctcagcctcctgagcagctgggactacaggggcctgccaccacgtctggctaatttttgttttagtagagacagggtttcattatgttggccaggctggtcttgaactcctgatctcaggggatctgcccgccttggcctctcaaagtgctgggattataggcgtgagccactgtgcctggcccatctcaattttttttttttttttaggcacagtctcactctttttgcccaggctggagtgcagtggcacgatctcagctcactgcaacctccgcctcccaggttcaagcgattctcctgcctcagcctcccgagtagggtagctgggattacaggtgcctgccaccacgcccagctaattttttttatttttatttttagtggagacggggtttcaccatgttggccaggctggtctcaaacgcctgacctcaggtgatccggcccgactgagactcccaaagtgctgggattacaggcatgagtcaccgcgtccagcccatccaatttttaaaatggacaataggtacatgaaaaggtgctcaacagccttacctgccagggaagtgtaaattaaaaccacagtgagatgccactacactcccactagaatggctaaaataaaaaagactggggttgggcacagtggctcatgcctctaatcccaacactttgcgaggctgagatgggaggattgcttgatgccaggggttcaacaccagcctgggcaacatagcaagaccccatgtctccaaaaatttaaaagaaattagccaggcatggtggcccaatgcatgtagttttagctgctcaggaggctgaggcatgaggatcagttgagcccaggagtttgagactacagttagctatgattgtgccattgcactccagcgtgggcaacagagtaagaccctgtctcttaaaaacaaacaaacaaaaagacaagatggccaggcatggtggctcacacctgtaatcccagcactttgggaggccaaggtgggcggatcacatgaagtcagaagtttgagaccagcatggccaacatagtgaaaccccgtctctactaaaaacaacaaaaattagctgggcatggtggtgcacacctgtaattccagctactcaggaggctgaggcatgagaatcgcttgaacccaggaggtggagattgcaatgagctgagactgggccattgcactccagcctgggcaacagaatgagaccctgtctctaaaaacagaacaaaaaaagaactacaatatcaagatgtggaacagttggaacactcatattccaattagggtaggggttggggtagggacgtataatttgactcaataactttggaagactatttggcaatttctactaaagtaaaacatatgcctactctatgatctagtaattccactccaagggtaatgagtgcatatgttagacaaaagacatataagaatttttccagcagccttattcattagagctcaaaattggaaactacccaatgtccatcagtggcagaatgtgcaaataaaatctgatacattttacagtgaaatattatgcatcaatttaaaaagaatgaacggctcatgtggtggctcacacctgaaatcccagcactttgggagaccaaggcaggtagatggcttgagcccaggagtttgagactagcctaggtaacatggtgagaacccatctttacaaaaaaatacaaaaattagccaggcttggaggcatatgcctgtagtgccagctactcaggaggctgaggtgcaaggatcacctgagcccaggagaggttgaggctgcagtgagccttgatcatgccactatactccagccttggcaatagagtgagaccctgcctgcacccccaaaaaagaatgatctatacagctatattcaacaagatgcatcagtctcataatattgggcaaaagaaaccagacacaaaggagtacatactgtataaagtcatttatatgaagttcaagaaccagccaaactccttattggtgattgaagtcaaaatactagttaccctgtgggatgggggacacaaaggggacatctggtgtgatgaaaatattctatatattgataaaggtaggagttacattgagctatacataagtaaaaattcatcaagttgtttaaaaacactcagttgtggccaggtgcggtggttcacgcctgtaatcccagcacttagggagaccaaggcaggcagatggctcaaggccaggagttcgagaccagcctggccaacatggagaaaccctgtctctaccaaaaatacaaaaattagccaggcatggtggtggacgcctgtagtcccagctactcggaggctgaggcaggagaatcgcttgaacccgggaggtggaggttgcagtgagctgagatcgtgccactgcactccagcctggcaacagagactctgtctcaaaaaaaacgaaactcacttgctaaggcttgatgagaccctgctttggccaggctctgtgctgggcccaggaaggcagtggtgaccacaacccctgccatggtaaatctcagtctggtccatcttgcacagctgccattttgggtcacgtctgtaaatacagagaaaagggcctgtggtggttgtattcatttgctagagctgtcataacaaagtaccacaaattgagtggatgaaacaacagaaatgtattctcttattgttctggaagctggaaattcaagattaagatgccctcagggccatgctccctctgaagacactgggaaggatccgttccagacttctctcctccattctggtagttccttggctttgggcagcataactacagccttcacatgaagctctgcctatgtgcatgtctctgttcaaatttcccctctttataagaacaccaatcatactggagtaggggcccaccctactccactatgaccttaactcattacatctgcagtgactttatttggagagttagggttaagtacatgggattgggacttccacatatgaattttgtgaagaacacaattcaacccgtcacagatgtaagttatgcttctctttgcaagacaatatcagcagctggtactggggaatatgagttctctggccctgttggtgggagaagaataggctggcctttgtgaatggaaggttgaaccaaacacatggcttatgaagtggggaaggacaggacctaggttcaaatcccaacctcccatgtaatgaggagaacagctaccattgtttgcacactgattgagccagcaccatgctcaacattttgcatagagcatgttagccataaacctcacagcatgacaactataaagtgcacatcatttgcagtttacagatgaggaaactgagcctcgtagctgctcaaagacacacagcaagaaagtggcaaagccaagatttaaatccaggactgaccctatggcttttccccaccacatttggagccccttttctgaacctgtttccctgtctctaaaattgagctaaaacagagttgtgaggattaaacaagatctcttaccatctggctcatagaacatgcagactaagattttgtttttctcttccccacacctatgcccacagagggtgttgtatgggtggaggctttttcagttgcccttttcagagcaaagtgaccagcccttcctgctctcagcccctgtggctccattacagcagttgtgagctcttgggcacatgcctgaccctccaatactgccacttgaacatgagttttcttttactgagacaggatctcactccattgcctgagctctccagcatgagactgcagtggcacaatcacagcccaccatagcctccacctcccaggctcaggtgatcctcctgcctcagcctcccaagtagctgggactacaggcacatgccaccatgcccggctaatttttttttgtaattttttgtagagatgggctctcactatgttgtccaggctggtcttaaatgcctaggctcaagtgatctgcccaccccagcctcccaaagtgctgggattacaggcatgagccaccacacccagctgaacatgagttttcaaaggatgatatgatccagcactgaagaagcacccatcaaaatagaatgatgtgattgatgcataaatcaacagagataagtggaagattgcaagacagggagagtagatagatgggtagaagcaaggaaagaaagatatatgtaatgaattagatgggtggaaggttggatggatggaaatttggatggataggtggaaggatagatgatggaaggttggatggacaggtttaagaatggatggatgacaggttgtatggataggttgaaatacagatggatggaaaggacaggttgaaataaagatggatggaaagctggatggacaggtagaagtacagatggatggaaggttggatggataagcagaaggatggtcagggagaagattggatggataagtggaaggatggatgatggaaggttagatggataggtggaaggctggatggataggtggaaggctggatggatggaaggttggatggataggtggaaggatggatggatggaaggttggatggataggtggaaggatggatggatggaaggatggatggataggtggaaggatggatgatggaagaacttttttggttttttgtttttgtttaaatatttgcaaatcatttatctgatgaaggatttgtatccagaatatacaaagaactcttaaaagtcaacaaataactcaactgaaaatgagcaaaggatttgaacagacacttctccaaagaaaacacattaatgtgccaatgagcacatgaaaacatgttcagcagcattagctatcaggaaattcaaatgaaaccacaatgagacaccacttcacacccagtagaatagttaaaattttaaacatagatataataataagtgttggtaaggatgcggaagtattggaaccctatacactgctggtaggattgtaaaatggtacagctactttagaaaacagtttggcggttcttctctaaacacagagtaatcatatgacccagcaattctgctcctacatatagatgaaaccctttttcttggggttctaggacgacttggcctgcaggacagagcccggcacgcagggcctttgcgtcttttcccacaagaagcgtggaccatttcgcccatcccagccctactggcttcagtttcccctctatgagagcccgcgggtctccacctgagagaatgcaggtgctcccgcgccgggagtgggcgggcagaagagcgggcggggggcggtccggatgcctcgtcccgccccgccccgcccctttctgccctcctcgggagaaggaggtggcccggtggccctggcggcgcggagactggcgcagcgcggggagcacgcagcgccgcgggagcccgggccaggtgagcgaagcccggacgcgggccagggagggacgcaggtgctggagggacagggagggtgagggagccaagaggggaggggacccccaccctggagctgcccgcgagcccagcgctctcagggtcagtccctgatgctccccacccttttgccagttccttccaccaaacccgcttttggggtccccatcgacctggattccggcggagacactgtctgtgactccatcaaagtttcctcatgttctctgggcctcagtttccacctctgggtaatgggaaccatagcctgtacttcactgaacttccaaaagaatgagtgaagccatgtccagggtgggtctggcgcgcgaccatagcacagccagatcccgaacacgccccagagattttgttcacccagcagcatttgctggccgcctgctttgcgccaggcactgttctaggtgctgggacactccagggaatgaaatcctcctggagctttgcaatctagcctcgcaaggcattctggcgtctgttttctcatgaccaccctgtgaggagccagagcagccagaaatatttgggtccattcgcggttgtgggtactaaggtacagtgaggttttaaggcccttacccaagggcacaccccaataagtgagtatccaaggctgagtccagcctttgccacaaaaggcatcctcttagggtagaaagtcagctctggtcccatagacccttccccagaacagagtcctctgggcctgagtacaggaggagggctcgctgtggggctgcatcctctcctctccctctcggggatttaggcccctgctcatgatggtttgcagtctctctcattaaatccatgagtgggctgggcgcagtggctcacgcctgtaatcccagcactttgggaggctgagggtggcagatcacttgagaccaggagtttgagaccagcctggccaaaatggtgaaacccccgtctctactaaaaatacaaaaattaaccaggtgtggtggcgcgtgcctgtagtcccagctactcgggaggctgagggaggagaattgcttgaacaaggcaggcggaggttgcagtgagccaagatcacaccactgcactccagcctgagcaacagagtgagactccttctctaaataaataaataaagccatgagtgttcgtgcttatacggggcaggactgtattcctcacccagacatttggtgagcagggcagtaacagaggaaattaaaaatacagcccctctagctgccagagtccctgccctgtgaccaccaccagcaaaaaaacatggggctcatcagtccagtcactcaacaaatacccgttctttcatgcagccagtatatgccatgcagggcagagatgcacctatctgtatatgtagggcctggcgcacagaggtccctagcacatggttgctgttgttacggttaatgatcacctagccctggtcatccagcctcatcctcaggtggagagggaggtcgggaggggggtggggggatggacgatggtgacagtgactgacagcctggcttgccctgagtctagactgagggctgggcacagtggctaacgcctgtaatctcaacactttgggaggccaaggcaggagaattgcttgagttccaggagttcactactagcctgggcaacagagtgagactctgtctcaaaaattaaaaaaagatctagggagctggatgcggtggctcacacctgtaatcccagcactttgggaggctgaggtgggaggatcacttgaggtcaggagttcaagaccagcctggccaacatggtgaaaccccatctctactaaaaatgcaaaaattcaccaggcatggtagcatgcacctgtattcccagctgcttgtggggctaagatggaaggatcgcttgagcacagaagtttgaagctgcagtgagctatgattgtgccactgcactccagcctgggcgacagagaaaagaaagtagtctgaggctgcaaagaacaggatcctcagtgctgtccccctaggcccatagaccagaccctaaagcctgcagagggattgggcagaacgtgtggtaccagccacccacactactgtcggaccttggaggaccagaggcgtcaggcatcagggtggagacaggcacagcacttggagtcatgtgcaagtttccagggtgcagagtccttttggatccatgtggattctcctcctcctcctctttctcttcctcctcttccagaaggctctcccaatctccccagtcagaaagcagccacctcccagtctggtgaggttcccgctggatgatttgccctgtcttcctttggtactccatggaaactggaattttaaggaactggtagataagtcaggaatgcttaatgtcaacctcagttacacagcgtgactttgggcctcaattttcttagctctaaaatccaagtcttggctgccttgtctctgactctgtgcagaggacagcagccacactggagttttttgtttgtttgtttgtttgtttgtttttgagactgagtctcattctattgcccagactggggtgcagtggcaccatctcagctcactgcaacctccgccttccaggttcaagcaattcttgtgcttcagtctcctgagtagctgggattacaggtgtgccccactacacccggctaatttttgtattttcagtagagacaggatttcaccatgttggccatgctgatctccaactcctggcctcaagtgatccgcccacctcagcctcccaaactgctgggattacagacgtgaaccaccacgccgggcccacactggagattcttgagattctgaaaggggcaggttccctgggaactcagagaatttctaatttccacctggagttcccctcagtcctagaggtctaataatt

SEQ ID NO: 326 - DNA, 17645 bp, Homo sapiens
gaaactttcttcttcaaaggtgagtcatttcacttggcctcatatatgttggtttcctgcccacttccagtgacccactggggctgtgggcttaccctggaagcggaacttttttcttctttgagacagggtcttgctttgttgcctgggccgcagtgcagtggtgtgatcatggctcactgcagcctcaaaatactgggctcaagcgatcctcccacctcagcctccctggtagctgggaccacaggcacatgccaccacgccttgctagtaatttattttattattttgtagagatggagtctcactatattgcccaggctgggctcaatctcctggctcaggtgattctccggtgtcagcctcccaatgtgctggcattacaggtctgagccaccaggcaaggccctggcacttttagcgctaaaaagggaaaagtctcaggcgggccaggatgggctggtcaccctagatccattgcgcccttgatttccagatgggacccctccccacccagccacacaccctgggggaggagacctcctgctgtctcatgccttcctgcgaacccctttgtcccctgcaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcggtgagtggggccggcggcggggcgcgctggggccggcgcggggagcccacccctgacctcccggcctccaccctgcagggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaagcccttccattcttctgagcattgatggacctggggagaagtgtggtggcaggaactggactgacctgaatctccctgcttcgcagaaggaatccatggttgatggggaatctaagaaggaagagtgggcccgggcgtggtggctcatgccttaatcccagcattttgcgaggcccaggcagacggatcatttgaggtcaggaatttgagaccagcctggccaacactgaaatcccatctccactaaaaatagaaaaaaaattagccaggcatggtggtgcatgtctgttatcccagctgctaaggaggctgggacaggataatcacttgaacccgggagagggaggttgcagtgagccaagatctcacgattgcactccagcctggccaaaagagcgagactccgtctcaaaaataaaaataaaaataataataataagaagaaagaagagtgggaggacgaagtagagaggaatcgaaaagttggttatggggcacccggaggacggacggccactgtggaattgagactgcctcatggctccatgtagacttccagagcctttaaaattttatgactgctacacaaaaatgtcatgtcaaagtgattatttttattttttaagtggtatcgtttaaaaatggcatggtctcataatcaaaatgtaaaacttttgtgcttcaaaggacatcatccagaaagttggaaagaggctgggcacagtggctcacgcctataatccgaatagtttgggaggccaaagtgggaggatggcttgatcgcagggtttcaagaccagcctgggcaacatagtgagaccttgtctctacaaaataatcaaaaaattagccgggcatggtggcaacccgtgtctgtattcccagctacttggaaggcgaagaggagagaatcacctgaagccgggaagtcttggcaacaatgagccatgatcacgccactgcactccaccctgggcaacaggtgtgtctcaaaaaaataaaaataaaaataaaattggctgggcacggttgcttatgcctgtaatcccgcatttcgggaggctgatgcagacgtttgagaggcagatgtcacttgagtttgagagttttagaccaactggccaacatggtgaaaccctgtctctactaaaaatacaaaaattagccaggcgtggtggcgcatgcctgtaatcccagctacttgagaggctgaggcaggaaaatcgcttgaacccagaagttggaggttgcagtgagccgagatcgtgcctctgcacaccagcctgggagaccaagcgagattgcatcaaataaaaaaaaaaaagaaacacaaaaattgtcacatggtaccatttcagcgcactaagatggctagaattaaaaagacacagagcataacaaatgtatctggggatgtggagaaacaggaacccccgggcactgctgctgggaatgtaaaatgacagacaatttgaaacatagtctggctgttcctcagaaggataaaaacacatttgccatgtaacccagctattcttctccttcatacgtatccaagagaagtgaaaacataagtctgcacagaaacttttgcgtgaatgttcacagcagcgttattcagaatagcaaaaaaggggaaagaaccccaacttcctttgaggggtgaatggagaaaccaaatgtggtctatccacacagtagaatatcattcagccagaagaaggaatgaaggactgatccgtgttacaacacagatgaacctcaagaacagcatgttccgtgaaagaagctagacacagaagatcacgtagtgtataattctacttataagaaatctctgggagagatgcatccattgagagagaaagtagataagcccagacgcagtggctcatgccagtaatctcagcattttgggaggccaaggcgggcagatcacttgaggtcaggagttcgagactccttggccaacatggtgaaatcccatctctcctaaaaatacagaaattaggccaggctgagtggcagaacaagactccacctcaaaaaaaaaaaaaaaaaaaattgtcacgtgataccatttcagcccattgggatggctggaattgaaaagacacagagaataacaagtattgctgaggttgtagagacacgggaaccctcgcacactgctgctgggaatgtaaaatgacagacattttgaaaaatagtctggctgttcctcaaaaggataaaaacacatttaccatgtaacccagctattcttctgcttcatacatatgaagtgaaaacatacgtctgcacagaaacttgtacgtgaatgttcatagcagcattattcggaattagccaaaaagtggaaagaacccaaatgtccttcgaggggtgaatggagaaaccaaatgtggtctatccacacagtagaatattattcagccagaaaaaggaatgaaggaataatgcgtgttacaacacggatgaacctcaagaatagcatgttcagtgaaagaagctagacacagaagatcacctagtgtataattctacttataggaaatgtctgggagagaggcatccattgagagagaaagtagatgaggccagacacagtggctcatgcctgtaatcccagcactttgggaggccaaggcgggcagatcacttgaggtcaggagttcgagactccttcatcaacatggtgaaaccccgtctctactaaaaatacaaaaattagctgggtgtggtggcacgtgcctgtaatcccagctactcgggaggctgagtcaggagaattgcttgaacccaggaggcagaggttgcagtgagccgagatcgtgccactgcccttcagcctagacaacagagcgagactctaagaaaaaaaaagaaaaagaaaaagtagatgagtggttatccagggaaatgaggactggcagtgatgtctcagaagggcagaatttctcttagaggtgataaaaatgttctaaaatgggttgtggtgatagctgcacagttctgtgctttgaattgtacagctcaatgagtgaattgcattgcctgtaaattgcatcaccataaagctataaaaacagggtacatacagtctgggtggatcccaagatgtcttcagatggtggcctttgagagtcatgaggggctagggttggagctgaagcctaaagcatgacttttagctggtgcaggagtggcttccttctgtctcccactacaattcagaggatactcagggaaagatctggacatcctgtatgtggaaaggcggttgcgcacagtggaatggactcctaagtggcaggcaggtgacaaccgttgtctacttcacccaagggaagatttctccatggagcgtgttttataggttctgtctctccgagtcccctttgagaatataatgggatacattgcatccatgctgaattcctaagccccaggacctcagaatatgcccttatttggaaacagggtctttatggaggtacttaaggtacaatgaggtcactggggtggatcctacttcttttttttttttttccgaggggaattttcattgttgtcccccagactggagtgcagtggcaccatctcagctcactgcaacattcgcctcccgggttcaagtgattctcctgcctcagcctcccgagtagctgggaatacaggtgccggccaccacgcaaggctaatttttgtatttttagtagagacaaggtttcaccatgttggccaggctggtctagaactcctgaccttaggtgatctgcccgcctcggcctcccaaagtgttgggattacaggcgtgacccactgcgcccggcctagggtggaccctatttcaatatgactggtgtcctttggaaaggggaaagggggacagtcacacccaggcagaacgtgatgaagatgaagatggccatctacaagggcaggagaaacctgaacagaatcccagctccgggccctcagaaggaccccacgctgcccacattgaccttggacctccagcctgcagatcgtgagggaagagacgtcttcgacttagggccccttgtcgtggtacttccttagtttggccccaggaaaccatcccaaaggcaagggcgtggttgtgctcagctgggggaagggggctgggggccgtgaggaggaggtgggaggcccagccaggctggagggtcagaacccgtggagctagaagagcccgtaggggagccccaagattgctgagaccagtgaccttcggccccagatggccttgccttggcccagaagggtcagaaggacctggtcagccaagctcagacagccggcaggatgccttccaccctgcagagggtcctatcttgtcccacaggtagatctacatcaccactagccacccctccaacgtgcacaggcccctgccctcacggcgcccctcttaggtccggcagttcctgcctccttctgatccagaagtttctctggcctctggagccggggcacacctcatgcaaggacagggtccaaattcctttgtccttggatcccacttggctgacgtcaccttcctgtactcagggagtttccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactgactcacagttccacatggctggggaagcctgaggaagcttacaatcatgggggaaggcggaagagaagcaaggcacgtcctacatggcagcaggagaagcagggtggggggaactaccaaacacttttgtccgcgtgtttgtgtgttttttttatttgagatggagtttcgctcttgtcgcccaggctggagtgcaatggggtgatctcggctcactgcaacctctgtctctctggttcaagtgattctcctgcctcagcctgctgagtagctggggttacaggcatgcgccaccataccaggctaattttgtatttttagtacagatgcggcttcaccatgttggccaggctggtcttgaactcctgacctcaggtgatccgcccacctcggcctcccaaagtgctgggattacaggcatgagccaccacacccggctgccaaacacttttaacccaccagatcttgtgagaactcactcacttacaccagaagcgcatgggggaaaccgcccccatgatgcaatcatctccagcccggcccctccctcgacatgtggggattacagtttgagatgattggggtaaggacacagagaaaatcatctcattctgcccctggaccctcccaaacctcatgtccttctcacatttcaaaactcaatcatgccttcccaacagtcccccaaagtctaaactcattccaacatcaacccaaaaggccaatccaaagtctcacctgagacaaggcaagtctcttctgcctataagcctgtaaattcaaaagcaagttagttacttccaagacacattgtgggtacaggcattgggtaaatgttccctttccaaattggagaaattggccaaaaaagggggctacaggcctcaggcaagacccaaatccaccagggcagtcattaaatcttaaagctcccaagcgatctctttggctccatgtctcatgtccagggctcactgatgcaaggggtgggttcccagggcctggggcagctccgcccctgtggctctgcagggtgcagcccccgcagctgctttcatgggctggtgctgagtgcctgcggcttttccaggcacacagagcaagcgcttggtggatctaccattctggggtctggaggagagtggtcttctcacagctccactaggcagtgccccagtagagagtctgtgtgggggctccaaccccacatttcctctctgcattgccccagtagccgttctccatgacaacctgtgcgtggtcatccaggcatttccatccatcccctgaaatctaggcggaggcccccaaagcccagctcttgtcttctgcagacctgcaggcccaacaccatgtggaagctgccaaggcttgggacttgcaccttctggagcgacggcctgagctgtaccttggtcttctttagccacagctggagctggagtggctggggcacagggtgccatgtcccgaggctgcacagagcagcggggccctaggcctagcttgaattaatccccaggaaatgggttttcttttctaccacatggtcaggctgcaaattttccatcttttatgctctgcttcccttttaagtataagttctaattccaaagcatctctttgtgagtgcatgtaaccgtatgctttcaagaaaagacaggtgacttgctgaatgctttggtgcttagaaatttctactgctggcggagtgcagtggctcatgtctgtaatcccagcactttgggaggccgaggccggcagatcacgaagtcaggatgtcgagaccatcccggccaacatggtgaaacactatctggactaaaaatgcaaaaattagctaggcatggtggcacacgcctgtaatcccagctacttgggaggttgaggcaggagaaccacttgaaccagggagtccaaggttacagtgggccaagattgcgccactgtactccagcctggtgaaggaccaagactccatctcaaacaaacaaacaaaaaaaacaagggacaggttcttgctatgttgctgaggctgcagtgcagtggtgcaatcataggtcactgctatggatggatggacagatgcgtgcacagaggcagggatggatggacagatgcatgcacaaacacgctgagcgcctactagcacaagacaagacatacagggttctgctctccccaggtacacagggttgagatccaatgggaaagcagtgagccagctgagtcaggggtacgaggagacactgagcagagaaataacccgggacatctgaggccagaagccaaaactatggcatcagtagggagactgcagaaggcggcaggtcccggatcaccaagggccttgaaagcatgtggaagactttgatcaatgggggaatcattaaggcattttgcattccggaactatcatcagcttcagcagggggcagggggtaggatagaggcagggaggcaggaagttctcgcagggtccaggcaagagatggtggagtgtggtcctggggaagggggcagtggacggatctgagggaggttcagttaggatgggcaaggattgagatctggctggatcctggtgacaggggagatgaggctggggcccttggaggatggtgtcctggtgctgttaatgcaggtgtgagagtgggaggaggaggagcaggctggcagaaggcaggcatgagtacaggtctgggcgggagtctgcagcgctctgggctggccacacgggtggggcaagggaggtggaggatcctgccctagagcttggtctcctctgtctgaggtcaggttccccagaggtggggctccagagggaaattcttgtgcaagcagtttctcaggggccatgtgctgaggggaatggggagcaggaacagcctagaagctgagtgaggatgtggtctcagctggagaggaggctgatcgcatgggagctctgcagcagggatggcaatgccggggaggccgtcccgcctgaggccaggcccagctctttgcagccccatattaactacattggctgctggggagcctgagtgacgggggaagggggcagccagggagggtgcctaggccctgtggagggcttggtaaggcagaggctggggaggctgtgtgcctcaacattcacatatgggcttcggatgggcgtggtggcacatgcttgtagtcccagctactcaggaggctaaggcaggaggattgcttgagtcagggaggttgagactgcaatgagctgtgttcacaccactgcactgcggcctgggtgacaaagtgagaccctgtcacacacacagaaaaagagaatgtgggcttcaaagttgaattcaagtaagtcagggttcttccacttgtaatgaacaacttccttaacctcattgtctcaggttcctcccctgagaaatgcgaggagaacggcgcctgctggtggcgggggcttgccgatgaaatgagccattcacccatgcctctcagcacagggcctgccctgggccgcatactgtgcattgtcagctgctgtcggagctgggctagtggccgccttgagagccagcagtccacgggggttggcgagcttctgggaggaaagggtggaacgtgactgtcaggtacagagctacagagaaccccagcatgaaggagtaggtggcaggggagaaggactcaacagagatggagaaagactaagcccaaaggtgatcaacaacaagagtgaaggaggaagtggtcagctgtggctggggcaaaacaagcccagtaagttacattggcctgtgtttggtcatccagggacaaagtgacctttttagtgccggtaggcccagtgggttggggaagaatttaggcggcagtgggcttaggcatgagaggagcggaggaagagaagattgagttgagaccactggctggagaacttgaccaggaagggagggcagagagcggcgtggagtcgggggagggaataggtccaatgagcgtcttaggatgaaggagttgtgagcactcagcacaggataagctgatacaaagaaagggatggaggatggatagactgacagatgcatgcacagaggcagggttggatagcatgacagatgcatgcacagaggcagggatggatagatggacagaggcatgcacagagagagggatggatagatggacagatgcatgcacagaggcagggatggatggatggacagatgcatgcacagaggcaggaatggagagacagatgagtgcaaacaggtagggatggatggacaggtgcctacacagaggcagggatgaatggatagatggatgcacaggggcagggatggatggatggacagatgcatgcacagaggcagggatgtatggacggatgcatgggcagaggcaaggatgaatggatggatagatgcatgcacagaggcagggatggacagacagatgaatgcacagaggcagggatgtacagaaggatgcatgcacagaggcagggatggacggagggacagatgcaggcacagaggcagggatggatggacagacagatgcatacacagaggcagggatagatggacagatactggcacagaggcagggatggatggacagatgcaggcacagaggcagggacagacagacagatgcatgcacagaggcgtgtatgaatggttggaaggatgcatgcacagaggcagtgatggatgggtggggagattggatggatagatgccggtaggtcgttcttgtcctggaggaggtgatccaggctaagtcctcacaccgggaggggcaggaggcgagcatggggagatacagctgtgtgtcccagtgcactggaagttacagatgacatcgatgtcctgtcctgatgaaacaggaaacacaattgtcatttgaaagttagggctgagggccgggcgcggtggctcacacctgtaatcccagcattttgggaggctgaggcgggggggtcacctgaggtcaggagttcgagaccagcctggccaacatggtgaaatcccgtccctactaaaaatgcaaaaattagctgggtgtgttggtggggcgcctgtaatcccagatactcaggaggctgaggcaggagaatcacttgaacctgggaggcagaggttgcagtgagctgagatcacgccattgcactccagcctgggtgacagaggaagacaccgtctcaaaaaaaaaaaaaaaaagagacagaaaagaaagttgggggccggggctggatgaaagcttgaggggctgtgggcctggcatggggctgaggggagtgtgcaggagctgcctgccaaagcctggggcaaggatgataggaggtgctggggcccctgtggactgccctctgagaatctcgtgaggctgggtctgcacagctgtggttgtgtaacttcccccagatgcatggtgtgacaagggtgcaggaaggggtgcagggcccggaagctcagtgtggttaaagacatgcaaggcaggatagaaggtgagagatgaatgatatggccgtgatcaaaacaccaaacttcagtttctcagaaaaaggactcagagca

SEQ ID NO: 327 - DNA, 21152 bp, Homo sapiens
gaaataggtggaagattattgagtaatattaagggtccaactgatgttgaaagtcaggcatggcagtaatctgcattcttcagtaatgctctccctcagtcctgaagagcatagacataggattagaaaatgtgggctgagcgcagtggctcatgcctgtaatcccagtactttgggaggccgaggtgggtggatcacttgaggtcaggagttcgagaccagcctgaccaacatggtgaaatcccgtctctactaaaaatacaaaattagctgagcatggtggcaggcacctgtaatcccagctacttgggaggctgaggcaggagaatggcttgaactcgggaggcagaggttgcagtgagacgagatcatgccacttcactccagcttgggcaacaggagtgaaactccatcaaaaaaaaaaaaggaaaggaaaggaaagggaagggaagggaaaggaagggaaaggaaaggaaaaatgtgatcttgactttggaggcctgcccagtgtgttggaaaaatctagggaggaagaagtctaaggtcctagtgaaaagactgaagtgagaagtgatgaacccagggaacgaggtaagttgagggaaggaaaggaggcgagggctgggcgcagtggctcacgcctgtaatcccagcactttgggaggccgaggagggcggatcacaaggtcaggagatcgagaccatcctggctaacatggtgaaaccccgtctttactaaaaatacaaaaaattagccgggcatggtggtgggcacctgcagtcccagctactcgggaggctgaggcaggagaatggcatgaacccaggaggcggagcttgcagtgagccaagatcgcgcggctgcactctagcttgggcacagagcgagactctgtctcacaaaaaaaaaaaagaaagaaaaagaaaggaggcaagaaggagactctttggactgagatactagggcagaaagtgcagccaccaaccaaaaatcttgttggattgaagagctgctgtgaagggaatcaagacatgggtgacatggcaggagtatgggttgtggtcatatagtgggaggacagtttttcacgtgggtttcctggagaggaatcagatgtttctgaccattactagctgtgtgccagcctaggaagttcattcttaagtctttcagaagtggaagaaagcaggaaaattgcttgctaaattacccatgaaagtcaaaaccattcttccttagaacttttgaaagcgaattgtcactaggacatatggggcttgatctggtcaaccatctcatgattttaaattttcatttgggatttttatctacctcttcatagcagagcaaaacaaacttgtctttttcccataaatataattaaaaaagagacaggctgaggatacccaccaatgggtcactctaggccctatcaaagtatgggatcaggatatgaagtaaatcccattaattgctgtaattgatagctccaaaagggagtatggcatacaattagaagttcccaaaagtttgctactcccctggagatgttataaaatagaatcagggttattagcccacattcaagcaaaagcttgtttaaagtggggcattttctaacttcttctggatagactaggcctctcttcacagttttgttaaatttagtgtttcatgaaacttaccaaggcctttaatattatgtacgtgcctttaattataagcacatatttcttctctattgcaagatttctcctgaactttacagatctgtcagtgaaagaggaaacttggataccacatgtggaaataacaaaagtgggatatgaacctcaattaactagcacataaagagtgctgttccctgaaaaaaactgttggattcatttaggtaatcatcgcttgatgaatgtactcttgctagtgtaaccttcttattaccatggagttacaaattaggtctgcaaaagacatctggaaacatctggccccttctaaagcaataacattccagtgtgttttttgacatactatgcagactcttccaataattctggatcttacacattgaaagctctcaagcgaaggtgctagttagatttttttaatgctttatttcccccaaaatagcaatcaaataactggatatacacatttccattttataatcactatcacactgtaatctaattacttgtttaaaagtgtgtctcctcactagattagccccttagagaacaaaacatgtatccatctgtgtaacttccttatgaaactacaggtatgtgctggaactgtatcctctacaaacaagagtactaataggtgagtagctttctttaagaacatttattgcagtattgttaaaatggcagcaaactggaactaaaccaaatgtccatcaagtggggaataattttaaaacttataataaatctatagatagaatattatttggcttaaaaaaaatgagttagagctgcatcagttgacctggagagatgtccatgatatattgctccatgagaaaagcaactaacaaatggaattatagagtgttattccaaattgtaaaagtaaacaatgacggcttgtgaaaaagataggtgtttatgattgtgggagaatattcataatgcactaacaggggttaccttaaggatgatcaggaattaaggtaaatgagtgtgggagaatagtgctagcaaaatgcaaaaatactcatgccataatgctaagggaaaatgcagaatgcatgattttagcaatagtttttttaaaagaaaagtttacctttcggtgtcttactggttgatgccaggcatagttcttaaagctctacatagactgtttcacttcctgcccgcaccaactctgtgaggtagggattattatttctttaatttcacataacagaaaactgtggtccatagaagttactgagctggccagtggtcacacaataattggctaagctaagacaaaataataacaggcaaataggcaaaaaatgaaattgcatttttttcctagaaactaatcagatcaaatgaaaagtatccatttaattaagtaatagacctgtggattattttttgcctcgaatttttgctattatttaatattacttcatttaaataaagtaaaattactaaaaataaatacaataaaatggctagtatggtggttttcaaaacctgtcctcaagtcctttgatgtgggaggtctgtgtttcttccctttgaattaggtggggcctgtgactgatggctctgggcaaccacataggagaagcaacattttgtgcttttggatgctgagtcaaaaaaggtaatacaacttcttcctggcttcctttttgggaagcttgctttggaggatgccagccaccatgaagtgagtctcatacagagaggaactgaggccccagccaacaggcagcatctactgtcagacttcagatggtgccagcctctccctagctttggaatcttctagctgaggccccagaaatcacagagcagagacaaattacgccaactacactttgtctgaatcttcagtgagcataataaatgtctgagtttttgtttgttgttattgttttgtttatgtttggttttgtttgttttgttttgctacaaattacatagcaacagatagctggaagagattctgcagtgatgttcgtcagtttggggtaggttttcccttagttttattcttctgctctctttaggcatattgtggtggttaattttatgtatcaatttggctgggccacagcacccaaatatttggccaaacattattctatatgtttctgtgaaggtgtttttttttatgagattaatatttaaatcagcggactttgagtaaagccgatgacattccatgatgtggatgggccttacccattcagataaaaatcttttttttttttttatactttaagttttaaggtacatgtgcacattgtgcaggttagttacatatgtatacatgtgccatgctggtgcactgcacccactaactcgtcatctaacattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattctatggtgtgtatgtgctacattttcttaatccagtctatcattgttggacatttgggttggttccaagtccttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttgtctgcataaatgtcttcttttgagaagtgtctgttcatgtccttcgcccactttttgatggggttgaatagaacaaggactgacctctccagcaagaaggaattctgccagcagattgaactgcaactcttgcccgatcttcctgcctgccacctacctcatcaggttttggattcaccaagcctccagaatcacataagccaattatgtcaaaacaaacctttgtttgtcatcattgttttgtctgtgttttggtttggtttggtttggatgggctcaagtgatcactcttcctcggagccaatccagttcaattaagttcatttcccattgctacccctctaattttctcaccttgttcagcacacagaagagaaatcttacttctgctatgacaaggctgcctagatttggaaacataaaatggcataacataacctctctctctctctctctctctctctctatatatatatatatatatatacacacacacacacactctctctgaatagcacacatattacacacattatacctttaactctgcttcccaaactactcaccagttgcgcctgcatccaaacctcattgtagtatccaaataaatcacttctgtttaagttattatatatgtgatatatttaagaggtctagaaaagagactaatagtagcatagagtcagtcttctaaacttctttctctctcttaggacaaaaattggaagcaatatgcagccatttccaacaaatgagcagcccacatattagatggcaacatcaaggatagaaaactttaggaagataaaggcctgggaagtagattagctgtggctttcgcctggatgtggcttcatggagttacatatgccactgagaattcccgagtgacaaagtgatcaaatccaggcaaaggaaaaaaggaaaggtgcagcttacccctcgaagcagtgggcaactgtcagaacccacttcttggcaatgaggacacagccacagatatgtccactgggttcactctgcagagaacactgccatggccaccttccagggcgactcgtccgacctccaaggatccttttgttcattcgggcagcagggcggcgcccacagtctaccaaggagcagaagacacagtttgtgagttgatgccaaaccttgctaaatgcttagctctttgctgtcacttacaagcgatcactcttcccctgagccaatccagttcaattaagttcatatcccattgccacacctctaattctctcaccttgtttagtacacagaagagaaattttacttctgctctcacaagactgcctggatttggaaacataaaatggtataacattaagttacatatttcttgttcaattcaaacactttaccagtgaaatacaagacagctccaactgttaccaccagaaatcacattctctgagcatttcctgtgttaccacaggaaagcacattcctcttggtgcaggaattctcaaggcaggagtgtggtcagatattaatcatgttgtaggcaggagtatatggaatatatatacttctttttttagtttatttaatgtcatcataatttaatttcacatttgtgggaaaagaaactattttaacaaaatttcccacatcattttggctggtggaaccaccacaatgcaaattcaaactacagttctcaaggggagatgggagtactttttagagtcagtggtgaggaggcagcatgtcagatttttatgcttatacaaagtggtgtgtgctcaaaacaagttgagaaatactccaagatgagtaaaatatgacttcagaaatttgaagaacagattaagaaatggaatatttagactggaaaggagtcttaccaagactctcaaggttaaatttctgctatatgagaagttgacaagaggaaaagtagcttaaatttgcttcatataactttagacgacatgatcagaactagtaggtgcaatttacaagaattgtgggttcaggaaaagaattttctaaaatctaaattcaactttgaatgcaagaacatggtccctgttaaaggatctttcaatgtgatggcacaagataattcagtttggggtagaaattttaatcactaagttctcttccaaccatgaaacatttacattacaacctcaatgtaaatgaaaaaggacaataaaaatccatattgggactttcaaaaatactatgatgtacttagaatcctagatctatcagattgaaaaaaaaaaatgcaaccctaaatatataatttccacattcctttctgaagatttactgtattttcatttcttgctaaatttatgtaggggcaagtgcaattatttgcatacaataaattatgtaatacaggaaaagctcatttgctttctaccctcccacagtctaaaatcctctcttccttactctctattacattattctaaatttatttgcagcacttaccaaagcctaaaattatttttactaatttataatctttattttcacccccatatagtgtatgttccctgagatgagggccttcatttcccctcattcacttctacatcccctcaaagcctaatactgaacttggcattaaagaaatacttaataattagttgttatttgttagattgaaaacacatagctcttaggaataggaaaagtcatcaaagactattcatccaacttcttagtggaaattgcagttatataagataacacttgtagttagtaaaccaggactagaaccaagtttaccaactcccaatctagaatgcattatttatttatttatttacttgacctgaaaggttttttctggaattacaggtttggggaaacaaatcacttggttaaaagatttaggtcattgttttagaggaagtacttcaattgacaaatattcagaaatttggctgcagagtttgttttatgaggaaaatgtcaagaactttttaagaggaaatggtccatttttagttttcctctttaaaattcttaagaagtagcaacatttatgagcttcagagtcagatatatttatttagagttcagacactatcacttagcatctgtgggctgtgagatttgagcaagttatttaaatattcaagctgtaaaatattggataatcatccatggttcacaaatctattatgaggtttaaacgagtcagtgtatataagattacctagctgtgtgcctataaagtaataagaacttagtaagtgtaaatttcctcaatttatcttcctcctacaccccacccatagacaagggaagcaaccctgtttaagatgcaatgattttttagggtaaacttaagtgtactttcaaggcaacttgattataatttcatttttgtgtctattcctctcttagacattccaagttttcttagttatcattacttcagttccctctgtttactagttctatgtagcatctgcaggaaatgcagacatgagggtttattttgaataagatattaaaagtaatccaagattagaacccaagttcctctctcctcgccatgatagtttctgtaatcgtgaataaaagagaaaaaaaatctatgtctagaaagaagaaataaaagcaaccaatgttgaaatgtaaaggcaatagtaaatctatggaaactctttactgatatgacaaatttggattatcttaagttaaaaaatggaagaaaggcccaatgataaactcttgctctgtaatctgactctacacagctcttatgaatgcattcttacccatttactagaagttcatgtaaagtggtcccattgaggctctcccagttggagtgtaatgtcagccaccgcggctctttctcctgttcctgtatcaatttggtcacagatggttctctgatacaaggcaaatactggataagtattcaaagtacaatgatctttgaacaggcattatcattatttagcactcattccctttcaaaaagaagcactaaatcatgtcaacatttcaagaggagaatttggactgttacaaattgttagagctgttttagtcattctccctgctgacctgtgtttgaactgcatgaggtgttaggattataatgtgtatgatacaaaagttccaacaggtaaaacataagaataactttaggcagagatcaaaagtaaaataaaatgtatctagctaggtttttttcctcctcttttcttgtccattgtaattctgcaatatagcaatataaaataaaataaacaacacataaagagaatcagtggccatttagcatttatttagacagcataaaagttgtaagaattgtaatatttctatgtttgtaggttgttgttgttgttgttgttgttttttttttgatgaagtcttgctctgttgcccaggctggggtacagtggtacaatctcggctcactgcaacgtctgcctcagggttcaagtgcttctcctgcctcagcctcccaagtagctgggatcacaggtacatgcaatcacgcccagctaatttttatatttttagtagagatgaggtttcaccatgttgtccagggtggtcttaaactcctgacctcaagtggtctgcccacctcagcatcccaaactgctaggattacaggcatgaaccatggcacctggcctcatctgattattatttttaaactattgtaatcacataatagaaaatggacaaaaacttcccctaactcatacttttaaaaaggcaaggaagaaccctctaaagggaatacttgatgatagaataagagccaaagattaaaaacacaagagtatttcataatgaatgaattataaacatttgattttaaaacaaatgtcatacatcctagccacaatgaagaagagtggcttaagatataaatttatttagaaatttgaattgactgttagattaccgaagatatcaaaaaaacctcttacaaaaataagaatttttctttttcttggccaaaatgaatccggctctccatcaattccagaagttctgaatgcagaggcaaagtgagatggaaagtataaaagtcagaggccacacatactggtcatggtgtttctcctgataacctgcatcctgagaattcccttctgcgatagaactacctatggacctcctaaatccaggtaaagccaaaagaagataaactttagattttgttatttaatcaggtcattcttaaatcaggtattcatagggcaacaagatacttgcatggggagtgcaattaggagagagtgtgcactgatgctggataggaaaatcattgcaaggaacaccagcctttcaactcaaaaggcccccagctgccctgaggaagggctccacagacatccacaggatgtttttgcatttcattcattagcttccaagaggaaaggcaatctagatggaatttctcagttataagtggaaaatttaagaaattaatcatcaaggataggggagtatcattatgaaaattaggtttccatgaaattcttgaacactggcatgtttctcatgcacaaacataaactttcagcaccagaaatgtcatccaatggcccatttaaaaaagtcagtgaatttgtttggttgtatttctgccatcgtacagaatctgagcatctccataacttcaatttccctttcttttttttccagctttattgaggcattcttaacaaataaaaattgtacatatttaaggggtgtaatgtaatgtttgatatatgtataccttgtgaaatggctaccacaatcaagctaagaagcatatctatcaccacatagttacgtgtgtgtgtgtgtgtgtgtgtgtgtgtgtgtgtgttaagaacactaaggccaagaatcttagcaaatttcaagtatacaatttagcatcgttaactatagtcaccatgttgtacattagatctccggaacttattcattccacattaccaaatctttgtaccctttgaccatctccccattttctccatcccctagtttttggcaactaacattctactctctgcatttacaagttgacttttttagattccacatataaatgagatcatgcagtgtttgtctttctgtgcttggcgtatttcacttaatatgtcctccaagtttatccatgttgtctcaaatggcagaatttccttctaagaatactgagtagtgttctattgtgtaaagaaaatgtagtgtgtgtatgtgtattctttgcataaaatttctattgtataaagaaatatatattctattgtgtaaagaaaatgtggcatcacattttctttatccattcacttatcagcaaacactgaagttgttttcatatcttgggtattatgaagagtgctgcaattaacatgagagtgcagatgtctttttgagataattatttcctttagatatatacccagaagtgggattgatggatcatatggtaggtagttctattttaaattttttgaggaatctccatactgtttttcataagtactgtaccaattaacatttctaccaagaatatatagggtttccccttctccacttctccccaacattttttatgttttctctttttgatgataaccattttaacagatatgaggtgacatttcattgtgattttaatttgcatttccctgatgattagtaatgctgagcaccttttcttatatttgttggccattctatgtcttccttttagaaatgtctgttcaggtccttagtccacttttcaatcaggttatttggctttttgctgttgaattattttagttccttatgtattttggatactaacctcattggatatatggtttttttaaataactttgaaaattataaaagtaatacttgtacacagaaaaatatatcgacaattataaaatgataaagttgttttcttctcctatcatatcaacaattataaaatgaaaaagttgtcttcttcctatcttagatgcatagaaacaaccactgtaaatagtgtttgagtatctttgtcaagctctttctacaattcatgtatacatttccctcctttgctacacacgttgttctgtgtggtcttgatactttcacttagtgacttatcttagaagtctttccaccataacagctaacaggtgttaactgttttctatatgacaagcactaaaagactaacttgttttatttaatcatctcaacaactctgtgacgtagactttataattatttcccattttggagatgaaaaaattgaggtagagaaaacaagtaacatgcccaaggcacaaaacaagcagacggcaaagctggtaatttaatccctatggtctcatgtcagagtacagttcttaaagtgtgaaccctacacagttctcccccattgacagcacaccatgttcttttgatagctgcatagtgtttgttacatggatgttcatacatttacttaactaatctctgcacacataggtttgggggtatgataaaatagcagcagttaatatcgtaaacattcaccttcgcctacatgcaaaagtatgattttggaataaattcctagaaataaaatcattgaatcaaaatttgaatttttgattggtattatgaacttccatttcaaagaataatagtaatatacatgcacatcaagaatatgtgtgcctgtacttctccatttttaaaactatgtaaatcatcttacgtaaaaggtggctggaacttaagagctgctcaaattttgtttgatgattgggattgcttttgacttaaataattgaaaccgttttgtattatatgaaaagacaaaaaagtcctgttgtgtagaaagcaaaagagaaaatttaagcatcaaagtcactgtatcctaactgagtctgtgcaggtaatacagactcaaaatgcttccatagcatctatggattcatacacggagaaggaaattttagcaatgatctaatccagcagctagggcaagagtaccagtggaggcccaattgccatttgtctacatatttagaagttataaatcaagttatcaagctgttaaagaaaatttctctcctcctctcttgacaaacacatctgttaggttcaaatacagaactcttggactcctgagaacagtgggtttcaaactttagcattcatcagaatcacctggaggacctgttacaacacagatttgttggcctcatccccagattttctgattcagttaagtctcagatgggacccaaaatctgtctctctaccaagatcacaggtgatgatgatgatgctggtctgagaccgcactttgaaagcatcactctagaaaagggatgaggctccatgtgagcagaactccttggctaacagagtccttaccccatggggtgagctagaggaggagggccggagggtgcctataaatcagggtttctcaccctaaatgctattgacaagttataccagttaattaattgctatgtagagtgattcctgtgcactgcaggatgttttgtaacatccctggcttctacccactagcaagtaagaccccatcaaccctggatttacaatttaaaaaataatgtctacagacattccaaatgtcccctaggacaggggtccccagccccagggcccctgttaggaaccaggccacacagcaggaggtgagtgcggggcaagccagcaaagcttcatctgtgtttacagctgctcaccatcacaggcattactgcctgagctccgcctcctgtccaattagtggccttagattctcccaggagtgtgaatcctattgtgaactgcgcatgcaagggatctgggttgcgtgcttcttatgggaatcaaatgcctgatgatctgtcactgtctcccatcaccctcagatgggaccatctagttgcaggaaaacaagctcaggtttcccactgattcaacattatggtgagtagtataatgatttcattatatattataatgtaataataatagaaataaagtgcacaataaatgtaacgtgcttgaatcatgccaaaaccattccccccatcccatcccagtctgtggaaaaattgtcttccacaaaaccagtccctggtgccaaaaaggttggggattgctaccctaggggcaaagtcacccctggttgagaaccactgctctaaatcatggagcccagggcaaggcccctctgctctgggcctgaaggcagtgctatacagagaagcaaaaggatttgccttatatttgcttcttgaggaattgtgtagtcataagacacacatacaaatatatcacttttctgatgctgaaatgagagaacagagctcattaggagttctggaacatcctgacattatgagagggattaaatatttcaaggcttaggagaacagccagatccctagacaatttggcctactctcccatcctcaagtcacttcgtttagtaataaatatcccatgcttgaattatgattatgttggggctgcttacttaaaaaacgaaggtcatcacaaattcccccaaaaccagggcttttttcttacctctaacaacaagacagaagtgcaggaattacctagacatgtaacacacttcagttgaaggataaggtttgtcctcttccatctattgatgggggaaaataatctaagcatccagcctcagtccttgacagttcatcttgacatataaatgcctttcacagtggataagataaattttttgcaattctaaatatcctgttccaaacttgaaacatttatactaaacattttgtatctgatttcaaaaatctcttcttgaatcttgtcatattctccctgtttgggtcccacagatttgacatactaataactgaaagttattgtgtcaagtagaaattttaacaggcaggtactaataggtttcaaacaaaacatgaatgaactctgctacagaaacatttctcaggctggatagctcagttcaatgggagtttatacagcaaaactttcatcaatagaaatgcttaaagcagagcataagttctgagcttatttttctagttaactcagtattttaaaaacactttttattgcaatcctaactgacaatagatgatagatagatagatagatagatagatagatagatagatagagatagatagttagatagattttttttttttgagatggagtctcactctgtcgcccaggctggagtgcagtggcgtgatctcagcttactgcaacctccaccttccaggttcaagcaattcttctgcctcagcctcctgggtagctggggactacaggctcatgcgaccacgcccggctaatttttgtactttttggtggaggtggggtttcattatgttgcccaggctggtctcgaactcctgacctcaagtgatccacatgcctcagcctcccagagtgctaggattataggcgtgagccactgcgcccagcctataattttattctttgactatgtgtttgtctatctcagagatggagtgtagtaactgtattaggcaaggatctataggtacaaatgacaaaactatctcaaagcaaaggggggaggttaatggatcataaaattaacttgcagagtatttatatttcataaaataaactaataaacaaaactaaatatttaatccatttccaatataaaaattacaaaattgtaatgtgaactaaaatttaaatttataaaatatgactgttaaatatacattatcattctaatataaattagaaaacaaaattaataaaataaagcaccatttaaaataaacatcttattaaaagtgtaaaaataatcaatcataaacattttgaatgaaaatatcatttgaacatatataaaattcagtcttataaaataaacatgttgtaagaatatttttgagcagaagtgtctacctcttttggaatctatgccagtccagatatttccttctggctattttattttcaaaaatctcatctccttttttcgagaacttgaccttttgggacaacacttttttttgagagacagaaatgcaacattttattgacaatttaattttagtttcaaagaaaatatttcttgtttatcttcacatcttttgtttcatcatgtaaagctagagattatcagtttcaatttcaacatgactttttaaattccagttcttcagaaagactgtgaaccagagtagaatgtatttttctaacacaagtcttgctttgttggctgctcttctcttcttcttgagtataacaggaatataaaaatgctttctaaaaatacgtgcatcacttttcacttcaaagttttaagtcagtatataactatatggatccattacaagataaattaattcaaaattcaaaaaaaattaaacaaatattgaattaactaaaaaatcggcattttaaaaatgcctaaaatagtgctggaatatatgagtatcaaaaagtggaaatgtaattgattactaaagagatgtggatggtcttcaggatgattgatgccagggaaccagtaccctcaaggctcttcagctcgtctccacttccttctgtgttgtggggaggagggcaaaggggatggcagcttgattggcttaaagtaacttttctgcaagccaaaggactggttgcctacagctctaaactcacaggcattcgtctttataaccaaaaaagaaagaagtcatctctcccaggtccaatcaaaataaatcttgggccgggtgtggctcacgcctgtaatcccagcactttgggaggccaaagcaggtggatcacgtgaggtcgggagttcaagaccagcctgatctacatggtgaaaccccatctctactaaaaatacaaaaattagccaggcatggtggtgagtgcctgtaatcccagctactcaggagtctgaggcaggagaatcacttaaacctgggaggtggaggttgcagtgagccaagatcacaccattgcactccagcctgggtgacaaaagcgaaactctgtcttaaataaataaacaaataaaaaccttgttgaagatacaaataaaaatcttgttgaagaaacaagtatcccaaaaccaattactttggcctggcagtaagacactttgattggtccatcttgggataggtacctacccctcaaccaatcccagacccaaaagagaaagtcatgtacaaagaaggttgctcccatttggagcccaaggataaaatgggaagtgaagtaaatatcgagaaggaagggatgtaggtcccaaaggaagggaggaatgcagagaagcaacacaatatgtgcccgctgcatgtgatcttaattgaaatgtgttagttcattgttcttgagagtcaagattctacatgttcttcagtttgtatgttagttttaagaagacataggaaatgtaaaagattaggttgaaattagatttgacatgtttattaatgatacaatgggttaatcagtgagtgttcaagctgatataaagtgagttggagctcagaagaaacattatagtgacactttaaacaagtgacagagccagatagacaagggttaaaactgatgcttagaggttaatgaggtgggacagaaatggagacaacagattggtgttgtatcagatggagtccctctctgaggagctattattttagttagaggaacaaattacaaacatgtaaaaaactattttggatactgataagttgttggaataagacaaaataaccaaatgtgatagagttacatgctgagactgaaagctgcctcaagtaggattgtcaaagaaagcctaagtcacagatgtatgagctgagacatgaatgatgaagccctagagttctgtattctatgcaaaaataacggtgaaggaaagtttgaaatgttttatgcttgaaatgttttaacatcaatattaaggtcaatgtgtctaaagtttagtgggcaagtggagaatactaggatatgtattgggtcagagaggaaggcaggggccaaattatgcagtgtctgacaggtcagagtaagaaatcagattttcagtccaaactgtaaaatagtaagaaaagaagaccaaaggcttttgcatgttggtaatattattgctgtcagtcctgtctttcaggtaaaagccagattgcagtaggttttgaagacaacatgaaaaagacaccttatcagaagttaagtcattactaagggtctcctggcatatctagcttcaaaagcagactgcttccttacaagggcttctaacagaaataatacaagccctctttggtcaactcctgatggattattcaagttataaatcatgttcttatttacccaggatccattcatatcatgtccaagacaatgctgcaaccatggtgatgactgggagtaaattttaggaggaagttaaagtgtaaacccttataccagggattattagggactagtaggtaatataatagatgttgtctttgtggttttgcccagatacagaaatattctttgaaaacaatgtttgaccaacttctattgaccaacactaaaagattagggcataaaatcaaattgcaactaactccataaaagcatttttgccaaaatcatatgacccagacacactgtttcccgattatctaactttagataaagcttgtggagcccagagatataaagagtcacctttcccttagactaactcactcaaataccagatgtttcaactgagcatttggcaaatattagaaggcagtctaaactctgatttgtatcatcaattaaataaatgtccataggttttttgatactgaacatgcaagtagcaaagtcaatatgctgttgacatgatttggctgtatccccacccaaatctcatcttgaattgtaactcccacaattcccacatgtcatgggaggaaactggtaggaggtgattgaattatgggggtgggtcttcctgtgctgttctcatgatagtgaatgagttttaggagatctgacagttttaaaaatgggagtttccctgcacaagctctctcttttctgtgtgctgccatccacgtgagatgtgacttgctccttctcaccttctgccatgattgtgaggcctccacagccatatggaactgtaagtccattaaacctctttttttcttcccagactcaggaatgtctttatcagcagtgtgaaaatggactaatacagtaaattggtaccagcagagtggggtgctgctgtagatacccaaaagtgtggaagcaactttggaagtgggtaacaggcagaatttggaaaagtttggagggctgagaagaagacaggaaaatgtaggaaagtttggaactccctagaaactagttgaattgctttgatcaaaatgctgatagcgatatggacaataaagtccatgctgaggtggtctcagatggaaatgaggaacttgttgggaaccggagcaaaggtgactcttgttatgttttaccaaagagagtggtggtattttgcccctgccctagagatttgtggaactttgaacttgacagatgatttaggatatctggtagaagacatttctaagcagcaaagcattcaagaggtgacttgggtgctgttaaaggcattcattttcataagggaagtagagcataaaagttaggaaaatttgcagcgtgacaatgcaatagaaaagaaaataccattttctgaggagaaattcaagctggctgcagaagtaacgaggagcagaatgttaatccccaagacaatggggaaatgtctccaggacatgtcagaggtcttcatggcagcccctcccatcacaggcccagaggcctaggaggaaaaagtggtttcatgggctgggaccagggtccttgtgctgtgtgcagcctagggacttggtgccctgtgtcccagccatgacagctatgactaaaaggggccaaggtacagctcaggatgttgcttcagagggtggaagccccaagcattggcagcttccacatggtgttgagcctgtgagtgcacagaagtcaggaattgggatttgggaacctctgcctagatttcagaagatgtgtggaaatgcctggatgcctaggcagaagtttgctgcaggggtggggccctcatggagaacctctgctaggcagtgtggaagggaaatgtggagtcagagacccccacaaagaatccctactagggcattgcctagtggagctgtgagaagagggccaccatcctcaagaccccagaatggtagatccactgatagcttgcaccatatgcctggaaaagccgcagacactctatgccagctcatgaaagcagctaggagggaggctgtaccctgcaaagccacaggggcagagctgcccaagacccatgggaacccactttttgcatcagtgtgacccagatgcaagacatggagtcaaaggagatcattttggagttttaagatttgactgccctgctggatttcagacttgcatggggcctgtagcccctttgttttggccaatttctcccatttggaatggctgtatttacccaatgcctgtacccccattgtatctaggaaactaatttgcttttgattttacaggcttataagatggaagggacttgccttgtcttagatgagacgttggactgtggactcttgaggtaatgctgaaatgagttaagactttgggggactactgggaaggaatgattggttttgaaatgtgaggacatgagatttgggaggggccaggggcagaatgatatggtttggctgtgtctccacccaaatctcatcttgaattgtaacttccataattcccacatatcatgggaggaaaccaatgggaggtgattcaattatgggggcaagtctttcctgtactgtcttcatgatagtgaataagtttcacaagatcatatggttttaaaaatgggagtttccccacacaagctctctcttttttgtgtgccaccatacacgtgagatgtgacttgctcctccttgccttccaccatgattgtggggcctccccagctctgtggaactgtaagtccattaaacctctttttcttcccagtctcgggtatgtctttattagcagcataaaaatggactaatacagctgccatgagaatttaggggcttgatttatgcattcttctaatcagagagccatcatacttccaatctgggctgaactcttgagatagcaacagatgaaagcaaaaagttttcaaattcaacaaagaactctaaatcttctcatctagacaagcactgagttgagagcctagcatttgagcagcaacacatgaaaggcataatttgggtctaaaacatcctaagtgcaggtgttttaaatcaactgcctctatcatgaaagcatttcagtagaatccctgcaacccatgaaatttgggagacctgcattct

SEQ ID NO: 328 - DNA, 21191 bp, Homo sapiens
tcaacaccattacaaagaagggatcggggattgatagactgacagatgcatgcacagaggcaggtatggatgcatgcacagaggcagggatggatggacggacaaatgcatgcatagaggcaaggatggatggatggacagatgcatgcacagagtcagggatggatgaatggacagatgcatgcacagaggcagggatgaatggacggacagatgcatgcacagaggcagggatggatggacggacagatgcatgcacagaggcggggatggatggacagatgcatgcacagaggtggggatggatggatggacagatgcatacacagaggcagggatgaatggacagatgcatgcacagaggcagggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatggacagatgcatgcacagaggcagggatggatgtacggacagatgcatgcacagaggtggggatggatggacagatgcatgcacagaggcggggatggatggacagatgcatgcacagaggcagggatggatggatgcacagatgcatgcacagaggcggggatggatggacagatgcatgcacagaggcggggatggatggacggacggatgcatggccagaggcagagatggatgggtgggtagattggacggacagatgatggtaggttgttcttgtcctggaggaggtgatccaggctgagtcctcacactgggcagagcaagaggcaggaggtgagcatggggagatgcagctgtgtgccccagtgcaccggaagttacagatgacatcgatgtcctgtcctgatgaaacaggaaacacatttgtcatttgagagttagtggctggggctgggtggaagcttgaggggctgtgggcctggaatggggctgaggggagcgtgcaggagctgcctgccaaagcctggagcaaggatgacaggaggtgccggggcccctgtggactgccctctgggaatcttgtggggctgggtctgcacagctgtggttgtgtaacttcccccagatgcatggcgtgacaagggtgcaggaaggggtgcagggcccggaagcccagtatggccaaggagagacaaggcagggaagaaggtgagagatgaaagatatcgccctgattgaaacaccaaactacccccagtttctcagaaaaaggactcagagcaacaagagaacctacagtcgacagggaaattcgtcagtgcggatgtgatttgagcaagaccattgaagcccctgctgaaaggcaggctggcagagccagggtacctggccatctaccttgaagtctctgtgcctcagtttcctcctctgtaaaatgggcataggagacaggtttggtgagaagtgaacgaaaacgtgtttgctacccctcttaggtctcacgtttcatgcttagacgctcagcgagtggctttagggaccgagagaaatttgcttttcagttcaccaggtcgttacctatgaacctgccctgaacagtgctgaccttagttagagatggccatgaaactcatccgcatggggtaactggggcctccctgtggtgctgcggggctgtgtctctgtcttggtctcttcaggcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgagagtgcctgctagaggagctctgtgttcccaaggagatggaggaagacctggggtgggggtggtacagggtagggagaggaggggcagaggctgtgaacagggagatgggggaggggggatggaggactcaagggatgtaagggatatggcttgaggagggatgggggcaggaatgagggaaggtcttgggtcaaggacatggacctacatccccagcagatgggggtggcaagggggagacgggtgggggtcgctgactatagactgtagctgggaggaggggatgctcccagggctggggctgcctgaagagaatggcacgcaccttgtaggctcctgccctcaccccaccgccctcttaagtttcttttattttctttttctttttttttctttttactttttttgagacggggccttattctgtcctccaggctggagtgcaatgacatggtcatgcgtcactgcagcctccacctcccgggctccagcgattctcctgcctccctgcctcagcctgggacctgagtagctgggaccacaggcatgcgccaccactcctggccaatttttaaaatttttttgtagagatggggatctccttatgttgtccaggccagtcttgaactcttgggctcaagcgatcctcccacctgggactccaaaagtgctgggtttacaggcatgagccaccacacccagctcctccccctcaaacttctgtgcacaaagtgctcccttcccagaggaggggccccatcggtgtgtaaggtggcctattcctctgtgtgttctctggatcttttcagccctgtggtccagtgtccatcacagccatgctgactgagtgactggagacagggatgatggagagttcaggaagggctgggcagaggaggctggggccacctctggagggtgtcctgctgttcctgttggccccagctgcactcgcagggccttcctgtggcccctttccccaagcaggggcggccgcagctctcacccactttctcctgcagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatggtagggggagagggacctgccgcgaaaccatcattgccccatccagtgtcctctgcagcagggccaggggacgcacacctgcctgactctttcctcacagggaaggcgccccaaaccccatatgacaagcccacaaggaaacccctggctcctccgccccagcccccggcctcgcccacacacaggtgagtcccccaccaactcggagaccttgggtgaccagctgcccagcctcagtgtcctctgagatggggatggtgggggtccctgccttggagaaaacaaacccccctctctactcacctctcctttcctccccagcccatccttccccatccctgatcgatgtgagggcaattttgacgccatcgccaacatccgaggggaaactttcttcttcaaaggtgagtcatttcacttggcctcatatatgttggtttcctgcccacttccagtgacccactggggctgtgggcttaccctggaagcggaacttttttcttctttgagacagggtcttgctttgttgcctgggccgcagtgcagtggtgtgatcatggctcactgcagcctcaaaatactgggctcaagcgatcctcccacctcagcctccctggtagctgggaccacaggcacatgccaccacgccttgctagtaatttattttattattttgtagagatggagtctcactatattgcccaggctgggctcaatctcctggctcaggtgattctccggtgtcagcctcccaatgtgctggcattacaggtctgagccaccaggcaaggccctggcacttttagcgctaaaaagggaaaagtctcaggcgggccaggatgggctggtcaccctagatccattgcgcccttgatttccagatgggacccctccccacccagccacacaccctgggggaggagacctcctgctgtctcatgccttcctgcgaacccctttgtcccctgcaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcggtgagtggggccggcggcggggcgcgctggggccggcgcggggagcccacccctgacctcccggcctccaccctgcagggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaagcccttccattcttctgagcattgatggacctggggagaagtgtggtggcaggaactggactgacctgaatctccctgcttcgcagaaggaatccatggttgatggggaatctaagaaggaagagtgggcccgggcgtggtggctcatgccttaatcccagcattttgcgaggcccaggcagacggatcatttgaggtcaggaatttgagaccagcctggccaacactgaaatcccatctccactaaaaatagaaaaaaaattagccaggcatggtggtgcatgtctgttatcccagctgctaaggaggctgggacaggataatcacttgaacccgggagagggaggttgcagtgagccaagatctcacgattgcactccagcctggccaaaagagcgagactccgtctcaaaaataaaaataaaaataataataataagaagaaagaagagtgggaggacgaagtagagaggaatcgaaaagttggttatggggcacccggaggacggacggccactgtggaattgagactgcctcatggctccatgtagacttccagagcctttaaaattttatgactgctacacaaaaatgtcatgtcaaagtgattatttttattttttaagtggtatcgtttaaaaatggcatggtctcataatcaaaatgtaaaacttttgtgcttcaaaggacatcatccagaaagttggaaagaggctgggcacagtggctcacgcctataatccgaatagtttgggaggccaaagtgggaggatggcttgatcgcagggtttcaagaccagcctgggcaacatagtgagaccttgtctctacaaaataatcaaaaaattagccgggcatggtggcaacccgtgtctgtattcccagctacttggaaggcgaagaggagagaatcacctgaagccgggaagtcttggcaacaatgagccatgatcacgccactgcactccaccctgggcaacaggtgtgtctcaaaaaaataaaaataaaaataaaattggctgggcacggttgcttatgcctgtaatcccgcatttcgggaggctgatgcagacgtttgagaggcagatgtcacttgagtttgagagttttagaccaactggccaacatggtgaaaccctgtctctactaaaaatacaaaaattagccaggcgtggtggcgcatgcctgtaatcccagctacttgagaggctgaggcaggaaaatcgcttgaacccagaagttggaggttgcagtgagccgagatcgtgcctctgcacaccagcctgggagaccaagcgagattgcatcaaataaaaaaaaaaaagaaacacaaaaattgtcacatggtaccatttcagcgcactaagatggctagaattaaaaagacacagagcataacaaatgtatctggggatgtggagaaacaggaacccccgggcactgctgctgggaatgtaaaatgacagacaatttgaaacatagtctggctgttcctcagaaggataaaaacacatttgccatgtaacccagctattcttctccttcatacgtatccaagagaagtgaaaacataagtctgcacagaaacttttgcgtgaatgttcacagcagcgttattcagaatagcaaaaaaggggaaagaaccccaacttcctttgaggggtgaatggagaaaccaaatgtggtctatccacacagtagaatatcattcagccagaagaaggaatgaaggactgatccgtgttacaacacagatgaacctcaagaacagcatgttccgtgaaagaagctagacacagaagatcacgtagtgtataattctacttataagaaatctctgggagagatgcatccattgagagagaaagtagataagcccagacgcagtggctcatgccagtaatctcagcattttgggaggccaaggcgggcagatcacttgaggtcaggagttcgagactccttggccaacatggtgaaatcccatctctcctaaaaatacagaaattaggccaggctgagtggcagaacaagactccacctcaaaaaaaaaaaaaaaaaaaattgtcacgtgataccatttcagcccattgggatggctggaattgaaaagacacagagaataacaagtattgctgaggttgtagagacacgggaaccctcgcacactgctgctgggaatgtaaaatgacagacattttgaaaaatagtctggctgttcctcaaaaggataaaaacacatttaccatgtaacccagctattcttctgcttcatacatatgaagtgaaaacatacgtctgcacagaaacttgtacgtgaatgttcatagcagcattattcggaattagccaaaaagtggaaagaacccaaatgtccttcgaggggtgaatggagaaaccaaatgtggtctatccacacagtagaatattattcagccagaaaaaggaatgaaggaataatgcgtgttacaacacggatgaacctcaagaatagcatgttcagtgaaagaagctagacacagaagatcacctagtgtataattctacttataggaaatgtctgggagagaggcatccattgagagagaaagtagatgaggccagacacagtggctcatgcctgtaatcccagcactttgggaggccaaggcgggcagatcacttgaggtcaggagttcgagactccttcatcaacatggtgaaaccccgtctctactaaaaatacaaaaattagctgggtgtggtggcacgtgcctgtaatcccagctactcgggaggctgagtcaggagaattgcttgaacccaggaggcagaggttgcagtgagccgagatcgtgccactgcccttcagcctagacaacagagcgagactctaagaaaaaaaaagaaaaagaaaaagtagatgagtggttatccagggaaatgaggactggcagtgatgtctcagaagggcagaatttctcttagaggtgataaaaatgttctaaaatgggttgtggtgatagctgcacagttctgtgctttgaattgtacagctcaatgagtgaattgcattgcctgtaaattgcatcaccataaagctataaaaacagggtacatacagtctgggtggatcccaagatgtcttcagatggtggcctttgagagtcatgaggggctagggttggagctgaagcctaaagcatgacttttagctggtgcaggagtggcttccttctgtctcccactacaattcagaggatactcagggaaagatctggacatcctgtatgtggaaaggcggttgcgcacagtggaatggactcctaagtggcaggcaggtgacaaccgttgtctacttcacccaagggaagatttctccatggagcgtgttttataggttctgtctctccgagtcccctttgagaatataatgggatacattgcatccatgctgaattcctaagccccaggacctcagaatatgcccttatttggaaacagggtctttatggaggtacttaaggtacaatgaggtcactggggtggatcctacttcttttttttttttttccgaggggaattttcattgttgtcccccagactggagtgcagtggcaccatctcagctcactgcaacattcgcctcccgggttcaagtgattctcctgcctcagcctcccgagtagctgggaatacaggtgccggccaccacgcaaggctaatttttgtatttttagtagagacaaggtttcaccatgttggccaggctggtctagaactcctgaccttaggtgatctgcccgcctcggcctcccaaagtgttgggattacaggcgtgacccactgcgcccggcctagggtggaccctatttcaatatgactggtgtcctttggaaaggggaaagggggacagtcacacccaggcagaacgtgatgaagatgaagatggccatctacaagggcaggagaaacctgaacagaatcccagctccgggccctcagaaggaccccacgctgcccacattgaccttggacctccagcctgcagatcgtgagggaagagacgtcttcgacttagggccccttgtcgtggtacttccttagtttggccccaggaaaccatcccaaaggcaagggcgtggttgtgctcagctgggggaagggggctgggggccgtgaggaggaggtgggaggcccagccaggctggagggtcagaacccgtggagctagaagagcccgtaggggagccccaagattgctgagaccagtgaccttcggccccagatggccttgccttggcccagaagggtcagaaggacctggtcagccaagctcagacagccggcaggatgccttccaccctgcagagggtcctatcttgtcccacaggtagatctacatcaccactagccacccctccaacgtgcacaggcccctgccctcacggcgcccctcttaggtccggcagttcctgcctccttctgatccagaagtttctctggcctctggagccggggcacacctcatgcaaggacagggtccaaattcctttgtccttggatcccacttggctgacgtcaccttcctgtactcagggagtttccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtgagtgagaggctgcgtgtgcttttgtgggcatgtctgaaaacagaccgtaagggtgcgggtgccctcagtatttcccgaggtgcctgtgtgtcagggctcagtcaggggcacccagcggcaggaggatagtgatggggtgagagtgtcagtggaggcgctggaggtcatatgtgtcgggggcgctggagaacggcaggggtgtggatgagagggagcacctgtcccaggagcccttcacagcccggaaagcccggggcaggggtggggcagggctctgctggaaacgactcggagaatgcttctctcagaggccggctcagctgggtgggcccaagagcaaggcctgtgtgggtcctggtgtctcttcctcctttcctgggttccctccgacctcccatcctctaccactgccccaccgcaaatgctaggcccaccacaccctccagggagctcttcggcctgtgacaataggggtttccatgatgtggcctggctcaggttcaggacagtgacccggaggacacatggctcccgcatgtcggcacggtgctgctttcaccctggttcctgggaaatcaggctagcgggatgggaccatcgctgcctgaaagtgtgcagacagctgccctgcccagaatatgtccccaggccctgcgcactctgtgggtgactgtcaccactctatagtgggggaaaccaggcatgtcacccccgagactaggcccttgacgtgggggctcagcggggattctgtggggtgcctctggcctctgtggatgcagccacgtgtctgcaggcaggaatggcccgggacctgtgggtctgcatgttggcagtcgggaagagtggcaggttgtagggtggacctacctggcaccccaaatattaatcagctcatcagagaggaatggctgctgttaccttctcaattgtcatgtccctaaacattttttccttggccaactctcacctgggaccatagtggttgtgggaaacccagctgagccagcctgctccaggacagtgtccatcctcccgtgtgtgtacatgggggggtgtgtgtgtgcagggaggacaccccggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccacgcaggccctgctcttgtgaggaggggtcacctaggcccatgctggccctgctcttgggcctgcccagctgagccggctcctgagagaagcgctttctgagtcgtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtataaattatcctggaggaaaggttaaggtgacacatggagactgagtgtcaccgttatttccgcaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctgggtggcagtgagtgggcgggtgggggatctggacgcccggggagactgagggaggcatccaagccccagggctccttgaggaaacaacaggggtgccagacgtggcccgggcccctggctgggcccagttcggggtgtgtgggagctgaggactcactgggcttgaggactgactgatgtggggtgcagaggaggcttgggcctggaaccgagtgctttgttcctaacaggtgatgtcgagcctggcagagctggaggtgagccgtggcctccccctccaccaagcttagtccctgggtcttaggctccacaggacactgggtctgggccccgggtccccttgggaatcacctggaccagtgggggccacagtgggaagggggcaggcaggagcagcatgaaccccctgtgccctcctctccccaggacgacttcaaagagggctacctggagacagtggcggcttattatgaggagcagcacccagtgagtatgacacacccatctgggcaccttgccttccttcacctctgccctgtcttttctttctttctttctttttgtttatttgagacagagtctcgctctgtcgcccaggctggagtgcagtggcatgatcttggctcactgcaacctccaaatctcgggtttaagtgattctcctgcctcagcctgacaagtagttgggactacaggcacccgccaccactccaggctgattttttttgtgtgtgtttttagtagagaccaggtttcaccatgtttgccaggctggtcttgaactcctaaccttgtgttccgtctgccttggcctcccaaagtgctgagattacaggcatgagccaccgggcccagccaacccctgccctgtcttgatgtggtgtgggcagggtgtgcccagcccctgagcttggggtggagggctgggagtgacagcctagctgggacctgcccatggcctcactcctcacacagtggcacagccctcaaggcacgatgagggccctgacctggtgaccaagcagacacacccatcctgtcactgccatggaggtgaatgcagaggagggggactctgggaaaagtccctcttgcccacggggctgtggttgggaaaccaacacctgtgggcctccgtctcccagggtcaggaaaaggctgagaggcctgggtgtggccagggcctggggctgacacccccacctacagaccctgaatggtgctcccattccacaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactgactcacagttccacatggctggggaagcctgaggaagcttacaatcatgggggaaggcggaagagaagcaaggcacgtcctacatggcagcaggagaagcagggtggggggaactaccaaacacttttgtccgcgtgtttgtgtgttttttttatttgagatggagtttcgctcttgtcgcccaggctggagtgcaatggggtgatctcggctcactgcaacctctgtctctctggttcaagtgattctcctgcctcagcctgctgagtagctggggttacaggcatgcgccaccataccaggctaattttgtatttttagtacagatgcggcttcaccatgttggccaggctggtcttgaactcctgacctcaggtgatccgcccacctcggcctcccaaagtgctgggattacaggcatgagccaccacacccggctgccaaacacttttaacccaccagatcttgtgagaactcactcacttacaccagaagcgcatgggggaaaccgcccccatgatgcaatcatctccagcccggcccctccctcgacatgtggggattacagtttgagatgattggggtaaggacacagagaaaatcatctcattctgcccctggaccctcccaaacctcatgtccttctcacatttcaaaactcaatcatgccttcccaacagtcccccaaagtctaaactcattccaacatcaacccaaaaggccaatccaaagtctcacctgagacaaggcaagtctcttctgcctataagcctgtaaattcaaaagcaagttagttacttccaagacacattgtgggtacaggcattgggtaaatgttccctttccaaattggagaaattggccaaaaaagggggctacaggcctcaggcaagacccaaatccaccagggcagtcattaaatcttaaagctcccaagcgatctctttggctccatgtctcatgtccagggctcactgatgcaaggggtgggttcccagggcctggggcagctccgcccctgtggctctgcagggtgcagcccccgcagctgctttcatgggctggtgctgagtgcctgcggcttttccaggcacacagagcaagcgcttggtggatctaccattctggggtctggaggagagtggtcttctcacagctccactaggcagtgccccagtagagagtctgtgtgggggctccaaccccacatttcctctctgcattgccccagtagccgttctccatgacaacctgtgcgtggtcatccaggcatttccatccatcccctgaaatctaggcggaggcccccaaagcccagctcttgtcttctgcagacctgcaggcccaacaccatgtggaagctgccaaggcttgggacttgcaccttctggagcgacggcctgagctgtaccttggtcttctttagccacagctggagctggagtggctggggcacagggtgccatgtcccgaggctgcacagagcagcggggccctaggcctagcttgaattaatccccaggaaatgggttttcttttctaccacatggtcaggctgcaaattttccatcttttatgctctgcttcccttttaagtataagttctaattccaaagcatctctttgtgagtgcatgtaaccgtatgctttcaagaaaagacaggtgacttgctgaatgctttggtgcttagaaatttctactgctggcggagtgcagtggctcatgtctgtaatcccagcactttgggaggccgaggccggcagatcacgaagtcaggatgtcgagaccatcccggccaacatggtgaaacactatctggactaaaaatgcaaaaattagctaggcatggtggcacacgcctgtaatcccagctacttgggaggttgaggcaggagaaccacttgaaccagggagtccaaggttacagtgggccaagattgcgccactgtactccagcctggtgaaggaccaagactccatctcaaacaaacaaacaaaaaaaacaagggacaggttcttgctatgttgctgaggctgcagtgcagtggtgcaatcataggtcactgctatggatggatggacagatgcgtgcacagaggcagggatggatggacagatgcatgcacaaacacgctgagcgcctactagcacaagacaagacatacagggttctgctctccccaggtacacagggttgagatccaatgggaaagcagtgagccagctgagtcaggggtacgaggagacactgagcagagaaataacccgggacatctgaggccagaagccaaaactatggcatcagtagggagactgcagaaggcggcaggtcccggatcaccaagggccttgaaagcatgtggaagactttgatcaatgggggaatcattaaggcattttgcattccggaactatcatcagcttcagcagggggcagggggtaggatagaggcagggaggcaggaagttctcgcagggtccaggcaagagatggtggagtgtggtcctggggaagggggcagtggacggatctgagggaggttcagttaggatgggcaaggattgagatctggctggatcctggtgacaggggagatgaggctggggcccttggaggatggtgtcctggtgctgttaatgcaggtgtgagagtgggaggaggaggagcaggctggcagaaggcaggcatgagtacaggtctgggcgggagtctgcagcgctctgggctggccacacgggtggggcaagggaggtggaggatcctgccctagagcttggtctcctctgtctgaggtcaggttccccagaggtggggctccagagggaaattcttgtgcaagcagtttctcaggggccatgtgctgaggggaatggggagcaggaacagcctagaagctgagtgaggatgtggtctcagctggagaggaggctgatcgcatgggagctctgcagcagggatggcaatgccggggaggccgtcccgcctgaggccaggcccagctctttgcagccccatattaactacattggctgctggggagcctgagtgacgggggaagggggcagccagggagggtgcctaggccctgtggagggcttggtaaggcagaggctggggaggctgtgtgcctcaacattcacatatgggcttcggatgggcgtggtggcacatgcttgtagtcccagctactcaggaggctaaggcaggaggattgcttgagtcagggaggttgagactgcaatgagctgtgttcacaccactgcactgcggcctgggtgacaaagtgagaccctgtcacacacacagaaaaagagaatgtgggcttcaaagttgaattcaagtaagtcagggttcttccacttgtaatgaacaacttccttaacctcattgtctcaggttcctcccctgagaaatgcgaggagaacggcgcctgctggtggcgggggcttgccgatgaaatgagccattcacccatgcctctcagcacagggcctgccctgggccgcatactgtgcattgtcagctgctgtcggagctgggctagtggccgccttgagagccagcagtccacgggggttggcgagcttctgggaggaaagggtggaacgtgactgtcaggtacagagctacagagaaccccagcatgaaggagtaggtggcaggggagaaggactcaacagagatggagaaagactaagcccaaaggtgatcaacaacaagagtgaaggaggaagtggtcagctgtggctggggcaaaacaagcccagtaagttacattggcctgtgtttggtcatccagggacaaagtgacctttttagtgccggtaggcccagtgggttggggaagaatttaggcggcagtgggcttaggcatgagaggagcggaggaagagaagattgagttgagaccactggctggagaacttgaccaggaagggagggcagagagcggcgtggagtcgggggagggaataggtccaatgagcgtcttaggatgaaggagttgtgagcactcagcacaggataagctgatacaaagaaagggatggaggatggatagactgacagatgcatgcacagaggcagggttggatagcatgacagatgcatgcacagaggcagggatggatagatggacagaggcatgcacagagagagggatggatagatggacagatgcatgcacagaggcagggatggatggatggacagatgcatgcacagaggcaggaatggagagacagatgagtgcaaacaggtagggatggatggacaggtgcctacacagaggcagggatgaatggatagatggatgcacaggggcagggatggatggatggacagatgcatgcacagaggcagggatgtatggacggatgcatgggcagaggcaaggatgaatggatggatagatgcatgcacagaggcagggatggacagacagatgaatgcacagaggcagggatgtacagaaggatgcatgcacagaggcagggatggacggagggacagatgcaggcacagaggcagggatggatggacagacagatgcatacacagaggcagggatagatggacagatactggcacagaggcagggatggatggacagatgcaggcacagaggcagggacagacagacagatgcatgcacagaggcgtgtatgaatggttggaaggatgcatgcacagaggcagtgatggatgggtggggagattggatggatagatgccggtaggtcgttcttgtcctggaggaggtgatccaggctaagtcctcacaccgggaggggcaggaggcgagcatggggagatacagctgtgtgtcccagtgcactggaagttacagatgacatcgatgtcctgtcctgatgaaacaggaaacacaattgtcatttgaaagttagggctgagggccgggcgcggtggctcacacctgtaatcccagcattttgggaggctgaggcgggggggtcacctgaggtcaggagttcgagaccagcctggccaacatggtgaaatcccgtccctactaaaaatgcaaaaattagctgggtgtgttggtggggcgcctgtaatcccagatactcaggaggctgaggcaggagaatcacttgaacctgggaggcagaggttgcagtgagctgagatcacgccattgcactccagcctgggtgacagaggaagacaccgtctcaaaaaaaaaaaaaaaaagagacagaaaagaaagttgggggccggggctggatgaaagcttgaggggctgtgggcctggcatggggctgaggggagtgtgcaggagctgcctgccaaagcctggggcaaggatgataggaggtgctggggcccctgtggactgccctctgagaatctcgtgaggctgggtctgcacagctgtggttgtgtaacttcccccagatgcatggtgtgacaagggtgcaggaaggggtgcagggcccggaagctcagtgtggttaaagacatgcaaggcaggatagaaggtgagagatgaatgatatggccgtgatcaaaacaccaaacttcagtttctcagaaaaaggactcagagca

SEQ ID NO: 329 - DNA, 22150 bp, Homo sapiens
actccaaaagttttatactccattcatgtgatagaaaagatccctagtgagaatgtagagataatatgaaaaatgtagagataatgtgaaaaaaataataacaggtccattgttaaaaatttcccacacaaattttaaagtataaaatgcctggcaagaaaatgtttaaagggaaatgacacttgtggaattcaaatcactctcggagcacttacagcctctcttagtcggtacggtgagctagataccctaacaaacaatttgtttccttcctaaatttcaaatgatattagtgactgattttattataatagtcacaggcagtgtgagccagaattatttccataccttctgttaaaatttgtggcattccgatccttttttcccctggatctgcttttattgttgttctttttgttttggaaatggggagtgtgtgaaagtcaataaagctgttgaatttgtctcctgtacgtttagcatccaagccgctcaaaactgccccaggtgtgaaggagtgagaagggatttgcatttctgcctttctttttaactttccatgtatctgctgtcaaatcttcatatgctatttcccacacctcccatttggaaaattcctgtataaatccatcattttactaaatgcattgttttagaactgaactgacccagcactacatatgttgtagaatctggacaacttccagccaccttcttacctctgattcttgagtctggtattcagctggttggtgctgcatacaagacttggtttaaaccatggggggtgctttaaaccacacccatggcattgggttcactgctggaaacattaaagaatttaagattctactatgcgatttttgaattttttcaacttcatccaagcagacataggtaattgatgtgcagaaacatttcagaaattaggtcagcagacattcagttgtccagggttgccacccatgtgggctgtgctggatactcaagccatgtgtattcattaggtcctttggggcttgaccccttgttgagaagctggcacagcattagacaactataatgaaaaagaattaatgcatactatattgtgtcatgaatctgtgggtcacattattccaaaatatgtattttataattgtatttgactgtgagagaaattaatgtacccatggatgagtatatactgattaaaacaataagaaacagactataagtttattttttgattacgtgattttttaaaatgggaaagtcactggttacatcatataattttaaactttatatcacagaaggtagtaagaagttctagtatcatttgtttctcacagacgctgagttcttgctaaatacattatgatacaacttttaacaaaaacattactgcaaatacatagtaatgcaaatctcagttaaaaaataaatctctgaatactgtgatcaaaacactgacaatttcagagctgattctatagctcaaagaggtttgatgactagaaaacttaattgcaataaaagacacttccatatccctgttgacctctgtgtctcctctttcccctatctctgctcacaggcgccatatggaccatggttctcacggcagccctaaggcagtcacaggtagaggctccctctagggcactacaattcccatccttggagcgtgcggccagtcttgggcagctccagaccccagctgacctcacttactgttgccagggaaaggccctgtttgtggacttcttgctgcaaggggtggctcgcagtgcatgtgattcctcccatcaggcaaactggccatactctgcagatggtaaactgcatgtccagggagcataggccaagggtattcacatggagcttaagttgaagccctggccaagctcttagtgtctcccattcttgactggacaacagagcaatgaagggctccttcctgacagttcataaatgttccttcataccacagtgagattttgctactaacaccatgtcttcgttttctgaaaatgacctgtgtgtttcgtttcatagacttcacaatcaggagagaacagataattagggtgggttgggtcaggtgcagttctttccagagatgacactggggaccagatatgcctccttactcttcaaaatcaacctcatataaaacatcaatttcctgtctttagatgatctcaatatgtagtgtggagctgtttctccctggtcctactagtctcaacttggtttagcccttaaatatttattgaaatgattaccatatctttccagtgagtcccccaggccttccagattatccaaaagattaatcctcataaatacagaccatcaccttgaaataatggcttccatccaattctgtctggtttcagaagtgctggtgccttatcttttaggtcaagtgcagaccccctgccacaatttcaagacctcctacagcccatgcccaccctgtgtatcctagatccacagtgccggctgccagggggacctgggactcaaggaaggacacagcaacctttttaaagatgtggctaaaggaaattcctgattcagaaacaaaatgataaaagaaggaaacaacatcagggatgaagaaaaatagaaataataaaagcatggataaatatgataggctagccttcttgagtttttctaaactgtgtctgatgattgaagcaaaaatttctccacggtctgatatagttcttcatgcatgtaaattatgttgtaaattgagaaggagaaatgggcctatatggaggtgaagatcctgcacatcacatggcagaatgtggacaccagtgggctgcaacaagtgacgtgcataaaatgtcacacctgaagtaatgaagggtctagagaaacccatacattctaaaacagtatagataaaccaaactggaattaaaaaaaacattaccttgctgagagcagcagccggtgagaccctaacccagcagcactagaggaattagagacacacacacagaaatatagaggtgccaagtgggaaatcaggggtctcacagccttcagagctgagagtcctgaacaaatatttactcaggtatttattaacagcaagccagttattagcattgtttctatagatattaaattaactaaaagtatcccttatgggaaacgaagggatgggccacattaaaggaatatgttgggctagttaactgaaacaggagcatgtccttaaggtacagatcgctcatgctattgtttgtgacttaagaatgcctttaagtggttttctgccctgggtgggccagatgttccttgccctcattccagcaaacccaccaccttccagcgtgggcgttatggccattatgaacatgttacagtgctgcacagattttgtttatggtcagttttggggccagtttatggccagattttgggggggtggcctgttcccaacatgtctcccttctttgatttgcaaatcaataaaagcaaaggcagctgcgtcatggtgagctacttctcacaggagtcaggatctacatctgcagactatacaaagacaaatgacacagattaaaagcacaatcatcataaaaattacagagcttcccagtgtttttatccattttaatgggttaatagctgctaatctgtctgcagctcctttcagccctccagttcttggcattaaggccaggcgtgcctgggatgctttaaatatttgttcttttaattttgcaatatccaaaaacaagtttgtagagtgtccttttagatgcttttttattcttcccccaattttgatcttattaagagctattaatagtttccacaaatccttaatgtttagctcctacagcaggccatatcatttgaggttgaggtgccactatactgccatggttccatataataataactcttgctgtacttcttattatgtctaccatctgaccattttgttcagatcagctgaacatagtgtggccttggcacacagactgagaggtgcaatttatgctaaatatccccttaggggatcaatcaataatgattccataggaatcattgtgcagcacctctgtctgttctgcaatgcaatcttcctaaacaagtacattcattttttctggccaggttcaattttgtttacaaataggttttttagggcggtatacctcaattataggagcagatttattatggtaaatccagagatcagaaagcatgtgtaactgtgtcatagagtgattatatccaggcattattgccagccaagattgataaatatgcccaataagtatgattgttccctgtgtcagcccttactgaaggaatactcatggcagtggtgatcatcactatcatagctaccattaaattactcattgtgactggttgttccactttcctcaggttttcttttatcatcagtgacagcttcttgatctgtccccaggtgggtggcagagtttgactggtattgctcatgacagttgaagtcctcctcagcatcagtatcaacctggctgcaatggggggggtggtcctcgggatcctcctggaatctcttccttggcatctggcttatgataaggtttcaggtattttgatggtacctaaatcagctgttgaatttggcctggagaaacagaaggataacctctaccccaagttattattttacctgtttcccaactttttgttattgaatctctccaccaaatcagttgttctgctcctgtctttgcagctggtttctgtagatgctgttcagctcctgataacatctggcctttgggcaggctcaaaaaatttaaagttaataatgctagattcaattgtgtatggactgtcctgtaatccctatttctccctcttttttgtttttgtcatcagttgtttatctgtatgatatcataactgagcattttcaattaactctgtggaatgaaccatgtatgatgaatcagaaatcacattaataggcataacaaaagcagccaatatctcgattacagctacaagctttgctttttatagggcatctgaataactttacttttttgagccagaataagaagctttactattactagacccatctgtgaaacaatgaaaacacttagcaggctgcaggttgtttactgcaggaattatacatgcaaaccgcttacaggcttgctcagctaaagggatagtaaagaactgaactgatggctcttaagtcagttaacattctccatttacctgattttttcttaattacaaaaactggagaattccaaggggaaaattttggagctgtgtgcccattttctaattgttcagtaactcatttctccaaaacctccagtttctcttaacttagtggctactgttctatccaaattggcttatctgttaaccattttaagggtataggttctggaggcttaacaatggccaccagcaagaatgatatcctaatctttgatgggatctttgtctttccacttgaagcagttctttcaaatcttgcaaatttttttctagtcctatgccagggacataccccatttcatgcattgtatgttgactttgagggctatataattgttctggaattagaacttgtgctccccattgttctaataaatctctcccacatacatttataggtacagaagttataattggttgaatagtcccacgttgtccattgggcccttcacagtgcaaaatataactactttgatatacttcaggggctttaccaactccaactatgttaaatttagtgggttgaattggtcacgcggacagccagtgctgtagagaaatgattgaaatgtccactgctgtatctaccaaacctttaaatttctttccctgaatggttatttcacaggtaggacgtttatcagtgattttatttacacaataaactgctttgcgttgtttatttgtgcttccaaatcctcctgttcatttaatttcactttttctcattcccacatatagcacaatcaggagctgtgctatgtgctctcctggctctgctttccagggaacaaaagtagatataacaatgtgaatttccccattgtaatctgaatcaatgactcccgtatgtatttgtatcccttttaaacttagacctttctaaaagtaatcctattgtccctgctggcaagggtacacagaatcctgttgggaccttttgcgggggttccccaggcagaaggctcacagcttttgtgcagcataaatctactgcggcactaccagctgtggtgggtgacagacattgcacaggggtgagggaatggcctgagctggaaatgccccagtttagaatgaggcccaggatgggcccctcatggcatttcctcaaatcaggttcccatctttatcaaacttagagtgacactgattagcccaatgttttccttttttacattttggacatatttcagactagcagttttcttttttcccctatctggtggcctgatttgctgattatttctccattcttttttagtatgaatagcttgtttaaattctttgagtaatttaaaaagaaaaagctcaaatgtagctataatatttccctgttgaactagggagtgtattctaacagggaactgccaagcctctaaatcaccctctcgtctagcttgctgaatttctccctgaatagaactaaaagcggtcacttgaggcgctgctcagtcactggggcaactactttttacccagtgtcctccagaaaagaaagatctggagggtcattttcttcaaaataataatgagggggtgcagaatggtagggatgaacctctccctcctttgccgctttagctttagctggtaaataaacatgctttgtaacctcttctgttacttcgttatactctccttcctcctccacatcagtgtgaaaaagttccaaggtggaatgaaccagaccccacacttttcccattggtaccctgatgcttctgagctccccttcttactcaccacagggattgcttaattccacgttctccaaccatcgctccagcaatccttcaacctggattcgagcccccacgatggacaccacttgccaagaccagctcaattggggagaccctaacccagcagcactagagcaattaaagacacacacacagaaatatagaggtgtcaagtgggaaatcaggggtttctcagccttcagagctgagagccccgaacagagatttactcacatatttattaacagcaaaccagtcattagcattgtttctatagatgttaaattaactaaaagtatcccttatgggaaacaaagggatgggccaaattaaaggaataggttgggctagttaactacagcaggagcatgtccttaaggtacagatcactcatgctattgtttgtggcttaagactgcctttaagcagttttccaccctgggcgggccaggtgttccttgccctcattccggtaaacccacaaacttccagcgtgggcattatggccatcatgaacatgtcacagtgctgcagagattttgtttatggccagttttgtggccagtttatggccagattttggggggcctgttcccaacacccatcatataccagcagtgcacttagagaaatgcaccacctgaatgagctgtgtaacactaggaaagcacatctttagttggaacattactggtttcacttaaaaccaagtatcagacacattatatacacactttgttttctgtttttcatttctaatattcgtatattagcattaaagagagaaatacaatttgagtgcttgtcatcagtgaagaaagtgattggcgtaattgaaaagatgaaaagagcagacattctgagtgtcctcaatcgatcttattgatttttaaaggattctagggcttgaatgtctcaaactagtccaaaaaaagccaacagcaggacccatacaactataaatctcactagatacatcccctattccatgaacatgagaggagatgaacattatcagccttgcccaatttctcagcttacatttatttgggggtcaatccaataccgttatatgaattctttggaaattggaatatttgagcaaaaatgtttactttttgcacttgaaaatacaaaaagatatagacatagagtgcatctttattagagaataccgaaaatcccttcaagtccaagttttgaaatccccagttgactgtttggcagaatggctcattgtcaggtagaactcttttctagggcccaaactacattgcttagatacaatgcaaagagacatgggccaaccccacctttccagctcattcgttatcagcaaaaagcttcggcctgggctccagttatggttatagttggcttcacaggtgtgcgaactgtcatctgggtgatcacagggtgatgacagggctgctgcatgttgctctggaggtttttcactgcacagtgaactgcctgatcacagcagccttagacaaaactggataacatagttcttaatgttttcttcctcattgagcatcccctgatctgagaggctgtgaggcaagtttttacaagacaaagatattagctgagaggatcaagtagaacaaatgcattgttgctgaacaccaggggtttggcctaggtgtggttgctcactgcacagaaagccagtcactaagacgagtattgccagggaagaagagatttattgtggatgctgtcagtctaaccgtcaaatccgtctctctcccaactaaagttaggagtttatatagacaggaattaaggggagtaaggaatatgatcaacaggcagcaggtggttagatgagaggtctagcatctcattgtaaccacctgtgggaaaacaggaacgggagagaaggaagaggagtcaactggcaacagctctccttgtccagttgtggtgatctgtaaagtttcagttccatgaaactatgtgggagtcctaatgatcagtttattgagaaagaaactcagatgacaaatgttaaatttctcaacctttaagacttggaggtcaatcctatactttggatatttttgcctgcttaaatctgatgttgcattgtaattcccagggctggaggtaggtcctggtgggaggtgatcatggggatggaaccctcatatggcttagtgctgtcttcctgatactgaattctcccaagatctggtcatctaaaagaatctggcacattccccaactccctctctcttgctcctgctttgccttctgctatgactgaaagttgaggcttcaccagaagccgagtagatgccagcaccatgcttcctgcaaagcctgtagaacctgagccaattaaacttctttcctttataacctctttactttatattacccagtctcaggtatttctttacagcaatgcaagaatggtttgacagtcaatttctatgtttattcccctcacaaaaggcctccataaacatcaactgcataggaaaattgagctggtttcaagatcaaaaatttggcccatattaatagtggttgaaactttatgtttacaattattacttctgttcattttaccatctcctcttcctccatgcagcaggggcatgttgcaaatcacacactccaaaaaattaaacacaggacattccaaaaattagcattggtattgaaaacactcccccaaatcaggcttatttgccattcgtattttttctgtagtgaaattttcataccaatctttcaccaattttctttttgggatttttcttctattcttatccaaagctgttttacaagtacttttttcagtccataactcacctttccatttccttaattgtgtgctttaagaacacaagttttgaatttaacaaaatctaatttatcaaagtttaaagtgagtacatcgtttttattactttaagtgcattaaatttgtgtatattccatatttgtattgtccatagagaaatcatcacctaactgaaacctacaaaaattttctcagtttttcttctataagttttaactttgagctcttgtatttagatctatgatgagttgaggccttatatatgctttggggagtcaaagttaacaccacattttgaagatgtgtctttccccttggatttcattggcacatttgctgaaaatgtcccaagcacctcatggggtatggctgtggttctggactcatgtattcacaattgttttgaatattcacataaatttataatccactgtcaaattttaattcaggtggtgtttaattaatagaacaatttgaggaaaactgacatctcaaaaatagttttcttgcctattttggccctatttctgccatacacattttggaaaactttttccagtactaagaataaatattggaagctttattgaaattgtatcaaatttacagaaacatttaaagaaaacatattaataatggtcttcctaatcattgaaatttttactttatttttaatttttttgggtacatactaggtgtatacatctatggggtacatgatatattgatacaggtttgcaatgtctaataatcacatcagggtaaatgggatatccataacctcaagcatttatcctttgtgttacaaacaattcaattataccttaaaaatgtacaattattattgactgtagtaaccttgttgtgctatcaaatactaggtcttagtcattctacctttttgtgcccattaacattccccaattccccctcatcatgcccccactacctttcccagcctctggtaaacattcttctactctatctctagaagttcagttgttttcatctttagctccaataaataagtcagaacatgtgatgtctgtcttgctgtgcctggcttatttcacttaatgatctgtagttccatctataatgttgcaaatgacaggatctcattcttttttatggctgaatagtactccgttgtgtatacgtaccatattttatttatccattcatctgctgatggacacttggattgcttccaaatcttggctattgcgagtagtgctacagtaaacatggtgcagatttatcttcaatatactgatttcctttctttggggtatatacctaccagtggaattgctggattgtatggtaactctatttttagtttttgaggtacctacaaactgttctccatagtggttgtactaatatacacttccacagtgcacgagggttcccttttctccacatcctcttcagcatttgttgttacctgtcttttggacagaagatattttaactggggtgagatgatatctcattgtagttttgatttgcatttctctaatggatcaatgatgttgagtacattttcatatgcctgtttgccatttgtatgtcttctttcgagaaatgcctattcagatttttgtccagttttcagattaattttttttctatagaattgttatagttcctgatatagttatagttacagctcctgatatagctagtgatatagtttggatatttgtccctgcccaaatctcattttgagatgtaatcctcagcattaaaggtgggtcttggtggaaggtattttcgtcaagggggaggatccctcattaattgatgctgtcctttcatcaacgcccatatttctgccatatgcattttggaaaagtttttccagtgttaagaataaatattgggagttttattgaaatattaaatttatagaaactgctattattttaataatgagtcttcaaacattgaaattatttttaaatttttgtgggtacaaataggtgtatatgtttatgggggtacatgagatattttgatacagtcatgaaatgtatatgaacacatcagggtaaatggggtatccctgacctcaagcaaccctcacaagacctgagtactcacaagatctggttaagtgtgtggcacctccctccccctctctttgcccttgctcctgccatgtgagatacttattccccttttgccttccacaatggttggaagcttcctgacgcctccctacaagctgatcagatgttagcaccatgcttcctgtacagcctgcaaaactgtgagccaattaaacctcttctttataaattacccagtctcacgtatttctttatagtacttcaagaatggcctaatacagatggatagtttgcaaatattctttcccattctatgggttgtctcttcactttgttgtttcctttgcaatacagatttttaacttgatgtgatcccacttgtccatttttgctttggttgcctgtttgtcaggtattacacaaaaaatctttgcccactccaatgtcctggagagattccccaatgttttattttagctgtttcatagtttgaggtcttagatttaactttttaattaattttgatttttgtatatgttaagagataggggtctagtttcattcttctgcatacggatatccagctttcccagcaccagttattaaagacactatctttaccccaatgtatgttcttcataactttgtcaaaagtgagttcactgtagatgtatgaatttgtttctgggttgtctattctgttcctatgtgtctgtttttatgccagtatcatgctgttttggttactgtagctctgtagaataatttgaagtcaggtaatatgatccctccagtttgattccttttgctcaggataactctgactattctaggtcttttgtggtttccatataaattttaggattgtgttttctatttctttgaagaatgttaaagttttctggatattgcacagtttgtccattaacttgctgagcaacatcttttttttttcttttttcctgagacagggtctcactctgtcttccaggctggagtgcagtggcatgatcacagctcgatgcagtctcaatctcccaggctcaagtgatcctcccacctctctgcctcctgagtatctcggatgacaggtgcatgccaccacgcctggctaatttttatattttttgtagagacagttttgccatgttgcctgggctggtctcaaactcctgggctcaagcaacacacccacctcgacctcctaacatgctagaattacaaacatgagccactgagcccagccagagtattttctttctgttaggtacatgaaatgattcaggctcatcttctttttctcccaatctccgactaggaatcatccctggtccccttttttgtggatagtatttaggaaataataacttggcagttggtgtgtttactgttactgagctgtgactgcatttatgtcctctcggtagaatgaatcacaaaatatatgtatatgggcacacccaacaatttctctattgttcctatgtatttaaaagatatgagttctattctaatcccacactgcaggttttctagctctcctcattcctatttctacaaataccttctctaacagggagaaaccttgccatcatcattctcaacatatttgctcagtggtaccaatctcttaacaatgctgcccatctcctccccctgtcccttccacacctcaccctcagccctcttggtgccagcagacacatagccacaactcctctcatcccacaatgcaggtctaactcctccactctgggaagggaaggcaaaagagacacataaaaactcaaagaggggaatcaaaagaaagaggaagggaaggccacattgattttttaaaaaataataaatcatcttttgattgccctaataaacatctcttggtgatgatacagtttatggatatgactagactttttttttcaattttaggattttgcatctaaatctatgagactttggtctatagctttatgttttttgtttgtttgtttgttttattggttttggtatcaaggttgcactggcctgaaaaactgaattggaaaagttccaacttttttcttctagaagagtttataaaagcctggtatgctttatttattaaatatttggaataacttcagtggagccatctgtcctagagttttctttctaagcaagtttttgaatattccactcagatattgtttgcagttgtgacaaggtacaatgaatctctggtatgaccttgtttccagggcttttactgatggcatgttcatgaaaggaccaacccactggcacttcctaaggtctaatcatttctcctccatattgcaaaatgcaaaacaaaacaaaaatcctacttgttttcttctcaaattagcttttcagcctcctgccctatgcagcatgagatatctggaaatttcttgagaaattatgtgtttgaagcccctaatgtatccatttttttttaattgcagtcttgattgttctcctggtttctggtcccccccatgccttcccctgacccccagggtatggccctctgcctgaaccaagttcagtattcaggttcttccctatagccagaagtggaaagggtccccagagcaaagagctgcattctgtgcatgtgctttctgggatttaccactctctagaattttgctcctttagttctctttgcttctatagcaataagttgcatttaaatattttttgtaattttatagttgtcctcaatcagtccattctgctgccgactactataccttacccaatagcaaaatctattttttttttaaagtgtctgtcactcaggctggagtgcagtggcatgatctcagctcaatgaaacctccaactcccaggttcaagtgatcctcccacctcagcctctctagtagccgggactacagatgtgcgcaatcatgcctggctaatttttgtatttttagtagagacagggtttcatcatgttggccaggctggtctggaactcctgacctcaggtcttgcccacctcaacctcccaaagtactgggattacaggtgcaagccaccatgctcagcctatttgtgctttttcaaagccccatatttaagttatatctctatatacattttaaaaagttatatcacctatgaaaaatgtatttcactttggagagaaatagagttgggtacaataagtcactcacagcagaatgtcctggcttatgtgttggacatctgctagggcagaaaccaccagaaatctggacccactctcttctactaatcctcttaagctgcatacaaggcaagttgacttgcccccttgatccaccattctgagacgggtcacccaaaattagtctgccccaggattattcaaaaatcctgctggtgggctcctgtcctatggccccagattaagggtctctttcttcctggacatacaaaagcactcttgcttatggttccctttgctaaaaactcttcccttattttacatatggctaagcaatacatctttgacctagttatagtcattggctccagcgtggcatcttttcaagtgtcagaaaacagcagtcttgacaatgaactgaactggatataagcaaagtaaaatgctatttctcaataaaaacctttttttgcgtggtggctcacacctgtaatcccagcactttaggaggccgaggcgggcagatcacgacgtcaggagatcgagaccatggtgaaaccctgtctccactaaaaatacaaaaaattagtcaggtgtggtggcaggcgcctgtagtcccagctacttgggaggctgaggaaggagaatggtatgaacccaggaggcagagcttgcagtgagccgagatcatgccactgcattccagcctgggtggcagagcgagactctgtctcaaaaaaaaaaaaaaaaaaaaaaaagaaaaccttttctctacatgttcttaaattgctagatatcctgcaattcaacacctctggtctatattaaatttagattttaacctaaagtgtccacacattggatacagttaaaaatactttctcactatctgatgttcactaagaaggtacttcttattacatatactctataaaatataacctcatagtaaatgctttcctatagtttgtgcattttctgtggcctcttgacttcacacagaatgattttccacattcattacatccatagggtttctgtcttatatgagttctgtggtgaacaattagggcccacttctggtgaaaggttttcccacattcattacacccaaaaagtttctcccgtgtgtcttctcagatattctgtgaaactgtagtagtagcaaaaaaatgcatcccttctcaacttacggatgttgagccaggtttcaccctgtgtgaactctctgatgtttactgaggtgtggcattgagcaaaatgtttcctatattcattcaccaataagtgtttttcacttttagttcttaaacataatctatggcccaaatcccagaataatgttttcctgcattccatatcttcatattgttttttccctctttaagttctcttctctactgtgagaactgacttcagggcaaaggtgttctcattatcattatattaacagatttctctcaccctttatgttctctgctctacaaagttctgacttcacccagagtaatttccctcacttactacatttatagggtttcacctcaagtgtgttctgtgatgtacagttagttttgacttaataataattttccacaaacattacattcatagggtttctcccctgtgtatgttctatgatgtgcaatgagttttgacttcacacagaatgattttccacattcattacatccatagggtttctgtcttatatgagttctctggtgaacaattagggccaacttctgatggaaggttttcccacattcattacatccaaaaggtttctcccctgtgtgtcttctcagatgttctgtgaaactgtagtagcagcagaaaaattttccacattgaatacatgcataagatttcccatctgtgtgttcttagatgtttagtaagggttgacttctcggagaatgacttcccacattcattacattcataaggtttttctcctgtgtgaattctctgatgtttaatgaggtcggattttctgagaaaggtgttgccacatgcatagcattcatagggcttctcccctgtgtgttttctgatgcacagttagaactgacttaaacgaggttttcccacattcatgacattcatgatttctccccacgtgtgttctctgattttgagtaagggatgacttttcactgaaggatttctccattcatgacatctgtaaggtctctcccctgtgtgaattctttgatttctaatgaggtctgaattcttatagaaggtcttcccacatccgtgacattcatagggttttccctgtgtgtgttctctgatgtcttgtgtgggctgacttctgggtgaaggtttttccacattcatgacattcataaggtttttcccctggatgtgttctctgttgtaaatgaagggctaatttttcactgaaaaaggttccacattcattatattcaataatattgctaattgagtgggttctctgaattagagtgggatttaaattctggctgaatgggtaaacattctgatgttcaaagagaatggattcctcaaagatactttctccacattcattacattcatagtggttctctcttggatgtgtttgctgatgagtaataaaaaatgacatataacaggttttcccatgttcagtatatttgcatgttttctgtcctgtgtaagctctcttatgtacaaggaagagtgaattctcagggaaagctttcccacattcattgtattcaaaaggttgctcccaatttttaatcttctgatgccaaatgaggtcttcattcagccagaagctgttcccattgttattatattcagaaggttcctcttcaaaatgaattatttcatgctttcatcacagaaacattttccacctttgttaaactcattgaacttcattcttgaatagtttctactggtattaattaattctgaaatacagagtgacaagaaagattagttgacaaggatatgtaagagaactgaagttagcattatgtttgaaggctcagtttaagccattatctcctcacacctacattatgacaacaatgtgcacacttccagtcttatacctcttttcaactcaacacagcagcaacaaatcaaatttctaaaagttctaattcatagatagtcctataatccaggctccaattgtgtgtgttgttgttgtttttgagacagagtcttcctctgtcacccaggctggagtgtagtggcatgatctcagctctctgcaatctccgcttcctgggttcaagcgattctcatgcctcaacctcccaagtagctgggactacaggcatgcaccaccatgctcagctagtttttatgtttttagtagagacaggattttgcaatgttaaccaggctggtctcaaactcctggcctcaagcaattcacccacattggccttcaaaagggctaggattacagacatgagccactgcatctggcttaattgtttttctagctctgattcactaggaataaaagtatgcaacaataagagtgaaatcaatgagtgaacaagtcatcgttgccacaggatcaggcttatggttctattccggctatgggatttgccctttattccatcaactgtactatattatactgagtccaatgttccaagaacaaacactttttttttaacaaggtatcactgaagtagacatatctttacgtttagattcagattagaaccaagccattcttttacaagtctataatgaatgtaattcactctaggtaagttcatctgtttgtccctcataaattgctcattcccatcataattttatactgatttttttttcattgtcagcttacagtctaacaatgtttttaaaaagttgccttcccaaattttcccaccacttccagattcatttactaaaaaacatgaaaggaccatttgtataattcatttaagcacaaacatcagctggattgctataacaatattctttgttaaacactgaattttaaaatatttcatgcagttctgttttcgttcaccaactatgttcctggcagccattactttacctatgattttctctcagtgccctacatagatatttatatcatggtacctaataaataatgtttatcagaattacccagagagcattttcaaacacaaattttttcaggcttcacgctgaaatcattactgtttgaatgtttaattttaattttaaatgctttttatattttagagacagaatcttgctctgtcacccaggctgcagtgcaatggcacaaacacagctcactgcagcctcttcctgggttaaagcaagactctcagctcagctccccagtagctgagatcacaaaaatcagccaggcatgggaccgcatgtgtgtgccaccatgcctggctaattttttaagttttgatagagatagggtctccccgtgttgaccaagctggtctcaaattcctgggctcaagagattctcccacctcagcctcccaaattgctgggattacaggcatgaaccactgggcccaggctattttaaaataattctgtaaaaaaatgtgaatatggtagaatgctaacgaatgagcaactcaaaaaagcatgtatagaaaaatatatttaatattttatagaaggagggatgctcttgaatgggaagaccacacgagggagctttccaggggtgctgaaaaacactctatatattcatctcaatgatggatacatgagtgtctcatatatatatatacacacatatatatttaattttattaagctgtgacttaactatataatttatatcacaattaaaaaaaaagatgtgtgtatggaagtgatactgggagatgctgggtgattaagagccactggatatttgggtcatgtcaacatgttacttccaaaggtctagagcctctaaaatatgattcctgaagaacatttcaatggtcttattatctgaacttaccctttgtgatctgcctacctttaaattccatctggcactaactcacccagatgactctggcttcgaaatttttcctctaatatccatggctccttgcctgtctccaatttgaggatcacttctggtttaggaatgcaataccctgtgaatgatgcaataccctgtgaatgagaattatattacttctgacaaactgggtgggtttccctgaaggaggaagacagtataccccaaacagtacacacacacacacacacacacacacacctcatttaatcctgtcgtggggcagaggaaaatattctttctggtatccaaaagggatacattgtctctgacctctaaatttcaaagctaaatgttatattttacaaaatttccacaagtttctatcgataagaaaggacatgcattctggccttctacatgggaaacaattcctacctacctactgagacaaggtggctgtagttctccagcatcacattcctctacagggtcctctgagcagggtccagatgatgccactcctcttgagtgaagcccatagtcacatccctaaatgacactgatccctggaaaatcacagttctgctcagtctgatgcaataagaatcagctgatgtgagacaagatgtttagggactaattcttacaatttttgttgttgaaaattaaatagaaaatgttataaagggcctccatgatatatgttgttttatgttacacattgtgggtaaaagatcatagcagaaatatcctgttggtgaattaattacttaatgcaaaagtatttagtacctacatgtgcctagagctttcttagtttctgagtattccaatttgaatacaagagtcttccttacaagagaggaacataccttctcataaggaaacatacatacagagacatatctaccacaggacttaaaggactcacaccacagatatgtgcaacacagatggatcataaaagtgttctgggcaaattcatgtgagagtgtgtcaacatattagacttcactgaagtgataaaactttagttcctttgcaaacatataacaaaaacttaagaaaacgttaaaaacctgaaaaaatatgtggcaagtcaatggaattgcttaacaggataacagcatgtcttacctgtgatgagataaaggttgcagaggcatgggagatgagggagactaggaaatacttttggctttaatcctgttagtgttctccaaatatttatcactcttctaatccataaaaatgtttagcaactactagtttagtttatatttataaagtaaataaaatacaatctacatataaggaaagcttaattttgttttcattttttagataaaaatataaataggcatgctgatagtttcctcccatgccctaaaggactggcagtatatgacataaacacaataatcttgcacacttcctttaggccataggctccctgctctcccaactccaagtcattgatgcaaatagcagaagttgatggtgaactgaaaatacacacctgaatccctgtaacataattcagttttcactcaggaagcaatgccaccaaagtacagtggagactgtgctggagagcagcgttagaggtagattgtctatattacggggcagcagtggagatgtggaagagggaattcactaagcaaaggaagagaagaagggctacttccagagggcctgtataggggccttagaaggtctggaaattagaaccaggaggttgggtgttgggggaggtgagagtacagagtgacaataagacacatgcaggccatgcagctcttggaatgtcttcatgtcatggaagtgagcatgtccagtggaaggttacagagatgattctgaagcttgggagagacctaaggtctggagttcaagaccagcctggccaacatggtgaaaccccgtctctactaaaaatacaaaaaatagccatgcatggcagtggatgcctgtaatcccagctactcaggaggctgaggcaggagaacctcttgaatccgggaggtggaggttgcagtgagccaagatcgtaccactgaactccagcctgggtaacagggtgagactccatctcaaaaatatatatat

SEQ ID NO: 330 - DNA, 22724 bp, Homo sapiens
gactcaagtaaatgttcttctctagaaaaacttttccaatttttcacatctactccgccccgtctttgttcccctaccccagcacctatctggttatacacctgtcccttggtatcctcagaggatttgttccagagtccctgacagacaccaaaatccatggatgctcaagtcttttatacaaaatggtgtagtgttttcatataacctatgcacatcttcccatatactttccttttctctttcttttctttctctttctttctttctttctctctttcattcttcctttctttttctttcttttttttttttttatgaaacagggtcttggtatatcacccagggtggtctctaactcctgggcttacaggatcctactgcctcagccctccaagtagctgggactaacagcacatgctaccacacccagccagtatactttaaatcatcttcagattacttataatacctaatacaatgcaaatactatgtaaatagctgttgaactgtattgtttttatttgtattctttaattgttgtaatcttttattgtttttttttcctaagtattttggacctacaactggctgaacccatggatacaaagggctgactgtattctgatgattaatttttgtatctttatcctcttcaagttagaagcccctaaaaagcagagattctgatcattccctgtgatatgcctagtgtgtagtacatagatgcccatagatgctcaataactgtgcatcaaatcaacaaataaatgaatgatgggtggctgaaaatcaggctgggttaccttgtgtctatcttagggcagtgaacttaaacatagaacctggagaatacacatgattttctctaatattcaaaaataatatgttgccacatctgaacatgacactatagctaaactcaacagcctcatcctagcatgttcacgaatatgccaagcatgttgtcttacctagtttcttgttcacatcgctttgagattttcttgtggtcttttcaatttcatccacaagcctctggctttctgcgaccaggcgttctgatcgggacctttgagcgtctgctctgtggtactggttcttgttagcaatgtgccactctgagggcaggaacttgggtggaggttgtaatagtttagccatttgaggtttccaaattcctgatcaaaagcagactcttttagattaaatgaaagcaatttgtccttttttatgataatttttattcaaggatgacatatatacggaaaattgcataaatcataatctgtacacaaaataaatctatctgtgtagccggcacccaaaccaagaaacaagcattaccagcatctctaacctcctcccagttactccacctcaagcccctcagggtaaccagtatcctgacttttaacactacaaattcgttttgctgtttttgaatttaacataaatggaataatacagtatgtattattctgtctctgacttctttagctcaacattatgtttgtaaaattcatccatattgtctatatgattgcagtttgttcgttctcgttgctgtgtaggtgccgttatatgaataaaatctagctgtcttttctactgtttatggatatttgggttgtttacactccagggccataatgagaatgctattaatagtctcatacatgtcttttggtgaacacgtgtatgcatttttataactcattagaattgttgggtcatggagtaatgttctgccaaacagatgagcccagagatgttttcttaaaaaaagaagaagaaaaagaagaggaagaagaaggaggaggaggaggaggaggaggaggaaatgtaacatgtgtaaactgacaactgggtattgaacttgttcaacacataaaagaatctgaaaacttccaggacaaagaaaaggagagaacaggaaggggaacaacacaggggaagccagctggcagaggctgtcggcagtggaaacgctaaaattacccatttcatcttcatacaactctgatggaccatgagaactgccttcctcagacagggctgaaatctgcccccactcccatctctaccctaaggtctgagtccctgctcttaggggcctctggatctctgaagccttcacatatataaggatgaaactagagtcagatcttgactaggctgagaacctcagcccacccagccccctcagacaacatggagtttctccgtttcttcctagcccagtcccttttatggcttctaccgaatttatctgagtgtggagcccagcatttaacccaaggctcctggataagtctgaatagcccccagagaggtggggacctaaattagggctcatcccaacgtcataaggatttggttaggcggggagggttgcgggtaggggtcggtggggtggggtcatggtttacttacctcagcgccacacagaaccactacgcaagctcgggatgggagcctccttaccccaactggagcttccagctcttgcagaacagagaggtaaacaacgcggtctccatgacaacaagtgacgcgttgccagggcaaagagggctggttccgccactgagcagcctggccaaaggcttagcgcaggcgcaaattctgcggaccccagagccagagacccaggagtgtggcgtgtgggaagggtagggccagatgctccggccacctcaacctaccgcgaagacgcggggcaccaagcagaagacagcggccaaagccccgagctgggagtcaggagacctgcgtctagtccgagccctcccgcgggcgggatcatctcgggtcgcgctgtaccccggctctcagacttcccggctgtacagtggggttgggctgggcgatgcctccaggacctcgcagtcgcaggcgaaattgagggttaaaaatcaggaagccaagttgattgtttctgtaagctacaatgagtttcctccagagtttgtataggtctgttaccacaactggcttatttctgcgtggggcgcccgatggggcactctgtgagggcaggtgtgtgagtagaacgccttcaggcaaacactccagaagtcactctgcatccactaggagatggaaaatatgggagaaaaattaaatctgaggggatagctccagaagatttaatatttgtcaagtaggacttccagaaggaaagaaaaaaagagagagaatggcaaaacaattgtgaaagtgagagagagataacttgagccaaagactcaagtctttagattaacgacccacctgaaattaacacacacccccattccttacatatagtcctccctgtggattatgcatataatccatagagtgattagctccaggatccccctcagatactgaaatctgcagattctcaagtctcatataaagtggtgtagcatttgtatataacctacgcacatccctagataggcatactttacgtcatctctagattgctacaatacctaatacaatgcctaatacaatacctaatatagtgcctaatacagtgcctaatgcaatacataatacaatacataatacaacacctaatacctaatataatacctaatacaatgcctaatacaatacctaatacaatgtctaaccatgcctactcatcgcttcattcgcatggattcaacatagcactcagggtgcaacaaattcaagttttgctttttggagctttgtggaatttttttcctgaatattttttatttgtgtgtcatcgcatccaaggatgtagaatccacggataggaagggccaactttatacctattctggtggaatttcttaattcaaagaataagaagaaaaagaaagaataggtatcaagtgtttcgtctctaacacaggtggctagaaatgatggttgctagaaatgatgctaggataatgccttcaaattctatagaaaattatttcaaatctgggattctacaaccagtcaaagcatttcatgtatgagagcaaaataaaagatttctttggacatgccagtactcaaaacggtgagcgtacattctttatggaaaaaaataatagagcaaaagtgaaaaatccagaaagaagaagatactggacataagacatagtggaaccaacccagctgtgtgatgaaaagaaagctcggtgtaatagctaccgaactaaaaagcaatgagtccaaattacaactaaaagtcaaaagaagttttgaacaatatctttaagaagagttatacaaactatgattcataacccagaagtataaccacatggtgagttgaaattatgtctcttctgagcaataaaaagtagataaatgatgacagtctccgtgatgcatgcctgaggtgccatcacttggaatgcctgggaggtatggcttgagctcaggagtttgagactgcagtgagctatgatcacaccattgcactccaacctgggtgacacagacccctattaaaatattttttaatttttataagttaaaaatagacaaatacaaattctgagaaaagttaaaagctgcacaagggctgggcatggtggctcacacctgtaatcttggcactttgggaggccaaggcgggaggattgcttgagctcagaagttcaagaccagattgggcaacatggtgagaccgtgtatctaaaaaaataaaaataaataaaaaacctacagaagaaagttataagtatgaagaaaattaaattttgatgtcattttcagagtagtatatgaaatacaagagatggtgccaaaagtcaccaccccctcatgatcatccctgctgaactcattcattctctgaactcattcattctctgaactcattcattctctgaactcattcattgatttgttcaacaaagatttgttgaccactctctgaactcattctctgaattcactcattcattaatttgtccacatacctattgaacatctatgaagtatcaagacctgtgctagacaccaaggatagatgaagataaaacacagtctctgccttctgtggagattacagatgcacagctattgacacagcaattcaattccacatctagggatttatcctacagatacatctgcacatgtgcaaaatgatgtaactgtgtgtaaaaagttattcattgcaaaattgttcttaatagaaaaaaatttacatatcccaaatgtccaccaagaggagactgattaaataaattatgaaacagtcatagagtattttttactgtaaaatatataattagaaatcttttttacatctctttgatatggagtgaccaacgagatatattaaatgaaaaaagcaaggttcagaagaattacatatatagtattttaccattgttatgatagaaaatggtaaaatgtaattgtttgtgtacccctagaatttctccagacagatacataagaaactggtaacactggttgcctctggaaagagaactggatggctggggtgtggagggtaaaggaggcttcactgaataatcttttgccttttgagagttgtacaattattatctcttttaaaagaatataaaaatgcagaaactctttataataaatgatttcagtaaatgaatgacacaaatacggcagccgatagaagagcaggaggtgtgaaagcgttgagacagagctaactagttattttgaaaccagaagaattcagagggagatgaacagaggcagtatgtctaggagacgacacacttagccaggggcctgaagactggcttccagcctggatctcaccacggacaagcctcaggtttcccatcctcgataaatctgtcatgctatcctgagtattttatggatgcaaaagtgctacccaaacatcagatcttattcacttcttatttaactgtcatacagtggccactgtgacccttgacctctgttttggtagcattgccagtagtattgggatctgtgtcaacttccccactgaactgcacctagattggggggaaaagactcccttcatataatggtattggtaagatgtgaattgttttccatcttaggtttcactgtggagcagtgagttcattgataagaaaccactagccctttattcttgctattccttataataagtatcaatatcacaggccattgtgcgaagctgggcattcaagaccctagtgttctgcgtctgtagcggggacttagtcccctgttgtatgacgctaaccccaaattagcaattaacaaacatgataacttaaaagcttttcattggaattttaacctaccaaataactgtgatgtgcttttaagaggcccttaggggaataaaaggatataaagcatgtgcttcccctttgaaataacagattttcactgccagtaaggatgaagagatgttctccaccatctttctttcaggtgttcacagcaaatcaacaaggaataaaaaaatgggaaagattcataagacactgatcaattacaggactgtatggcacacaccaggatgtcccggcacagttcacaagcaaggctccattcagggtccccatttctcatttctagaaggtggcttttctctgtaattgacaccacagtacaaaataaatcaaaatcctgaggctagaaacaagatagtcaagaatatgtgcaacatgtattgatttctagaagtcgtcacgatattttaaagtagcttcttgtatagaattaagtggtgaaatgcttcctgtttctcgaatgatcaccacaaccaccatttatcaagcatgtattatgtgccaggcactgtgcttgggagatattatcccatttaatctacacacagccctttaggagagctatgattaatgacccaattttttagaagacaggaggcacaaagaagttacttacagctactaaatggttaaaaaaaaggagggggcggattttaattacctgaccctagagcctgcaatgctaaccactatacccattgtcggagcactatattgactcacacgctcctaagagacaggttagtccttttcaaggtagtgcataatgatcttttcaatgtgtaacgttggaggcttgactagacctttcttaagtcttgttcctatttgcctccaggagtttgagcaaagtggccatttcctgcccttcatcacttgctgtatggttctccttaaagaaaaaccagccatgtgggtgatcctttgagcaccccatctgcctccacgggctctcctgtaagcttcttcacccagccaacaaggtcctgagcagaagccttgtttccaggctgtctcctacgtctggaagtctgggctcttgaatcacaacaggatcttgactgctttggcaatttgaatttgaggatgatgagcagtgcctcatctcaaaaaattactggagtaacttttatgaaactattttgttttcagggtctaaggtttttgctttggagacactcagggaatatgtatctactcgttcaggcttagaaggcttgctcttggctgctttgtaggcaaccaaaccaaatgttgaacatattcagggttttaccaagtactccaaaaacaagaccaaatataatcaaaagtaagcaagaaagaaatggtgagatggctttaaaatgacacctgcatgcacaatgttattcatttcagcatcgctggtaataggaaaagactagaagcaacttacatgcccatcagtaggtgtcttgctaaacaaattatggcacatccttaccattggaaaccatgaagctacaaaagaatgaggaaggaccttttgtagccaaacgaaatgacctctaaaggataattttcagtgaaaaacaataaaaaatcaatgtgatcctcctgcctcagcctcctgagtagctgaagcagaaaggttgatattatctattttgtcctcaaaaatatttctataaataagaggggaggaagaaaacatatatacatatttgcttgtaaatgcataaatatttctggaaggatacacaagaaactggtgaccttggctgactgtgaagcaaactaggtgtccagggagagtggtagaaggagacttttcactgaatacccttttgtgtcttttacactttgaaccatacacatgtatgtactacctttgcaaaaataataattgaattttattttattattattaaaattagttctagaccagtattgataagtaggaacaagatagaaagtcttataacaaataagacaaagggctagaatatttcagttacagtgataggctatgaaccgggtcaggactagccagttaaaagagtcactacatttggtcatttgctgtaaagaaagccgaaatcaaatcggtgctttggtaaagccattacataacctacatttggattaattccagttcctaaccattgtttcttcttgcagtgaggccccagaagtaattcaggcagaataatgaatagaaatttcgtagttttcctgaataatagtagttgagtgcctatatatcagaaagtgtttgcattatttatccatcatttaacaagtcccttcttaagctctgctccctgcatctcacagtgctaggtgctttggggtaggtagcatgggatcagcctctggtatcagacccaagttcaagtccagttcaggcttatactacttgcaggatttgtttcccttgttttttgtttgtttgtccatttgtttgggggatgtttagttttatttatttatttgccagggtcttgctctgttgttgcccaggctgaatgcagtggcagcaatcgtggctcactgcagcctccaactcctgggctcaagtgatcttcccacctctgcctcttgagtagctgggactacaggcacatggccacctgccaccatgcctggctctttctttcttttctttctttcttttttttgtagagtcacagtctcctatgttgtccacactggtgtcaaactcctggtctcaagcgatcctctggcttcagtctcccaaagtgctaggattacaggtatgaacaactatgcccagccccagctgtgtgatgttgggcaaactgcttgtctctctgcatctcagtttcctcatctgtgacaaatgaacacaatatctaccacatagggcactataaagattaaatgaaatcatgtatgtgtattagtccagtttcatactgctataaagaactgcccgagactgggtaatttacgaaggaaagaggtttaatcgactcacggttcagcatggctagggaggcctcaggaaacttacagccatggcagaaggcaagaaggaagctagacaccttcacaaggcagcaggaagaagaagtgcagagagaaggaagagcctctaataaaaccatcagatcttggccgagcacggtggctcacgcctgtaatcccagcactttgggaggccaaggcgggtggatcacctgaggtcaggagtttgagaccaggctgaccaacatggtgaaacaccgtctctactaaaaatacaaaaattagccgggcatagtggtagacacctgtaatcccagctactcaggaggctgaagtaggagaatcacttgaacctgggaggtggaggttgcagtgagccgagattgcaccaccgcactccagcctgggtgacagagcaagactccgtctcaaaaacaaaaaaaaaaaaatcagatcttgtgagaactcactcgctatcactcacaatcactatcagaacaacatggggaaacgatccccaagattcaattacctccaccatattgatactaaccatatcagtaggcaaattgcaacagatgctcaatacgtattttctgtccttcctttctctttaaggttcttggtgtcttaacatactcagggatatttatttacaaggcagcatattataacaaataagtgataaaaacagcgtatatcacaggattgtagttcctaactagcagttcatatcaatagcaaacaaaaaccttcttataaagttcttcttagacctgctcactcagtcattgaaggtagggctagggcataaaaattcaatatgtatctatttcctgttaaatcagtaatacacactgagaattaaaattttaaatataaaagggaatacagtgagaagtaaatctccttcccattcctattcctctggctcctttttccctccaaaaggcattcattttgtccaaagatatgtctcattattttttttctaatctttgttctatgtgttcttcaaattggataagttctatgtttctgtcttcaagcttgctgacttcttttggtcgttttcatcctgctataagcccatccagtgaatttaatattttagatatcatatgtttttagttctagaatgcaaccatttggttgtgttttggtagtttctatttctctgatgaaatttcctatttttcattcctcctgaacatatttccatttatatccagttcttatctcatgagctatttcccctaatcacagactaaaaatatatattttttcccttccatttaattcttagatggattccctgtctagagaatgaagaatttagattcagtgatcatcacagaaataaaattgttacaatcttttaaaatccttttattcaccttgaaagcaatttgggattttggactttaaaaataatatttcacttgaaaactgtctcaagcatctaatgtaaatgaaaacagcaggaattctgctaagtgatttgaagaaagacatcaaaacacactgacttttgcacatatatttttaattgagacagagtcttcctctgttgcctaggctgagcgcagcagtgaaaacatggctcactgcagccttgacctcctggctcaagcaattctcccacctcagcctcttgagtagctgggaccacaggcacatgacaccacatcttgctaatttttaaattttttatagggacagtgttccactatgttgcccagcctggtcttgaaatcctgggttcaagtgatcctcctgccttagcctcccaaagtgctgggattccatgcatgagccacctcacctagcttgcctatttttaattgggaatttttgggctctctctccagtgcctcattatgtaaggtatataacttgcagggcatgacctcagggaactttctagttgcctgaactttctaatggcgacaactaggacaccagaacacttttgccacctgtcctactgttgctagaataatgttggcccttgagttcatagacaaagagaaagcagttctctcctggccactcaggggcagaaaaagcatccccactcctctgcattaggagaaaacacattttctatgcatgaaagaaaaggaagcagaacttctgttaaaatgatgcccaggaaaaaactttttttttttttgaaattaactattctatcttatattagtcaataaggaagtgtataatatataatcaatatatattatattcactgaaaattgctttaaagatggtgctaagccaatactgagaagagtgcctgtaacaaaataggcactcagtaatcttttttaaaattcacaagcaaaaaaaatatacatatatatatatggttaaactggatttcatttcccatacaaataccagaagcttccaagaaaagtatattttgagagttttttttttcttgaagggcattatttttcatataaagtttgtgttgaacaaactttgttacaaagaacaattctatgctatggcagagtatgtttgcacattgcagttgtcttttttctttatgatgaaattatcaaacacattaataagatctgaaggtccagttttcaagaaaggaagatagtcatggatgctggtgtaagccttctagaaaattttcaggcctttagaaaaatttgaacaactgcctgatcccttgagtcgtgaaaggtattttaaaattagtattacggccaggtgcagtggctcacgcctgtaatcccagcactttgggaggccgaagtgggcggatcactaggtcaggagatcaagaccaatctggctaacatggtgaaaccccgtctctactaaaaataaaaaaaattagccgcgcctggtggcagacgcctgtagtcccagctactcgggaggatgaggcaggagaatgtcgtgaacccggaggcggagcttgcagtgagccgagatcgcgccactgaactccagcctgggtgacagagcaagactctgtcccaaaaacacaactaaaaaataaaaataaaaataaaattagtattacatagtaaaaattatgtgttaattattgttaatagtcttcagtgttaattatggacttactaattgcataaatcatgactattccttaatgttttatttcaaagtagagtttaggatgctaaacatatgtttattgtttgcaaatacctatgtgctggcatttatgtgagccaagcaaagtctgattgggccaaaccctgggaaatgtaaatatatttattcttattttactatttggcaaagtctcctgataattgtaataatgtctgctattgaatcgtggcagacaccatccagtgtttctcggaatacaggcagccctcctacactctgcatcagagcccctcccgcaggcgatgcttgttaaaggatggattcgcaggacccgccgctgaatcagaacttaagtttaaaaaaggctgcaccttcacgggtgctcgctctgtcctaccagtgagcttccctttagtttcgcgtttccacaggaaacaggacatagatctaaaattgcctttgcacttggactggtttcctttgctgacctaatacagaatagctttttgtgctgtgactgcgagtgtgttgaacagatcctctgtattttaggagaagaaatttggtgcctcgttgctcaccatcaccactggccctggtagctctgcggataaaccagcttggatttcacccttgaggattaacattgcaacactgcataggcacataaagccacctgaaagtcaagatgaggcaggtaatgtgcactgggatctcatgtggttggtgtcttgtcttttgccatttgtcaagcacagcagctgaggttgctgaagcaggtgactttcaagagccgaacccactgcaagaagctctcctggaaaggggcatcaaggctgctgaccctcctcctgcccctccgctgaccaactccacacctgggattagaggggaggaaacctttatcccatactctcttatgttctattcctggggacctgcaaattaagctgataaaacacagattaacaaaggaaaaataatacaattttaattgatattaatatttttatgtgcacaggagcttcacaaagagaagtagaaactcaaatacgtggttagatgtgagaaattatatactactttcacaaagggtgataaattatggataagtgactggacaaaggaaagaatgtttgggcttctggggttataaattgtgagaaagtgcttaggaatatatgggagaaaataatagaagattaaagttatctccataaggttggtttatgcagattcttctgaatgcaactcccatcaccagtgataagagtcactctttttcttccgggtatagaggggcatcttcctcaaagcaaaatttaggtcctgcatttaggcagataagggaaggcagagaacttttactgcatttgttgtttcttccttgcctatagctcaaaatattcttctgccaaggtagcatattttgggggtggcatattctgatcctctttaggatcatcagcacctccagctggggtgaggctggatgggggctggcacaaaggaggctttcaggcagtttccttgagttctaaccgcaacccctgcagaacaattggcctgtggcctgtggcctgctctccccactatgcctgaattgctgtggactagtttatgaatagccctctgaacccagaggaagctcgaggaacagaattgacatacccatcagctagaatcgctgtaggaagacagaatcagtgaacataaagtatccaagttcaaacaattgaaaatgaaataataattaatttttaaaagagctttgtgaaatatgtggataaagcatactttccgatgagcctaatactatgaatgataaattataaacgggagtcctattttaaatctaagcaaggattttaactcaaggaaatcaatatgttccacaagagggcagtatggtaactcgtttataaaacagtaggctcagaagagccaaggacgtttgtgatcagtttttaaatttgtgataagaactgctttgagcagaaacaaaaatcaaacaccatttttaccgtaaagagtttttctacatgacatgaaagctactcaaaaagattggggagttttttaagtgtgaatgacatacttttgaaaaagtaagctcctggacttggaactatacagaattgctttcattagttgctatgttgctcggttgctatgtggtctagtaaaagctacagacaaaatcaaggaaatcacatttcctctgattcctcacctcaagttgtgcctgacaaagtttgtgggagagtctaaattgggaaagatagtgatccttacagctagctttatctgaactctgagtagcaggctgggcgctttacgtggattatttctttcagccccatcgtagctctatgagttaggaactattattatcttcatttgatagacgaggaaaccaaggcccatagaggactgaatgcttgcccatgggacatggctcatgcagagttgggattcaaatcgggcacatcaaatctagatcccaagtttgagctatttctaggcaattagtagcaaagacagaactagaacccatatctctttgttacgaattaaagggtgactttaatgttgaaaacgatgtgtatggcgggactgagtagaagaaacctttggaggagggctgatgggccagacaaaaagtgactgtgtttgcaaaaagacaggttcatgccaagaaacgagaacattcctgtctgagctgggatcccccatttatgccgattatgcagtgtcagggttgtcaagagcagagggatttccccattctcttctcaaactccaaagagctctgagatccacaggctggtggggttcccaggagaagcctgcagaaggtgcttcctccttcagggcacagaagaggacgaagagaagttcacctaaatccccagagcccttagtcaagttcatcccaaaactatccgaataatcatgactgctatcccttgagaactcaaatgccaggccctgtgctaagcattttacttgtgttagctcatttagtcctcatagcaattcaatgaggtggggcttatgttcaccatctgggaatttcacaggctggcccctctcacaggagtttcatcatgtaaggcctgcgtacatatatgcatgagaaagcatgtcttgtacacaaattggttttcctaaaccctccctcatctttgagcaatgcagccgattttgtttttaaaatgcagcccacttctgagtaagcatggcagattgctcacttcccccttccaaaactccactgaaatggcaataaaggaatcaagaatatataaactcataaggtgataaaatgagggaagagatgaacatggatgagagagtcccacaaatatctggaagagggagaggagcaggagctgacttggcagagctggggatcactacctggctccctgcagatgaggaaactaataagcagaagcgaggtggtcttatagaactctaggtgctgaggacggggagatccaaatctacagaaggtgggcataaggcatgggactaaaaacaggggggctaagtggcctgtatagggggaggatggacccccttcctcctcctacagcaggcgcaccccagctgtctccacccacccattgcacgcctccccaccctcactgccagcaggaggtttgacacattctctctggataactgaatggctcctgagaaaagacccccacattctgacatcttggagtcccgccccagtttaaaagccagtttgctgtccagcgaccttgttgtaagtccttctgtggacaagcctcacctactccctcagagttctcattcatctttttagtgagtcacacttagacagaaacaggcagcccaggatctccaaatgtttaaagacagcctccaacttggaagaaagaaatccaaacaaataggaaaaaggaacttggagaaagcagaaatgatggaagacgtagaaaaaaatgtgaaaataaaaatttgataagcaatttcttcagaaaaataaaataaggtgttatatccattaatcaagagttagattctttttttatgtactttaagttctggggtacatgtgcaggtttgttacataggtatacacgtgccatgaagttttgctgcacccaccaacccatcatctactttaggtatttgtcctaatgctctccctccccttgcgccccatcccctgacaggccccagtgtgtgatgttcttcctccctgtgtctgtccatgtgttctcattgttcaactcccacttatgagtgagaacatgcggtgtttggttttctgttcctgtgttagtttgctgagaatgatggtttccagcttcatccatgtccctgcaaagtacatgaactcattctttttatggctgcacagtatttcatggtgtatatgtgccacattttctttatccagtctatcattgataggcatttgggttggttccaagtctttggtattgtgactagtgctgcaataaacatatacgtgcatgtgtctttatagtagaatgatttataatcctttgggtatatacccagtaatgggattgctgggtcaaatggtatttttggatctagatccttgaggaatcgccacactgtcttccacagtggttgaactagtttacactcccactaacagtgtaaaatgttcctatttctccacatcctctccagcatctgttgtttcctggcttttcaatgatcgccattctaactgacgtgagatggtatctcattgtggttttgacttgcatttctctaacgaccagtgatgatgagctttttttcgtgtttgttggctgcataaatattttctcttgagaagcgtctgttcatatccttcacccactttttgatagggttgtttttttcttgtaaatttgtttaagttccttgtagattctggatattagccctttgtcagatgggtagcttgcaaaaattttctcccattctgtaggttgtctgttcattctgatcatagtttctcttgctgggcagaagctctttagtttaattagatcccatttgtcaattttggcttgcgttgccattttttttggtgttttagtcatgaagtctttgcccatgcctatgtcctgaatggtattgcctaggttttcttctagggtttgtatggttttaggtcttccgttaaagtctttaatccatcttgagttaatttttgtataacatgtaaggaaggtgtccagtttcagttttccacatatagctagccagttttcccaacaccatttattaaataggaaatcctttccccactgcttgtttttgtcaggtttgtcaaagatcagatggttgtagatgtgtggtgttatttctgaggcctctgttctgttccattggcctgtaatcccagcactctgggcggccgaggtgggcggatcacgaggtcaggatatcgacatcatcctggctaacatagtgaaaccccatctctactaaaaatacaaaaaattatccaggcatcgtggcaggtgctactcgggaagctgaggcaggagaatggcgtgaacccaggaggtggagcttgcagtgagccgagatcgcaccactgcactccagcctgggctacagagcgagactccgtctcaaaaaaaaaaaaattgttatgtgtgaatttgatcctctcattatgatgctaactggttattttgcccgttagttgatgcaatttcttcatagtgtcgatggtctttacaatttggtatgtttttgcagttgctgctactggttgttcctttccatgtttagtgcttccttcaggagctcttgtaaggcaggcctggtggtgacataatttctcagcatttgcttgtctgtaaaggattttatttctcctttgcttatgaagcttagtttggctggatatgaaattctgggttgaaaattcttctctttaagaatgttgaatattggcacccactctcttctgacttgtagggtttctctagagagatccgctgttagtctgatgggcttacctttgtgggtaactggacatttctctctggctgcccttaacatttttcctttatctcaaccttggtgaatctgatgattatgtgtcttggagttgctcttcttgaggagtatctttgtggtgttctctgtatttcctgtatttgaatgtggcctgtcttgctagtttggggaagttctcttggataatatcctgaagagtattttccaatttggttccattctcccttcactttcaggtacaccagtcaaatgtaagtttggtcttttcacatagtcccatatttcttgaaggctttgttcgttccttttcattcttttttctctaatcttgtcttcacgttttatttcattaagttgatcttcaatctctgatatcctttcttccacttgattgattcggctattgatacttgtgtatgcttcacgaagttctcatgctgtgtttctcagctccattgggtcacttatgttcttctctaaactggttattccacttagcaattcatctaaccttttttcaagattcttagcttccttgcattggattagaacatgctcctttagcttggaggagtttgttattacccaccttctgaagcctatttctgtcaatttgtcaaactcattctccatccagttttgttcccttgctggcaaggagttgtgatcctttggaggagaagaggcgttctggcctttgcaatttttagcctttttgcactggcttctccccatcttcatggattgatctacctttggtctttgatgttggtgacttttggatggggttttggtgtggacgtcctttttgttgatgtttatactattcctttctgtttgtttgttttccttctgacagtcagggccctcttctacaggtctgctggagtttgctggaggtccactccagaccctgtttgcctgggtatcaccagcagaggctgcagaacagcaaagattgctgcctgctccttcctctggaagcttaatcccagagggaaacctgccagatgccagccggagctcccctgtatgaggtgtctgtcaacccctgctgggagatgtctcccagtcaggaggcatgggggtcagggacccacttgaagaggcagtctgtcccttagcagagctctagtgctgtgctgggagattcactggtctcttcagagccggcaggcaggaacatttaagtctgctaaagctgtgcccacagctgccccttccccaaggtgctctgtcccagggagatgggagttttatctataagcccctgactggagctgctgcctttctttcagtgatgccctgcccagagaggaggaaactagagaggcagtctggctacagcggctttgttgcactgtggcgggctctgcccagtccaaacttcctggtggctttgtttacactgtgaggggaaaaccgcctactcaagcctcagtaatggcagatgcccctccccataccaagctcgagcatctcaggttgacttcagactgctgtgctggcagcaagagtttcaagccagtggatcttagcttgctggtctccaggggggtgggactcgctgagcaagaccaccttggctcccttgcttcagccccctttccaggggagtgaaaggttctgtctcactggggttccaggtgccactggggtacaacaacaacaacaaaaaactcctgcagctagctcagtgtctgcccaaatggccacccacttttatgcttgaaacccagggcccttgtggtgtaggcacctgagagaatctcctggtctgctggttgcaaaaaccgtgggaaaagcatagtatctgggctgaatagtacagtccttcatggcacagtccctcatggcttcccttggctacgggagggagttcctgaccccttgcacttcccaggtgagacgacgccccaccctgcttctgctcacccttcgtgagctgcacccactgtctaaccagtcccaatgagatgaactgggtacctcagttggaaatgcaaaaatcacccatcttcctcataggtctcgctgggagccgcagaccggagctgttcctatttggctatcttgccaagttccccctcattttcttgaattacagcttttagtattctttctgatcctttgctttggtttttgttcatctttccgttgtgcttttgttttgtgtaatgatattattttgccctttattgtctcttttcttatagtaactttgtatgggatttgacttcactacttttctactgccatttttatgtgaattttgttttccatgttaataaaaagaagcttgttcagataacacatctaacttcttggatccccatccatttttgttcttgtaatgttcaaaaacatgatggcctgcttttggagatttcctggctttgtttccccaccctgtgcttttctggatcttttctttcatttatttcagttgagtttttccaagggtttctctgaagtgttccgctccatcctggaagacagccttggctgaccagtttcaggagttcccgtaggtccttagatcttatcaactgtgcctggcacctacttgctattacagtggtgataggctttggatctgtgtcccctctaaatatcatatcaaactataatccctattgttggaggtagggcctggtgggaggtgactggattgtcgaggagatttctcatgaatggtttatcaccatctccttggtgctgttctcgcgctagtgggtgacttctcctgacatctggtcgtttaaaagtatgcgacactgttttagtctgttcttgcattgctataaagaaatacctgagactgggtaatttataaagaaaaaatatttaattggctcatggttccacaggctgaacaggaagtatgatgctggcatctacttggcttctgggaggcctcaggaaacaaaatcatgatggaaggtggagggagagccacatggctggagccagaggaagagagagagaggggagaggtgccacacactttaaagcaaccagatctcatgagaactctatcataagaacagtaccaacggatagtgctaaaccattcacgaaggatccacccgcatgagccaatcacctccaaccaggtcccatttctgacatttgaaaattacaacttgacacaagatttaggtggggacacagatccgaaccatatcaggcaccttctccccctcttccttgctcctgccttcaggatatgatgtgcctgctccccctttgcctttttccatgattggaagcttcctgaggccttcccagaggcagaagccactatgtttcctgtacagccggtagaaccatgagccaattaaacctcttttcttgtaaatgagccagtctcaggtatttctttacagcagtgcgagaatggcctaaaacaaatgggcatgttccctcctagttccagctgttgttcccaaattggcctactacaattttaccattttcaggtttgtcatatgtcctgttgttttcttccaagttctcttgcacaggtgagatgtggataacacataggtcttatggctgttggtggtttgtcctgttttggagtttgcagggattacttgtctagctttttgtaaatgtgattcatgagtatttgattttgctatctagttctgtctgtttttatgtggatatccaggaagatccaaattctatgctgcctccactgaaactgtcttcccagaaatgtattactttttgtcattaaaaaggaggtataggaagattaatctatgcactgcatttggaaaggtgtttgtttgtttgttgtttatttttaggttgcagtgatggcagggagccaatgttgatttctgatatgggaggatgatgatcagagctggtcatctgaaagattaacttggcagaagtttgaagattgaagaaaagtagtggagtgagaaggccaattctgacagtacatcagcagtccaaataggagatgataatgagggaaaggtgagtgggaagggcaaggaaaagacagctgtggggaattcaataaacgctgaatcagtggcttggtggtgagggaaggatgaagaagagttagaagaatcagaattgactgaaaatttgtaggatgaatgtctaggggaataatattacccaaaacaccagtgtagatgaggaaaatgatatggtgacagtaataatgaggggtcagagggagagcagtgactaattttttttttttaatttgcatttcactagctggaggtacctcaagaaaaagatgttgtgtgtgaatgtgcagggctgagggaaaggtccatgctagacacacagatttgagagtcatctgcaaagtatact

SEQ ID NO: 331 - DNA, 22952 bp, Homo sapiens
ctcttcagtctactcctatcccagtcatacctctgaaattgtcaaactcaccaatcggctgcagggtgtttcctctgtcatctttttttctttcttcttttcttttctttctttttcttttctttttttttttttttttttgagacagagtcttgctctgtcacccaggccagagtgcaatggtgtgatcttggctcactacagcctccactgctgggttcaagcaattctcctgcctcagcctcccaagtagctgggattacaggcatgcaccaccatgcctggctaatttttgtatttttagtagagatggggttttgccatgttggccaggctggtctccaactcctgacctcaggtgatctgctcaccttggcctcctaaagtgtctgtcatctttcttgataggtgaattatttatggtgtgggctatgatgctaaaatagagaccccaaaatacagtgattgtagagagaatttaatttatttctttcacaagggagtccaaatggcagtaggcaatccacagcagatggatggctctgcttaagagcattcaggttcccaggttcctttcaccaatttctctgatattccttggagtactgtcctcatgcacatgattgaagctgagccccttccatgtccacattccagcctatggaaaaccaggaaaagagaaaggtggcgtgcacacccaatattgtaaggccaagtatagcagattgcataagttcctttttctcacaccccactgacttgagctcagcctcatggccacacctagctgcaaaagagactgggaaatgtagtctccatgtaagtggctttgtgtccagctacagctcagtggtttctattactaaaagaaaaatggagaaaatgggtacagaggacaagcaggagtctctgccacaacatcttaggagcatttgttacagaggatcgttctctccttcatggaatacttttgttcttttggcttcagtgacaccacactctcctggttttcctctgggccctctgcctactcactcaatctcttttgctgggtgaacttattctgtttgacctctgcatgttggacttcctgaaggctttgtcctgtgccatcttttattccttccatctacatgcttctctaggtaattttattcaattatgtgattttatataccacattgatagaaataacttctgaatttatgtctttagccatgacctttccctggagctccaaattcatatatccagttgcctacttaacatagttgatcataactcttggttactttggccacccatgtccctctcccaagcctgctcctgcttcagttttctgcatttcaagaaacagagaaatagcttcagcatcattccaggtgctctgacaaaaaccttaggtatcattcttagcttagttcttctctcacttcccgtcatccacttcgttgacaagtttataccctcgacctccaaaaaaacacatcctgagtttaacttctttctgtcttccccattaccagcctgagcccagccagcctcaccattttactggatgactcatcttcctactgccactttcactgccaacaagccaaccttacacagcaccctaagtgatgaattaaaaacatgaatcagctcatgttgatcattgaaccctttcccatctcaccttgaataaaacccaaactctctaccctggtctacaaagccctacagggactggcaccacccacctctccagcctcatctcatgtcacctgttttctcaatgacccactcccatcacggtggcacataccaagtctatttccattttagggaagatatgaggcagaaagaccttaaatggatgttttctctgcatgaaatgcttgtgccccagaacttccccaggaagatccttctcatcctttaggtcacattgcaaaggtcaactccttagagaagttgtccctgtccacgcagtctgcagtagactgctcctttcaacccatcactcttagtcgcatcaccctgtcttattctctcaataacacttaacactacctagcataatatatttgtttattcgccatccatctcccctcacggtggatgtgaatttcatgggagcagggcttgtcttgggccccactgcaaatcccgggccaggcacacgttgggccctcagtaaggatctgctgaatgaatgtatgtctgaatacagctccaattctggaacctctttagcaccccaggagtattttaaagaccatgaatgtgtgaataaaaattctatatttccaacttcttttaaagactttttccagactgctttagtaccataaaatctgcttttctcttctgacataagggcaaaaaattagattctcctttagtaaatgcactcaggcatattcaggagagaccacagcctttagtgctcaggttcttaatctgagtccatggacccctagaaggtccatgggtgtgctgaaattatatacagaagatacattcatttttctaggaggtaggttcataggtttgttgaatactcagaggaggtcagtggccaaaatgaaatccattttattgtggaaaaagtattagaggccgggcacggtgcctcacgcctgtaatctcaacacttggggaggctgaggtgggtggatcactgaggtcaggagttttgagaccagtctggccaacatggcgaaaccccatctccactaaaaatacaaatatatatatatatataaatatatattttatattatatatatatattttatatataatatattatatatattatatatattatatatattttatatattatatattttatatataatatattatatataaaatatattttatatataatatataatatataaaatatattttatatattgtatattttatattatatattttatatataaaatatattttatatactatatattttatatataaaatatattttatatactatatattttatataaaatatatattttatatgtcatatattttatatataatatatattttatatgtcatatattttatatataatatatattttatatgtcatacattttatatataatatatattttatatgtcatacattttatatataatatatattttatatgtcatacattttatatataatatatattttatatgtcatacattttatatataatatatattttatatgtcatacattttatatatatcttttatatgtcatacattttatatataatatatcttttatatgtcatacattttatatataatatatcttttatatgtcatacatataatattatatatattatatattatataatatattatatattatattatatatattatatattatataatatataatatattatataatatattatataatatattatatatataatatattatataatatattatataatatattatatatattatataaaaatatatattttgtatataaaattttatatataaaatatatatataatacattataattatatatattatatatatatatatatatatagccgggcatggtggcaggtgcctgtaatcccaggtactcaggaagctgagggaggagaatcacttgaacctgggagatggaggttgcagtgacccaagatcacgccactgcactccagcctgagtgacaaagcgagactccatctcaaaaaaaaaaaaaaaaaaaggtttagagatggacttgcgcaatctctatttgagttctggtgatgtcagtcacaaataatgcaaatttgtgcagattatgtaatttatttagattctagttttcttatctttaaaaataatctgacttacatgtattctgacttacatgtacccacacttaaaatatatttaatcccatcacgggatgctatgtgctttaccgtatctcacaggtaatgacaatgaggctcagaatctactcaggctacttgccaaatcacatttgttcccatataagttgtggatcaagacccatgtttctcccatgcttcaaattgcctgctctttattttatttatttatttatttagacacagtctcgttctgtcacccaggctggactgtagtggtgcgatcttggttcactccaaccttcacctcttgggttcaagcgattcttctgcctcagcctcccaagtatctgggattacagatgcccgccacgatgcccagctaatttttctatttttagtagacacaggatttcaccatgttggccaggctgatctcgaactcctgatctcatgtgatccacccacctccacctcccacactgctgggattccaggcgtgagccaccgtgcccagcctactttttaaataagagtttgcagtaccatcattctgcagtccaatttctctgggtggaataatgtcttggaccacttcacagcaagtaccatagagaaaagcagccagctggtgatgtagtttcccagccaggtaagcgcgcttttgaaccagaccagagccctgtgaacccaggagtacgggctttatcatccattcttgacagaagagaaaatgaaagcacaaagagattaagtaattgactctaggtcagaaggttagtaattttcagggctgaaagtttatgcttcacaatgtaatattttcttaacttttctactaaaatgaccttgggaatctttactaagattcttcactagagggctgactcttatcgtcatagtttagtatttggctgttcttcaaaaaattattttaaagtactttgcaaagcttgagtaatattttttttctaaaaggacaggaagatatgtaatgtgcccattgaacaaggattaatgacattgttaggaaggaaggaaaaaggatatcacttctacatcgatttcagcgtttatgcattaacaccagacaatgacctctaaaatgagaagagcactagcttaacattgtaaattgacaaggatcttggaaatgaggaattaaggttagtcagagattcaactgtatagattctactcatggcagggtaagaggcaactgagaataacatgaaagccaccggtaagtatttgactttttttttttcctttccctctgcttatactaatggtccattatacttcaggaaaaatagagacagtactgagactgtttccaaaagaggctttaggtggctaatagtgtcacactggccagtctcagggaccagttgtgcagtgcacttttgacttgaaatacagttgttgttaagcataagttaaaagctgagttttcaaaagttgtgtcattgcataggagtttaaatataagcaatagcttattggctactaagtgcagtttttataatcctcccatccaaatgtgcctctagatcatacactctggtcagatatgcttttgagacactgttcaggcaaaggcaagcactaccttcccagatggttttcagtgcatttctgccccacaaaccagagcaactctccagtttctttctttctctctttcttttccaaggtcaaagctcagacagcttggttctccaagagactgatggccccaatccctgaaatgaacagcagtcctaaagagcagcagcctctctgccaaggggaatggcaacaccaggcaaagccaatagactcatctcttttatgattccatgaggcgttcatgatcacagggagtagctgcattgctaattaggggtcacggaggtggtgagggcctcattcattcattcaccctttctttcagtgaatacatcttcaactgcaaacaattcttttgatgattatctgaatgttctcgcagcacggaggcctactttctaggacctccacgtctcatccgcacttggccgaccacggaatcaatgagatttgactcaccgaacatcagactcttcctataaaaaactcatctttttattcaacaaatatttcttgagtgatcactacctgtgagcactattctaggtattggagataaaacaataaacaaatgggacaaaatcatagccttcaagatgcttgttttctaggggggagaaatatacaacacatacaaaatactaacatttcagattatggtacattccatggagaaagctaaagaggtcaagagaataaggaatgtggatgcacacgtgcattacatagagagtagtcccagaaaactcctctgataaggcaacattgagcaaaactgggaggaagtcaaaagtcaagccatgcagaggtgtggaaaagaactttctaggcagagggaagtgtgaaagcaaaggtcctaatagaggagcaagtttttgtcttgtctgatgaatgaggataggtaagggtgagcaggaaaagtgataagagatgaggtcagagaaacaatggagccagattgagtaagacctcagaggctactctaggatgctgccttttactctgagtgcattggaagccactggcaagttttgagcagcaatggctattttggctgctctgaggagaatggaatatggggtgaaaggctgggagcaggcagaccagtcaggaggaacaacagaaattgctgattgccacatagtagccatctgccctttctttctttagcaatagaaccctgattcttatttgtggcagcaacgcacccagctaaagtctagatttcctagatactctctgtcccctgtcccttacaattagacagagtcatgtgattaatttctggccaatgacctataagaaggtagatttatagcacactttggagcactgcttaaaaagagcctactcagttgggagttctttgctcttttgcttccttctgctgccaacctggaacatagacataatagctggaactctagcagccatctgcaaccataaggagatctttttgttttgttttgtttttctccccttctgcattcttatcatttatttgtggtaagaacacttaaaatctattctcttaacacttttcaagtatacgatacgatatgttattaactatagtcactacgttacagaactcttgaatttattcctgctgcctagctgaaattttgtatcctttgaccaacatctcctcaatccctacccttccctccttaaaccctgttaactgtaattcctctctctgcttcaatgagatggccttttttagatttcacatataagtgagatcatgtagtatttgtctttctgtgtctggcttatttcctttaacataatatcctccagattaacctgtgttattgcaaatgacaagatttccttcttgaggctgaatagtattatccattcatctattgatggacacttaggttgattccatatcttggctattgtgcacaatgctgcaatgaacatatcaaagaggtatgaagatttcatacctttttgaaatgctgattacattgcataagacggcctttaaaatggaagccacatgctgaggatggtggaacagaaagctcaggtgggtccctgaggatagcatagaaataccacaccaaatctggacggcctatttctggactcgtttcacatgagagagaaatgggccaggcatggtagctcatgcctgtaatcctagcactttgggaggccgaggtgggtggatcatttgaggtcaggagttcgagaccagcctggccaacttgatgaaaccccgtctctactaaaaatacaaaaattagccaggtgtggtagtacacgcttgtaatcccagctacttgggaggctgaggcaggagaatcacttgaaccccggagaaggaggttgcagcgagctgagattgcgtggctgaactccagcctgggcaaaagagggagactctgtttcaaaaaggaaaaaaaaagagagagagaaaaaaaaataaagttcttttctgtttaagccactggtttttaaatttgcggttttttttttccagctctatgtagctaaactgaaacatgatgaatataagtagcctttgcaacaatccaggtgagagaagacagtggtttggcccgggggggtggcaaaggatgtcagatactggacttttttttgaatcctataggatttgcagatggtttagatacaagaatgaatgaactattaatagaaaaactaagacttctggtttggggcccaagtgacttgagagtgtaatgatttacagagatgcagaaggctatggagggggcaggcttgggtgtgggactggggttggtgggaacggcagtctagggcacacgtggcagcatggccttgatagaagcaggaacacgatgaaacagggagggaggccaagagcacggggcacagattggtaggaaatgagtgagctctcatcctactgcttctattttctcaacaaaggctgatccaggtcatcccctgagactgaagggaagaaagcagagggtggagatgggaggtttgaagagaaagacactatggaatagtccttttagtgagtgggattgctgggcagccatgggtgtgcatctgtctgaaatctgtgctctctaatttaaagaaaagccacttaccagcgctgtgtgtttttctgcaatccagtccagttgcatggttgggtttaactgagcctgggtttcaccagacaagcactgtaggatataagatgagagaaacagggggaatgaaggggtgtttgcaagaaggagatcagaatgatggatcaggaatcaaaactggataaagaaagaagtaaacacatgagatggatgaacacagacttgacagttcttgaaaagaccgaaaaacagggtgggctccaaagaagccaaacagaaggatagaaggttgtgaagggggaaaaggagatttcggagatgcaattagtcatcagtgaggacaaggtcaaatgagtcactggagagagaaggaattgagaagctaaagatattgaatggaggtcaaggtgctgaataaagtatatttcattataagactaataataaaattcgttcacaacttcctctaattagatttgttatctgctttgaataaagataccattaattagtctaagtactttaaatttaatttttttttctgaagggatatttatgggacttcaaagaacaaagttttacccaaacaactaagtttttgttgggtgaaaatataaagcatttttttccatgtgaaacttctttgtatcttgatatctcttctttttcttctgtgagtttttttaggcggcgagtctattaacacaatcttttaaagattgacctgtttattctctctgaaatagttcatgtcatagcttgtttcttctaagctggactttgcccccttgtactttccttgcaactttttcatcgttttttaaaacaacatttattctcatatttacttattttctcaaatgtttgtttcctttcttcctgctccatctccctgttcctcagattcctttccttaggagaaaaaattggggtatttcccacagcatgctgtgagaaaagtctctgaacttcctgggggtgggacttgtgaacacagagggtcttgcacactattttatatccagcgagtgttcagattacagggccaggcctcagatacaggtccagtttgtggaaggcggtccctgaaacattatgaacactgctttgctccttctgtctcctagtccctcttcttaagctcaaacgttattaattgggagtctgttctgggctactcattgtactgattaaagtaattcacattaatgggcaatgactgatctactcaattctcttaggggaagtcacatttctaaaatgtgcatattaatccaaataaaaccctgattcatgagataaatgtaaagcaaatgattaacactctattcagggttttctgtcacagaacaaaatattttcttttctcttggggccccaaaacagccttctcatcccttagaaagtgggctaggacaatgtaaaattggacagtagagttgtgtgtgtgtacgtgtgtctctgtgtgtgtgcagcacctgtcacctcatctacacatctctctagctcatgatatatgtttcaaatcatgaaccagagacattcatatatgaacatggttaagacatattcattctttctttctttcttttcttttctttctttttttttttttttgagacggtgtctcgcactgtcgcccaggctggagtgcaatggcgcgatctcgactcactgcaacctccgcctcccgggttcacacgattctcctgcctcagcctcctgagtagctgaggttaagacatattcttaacgagtaagttctttgtctaggataatattttgtaattttccacagaatattcttcagatgcctaacttgatgaaggttttcaggagcctagtcttagaatcatagaggttcttggctcctggttccttcttaaatccaattgttcattactggaatatacaaatgagtagggagccagaaatgataggcaccagaaactgaggtttccatttctcaatgtggcctgaactaaatgaattaaatctcatcctcctatgggacgtgaaggaaaagggctctggctgggaagtactgctgtgcagtggttagtatagtgggtctgagggtcaaatagatttgagtgcaactcccaacccaactcctactactagctttgggacctcgggtgagtcacacagccctcaggtgctacagcttctataaatagtgatatagtattcttacttaaagtgtggctgatcagagcagcccttccgtggatcaaccaccccatcagaggatctatgtctaggattgagccttttctgccccaggaggttctttcaggtccagaggctttcccgtggagggaagagaggcagcaatgaaatcagcgtataggcggactgggctctttccccttcatgtctgcagggcaatgacctcctagagtccgctatgcaccccccacttgcctctctgggcactgcgaggtggagcagttgtaggaccaggaaaagcaagaacagagcgtcctcttcggctaccctacccgggagttcaggcgctgcgcctggccctctggggcgtgtttgaccataactcgcaccgcttgctcttttcccatttcagcaaagtcttgagcctgtattctagtaccttttatcagccttgggtaagcagctcgcacggggtatataaggagaatcaactttctgaactgaaaaaaatgtaaatagtaaagtcagtcgtgcttcttcctgccggtgactgtttacaagagggaagtcagcggggcccccaagaggtcgctggtggcgcaggaaccgcatccagattgtaaagaacgggggaaggaaaaaaaaagaaaacacccagaaactttcttccttgttgcgaataatcgccgcctccccccctccgcccccagcagaagcagtaacgtgacacccgagcgaaatcccgagacccgagcggagagggaggggagagggaggagagtgctgcggagcgccggagggagaaaggggaggagaaggaggaaaacccctgtcaaggaggtggagcgaggggatggtgtccgcctcctgttcctccctgccgttttttagagaagcctgaaccgggacaaaacacgccgagacctacagacacaaagccggggggtccacgctggcgctggaggcgagccccggcggccgcaagcgagcccgaggcgcggcggggcgcggggcgtggggacgctagcgggcgccggacgggcgcggcgccccgtcacgggcagcgccccgaaccggggccggacacctcggccgctcgggccgcggcggcggggaccatgccgaagaaagtctcctgagcccggcaacttcggcccctccccgcccccacccggctgccctccgcgcggccctccccatgtgcagccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctccgggactacggcttctgcatggccaccctgctggtcttctgcctgggctccctcctctatcagctcagcgggggaccccctcgcttcctgctcgacctgcggcagtacttgggtaaggaagctgggcaggcgctagggcggcgccgacagcgcaaagttgtgcggcggggagagggtcgcggcggggacttctcgcgctgccaccgcgcgccgccgccgccccgggtctctccaggtgctaagcccgtgagcatctgtgccgcggtcgggagcgccttcttcctcccgcgcgtccgactgtcctcaccgaggcgggggcgccgctgggttgcgctgccggcaggtaccccggggcgaggcaccgctcaccttccccccgccccacctccgccacccggatccggactggggcggagtggatgggtgtgtggggtgtgccggagtgtgtgtatcttcaggcctggcggcgcggggagtggcgaagggaagggaaggtcctcttcgttgcattgttagtgaccgcagttcagtcccgtcccgcgccccggggagtgtgggtgggtttagccctttgccaccgtccgctctgagaattctgtcccgcagatcccccgcctgcccgccggccctagtggctccgcgctgtccccgggctggcttgtcccttggctgccgctgcccaccccgccgcccgcagctagcctggcgcggggaacgggttgcatccaggggtttggggatgcccgagggcgctggtcagcctggccagcagtgtcgcccccagtaacccgaggatcctcggcgctgtgtgcgtctcaagctcaagtcaaaacttgtgtgtgtgtgtgtgtgtgtgtgtgtgtgtgtgtgtgtgtgtgtgtgtgtgtggtttattaggagagaggccgcctgtctttagcagaagtaaggaaggggtttgacgggagggaaagagccgctccagcgagaaggcgtgaccccgcagctccctcgtctcggctgcgggagccaggggtgccagggacaggcgagcgcaagcccaggtcgcaaggacgatgctggcactcgcgttcgagccaagggaggatgcagatccctcccaagtctgtggccagaagaggtcgtgcgggggtgaaggctgggagagctccagcttcttgcaagcatccgaagtgataagcctgagcatctgcacgatgagagcgagtgcggggaagcagagccaccgaagtgctggaaagaaaatgggccaaatgacccgggccagctggaggctgccacagttaccccaaacgtcacttcgtggcagaagccacaggtctagatagtagaccgtttggagaaaagagaaaagaaaaggaaaaaaaaaaaacccaaaacaaacaaacaaaacaaagcaaaacaaaaacaaaaccacatcagccaagttacaaatgtgttagggcatttggaaatgtagatgtggataaaataatattctttaccttgtacaagacctcatattttaaaagttacacttttatttctttataaactttggggaactacagattacaggaaaagttggcccaagtagatttccatagcatttggtttcatagaggatttggggcaatatatcctttattagggaatcaaacctcttcttttcataagttctgtattgtggagtctcatagcttcctccactctctgacacctgctagtgccacaaaagttaacagtattttcatcaccagcagcaatccctgttaacaggcattgggaggcaagcgttgaggctcagggtctttctccattaaatctgacagtgaattcttgtggaagttctttttaagtaatagatggaggccaggggtgtagggaaaagtgtaatggaccaggatggaagtcatctgtgctcattgtcctcaaagcacctggcctcgtgtagggtactcagacttcataggcctggtgtttcatggcagaattagaagccacacctgactgtcaatgaaacctccacccagctcctaaagttttggggttctgacacctttcttgaggaagggaaattctgggaggaggaaggagcaaaggtactactgaggataaaatcaagacatttcaacatatattgcattaacattttcactttatatttccaaacaatgaggcctaataaatttgggtggtcagttggtagaagggtgaattctcagcttctgctcaggaaactaggaagaactgaaagattgaatgctgctcctgttactagctgatcattatatttctgactgatgtgataggttcaaaatgacatcattgtgaactgaaaatagaatacccttggccaaatttgttccctgttacgtaaatataatgatttttgggaaaagtgggcttgtggtattttggatggtctaaaatatacctttaataatataaggccactgtgtctgcagaattactttcccctgttttcctccattcttttattttagtgtctgtcaaaacaaaacttgtggttagtaaacacatcctctcaatttcctcagccaattttggcagcaagtatttttcgtaaatgtaagttcatgtaaagtaaaaattttccaaatcaaaatatgtttatatcaaacacttttctttacagagtattatttcagtatacttatacaatattctatgtctgacacacaatggccactcaataaatattggttgaattaatgacccaacctgttgtatcaaacaggtagtgtgatatttaacgtactgaatattctcataggaaagccaagagacagtagcattcatagtaaaagctagtatttatcacgcatgtgccagtcagtgcatacacagggtgacattcaatctgcacagcaacactgtcggtaggttctattgttatttccattttctgtatggaaaaaatgagggcaaagagttatgaaggacacatagcaagcgaggcaggacttcaacccatgtctgtctgattgcaatacccattgcatagcactatgggcagtttaagggagaaaatggaaggacagccaagatgcaaatgggaatctaaagatcgggactggctaaaaacgatccatcacatttacatccataattccactttccttttcttgatacttgtactctgagtatcttgaggagccagcagagaagggaaataattcaagcagctggtttgctttaactctacctttccgtattaatccccactatgtggcctccatttatttagggaactagaccctccctgagctggacaacaactgggagtaatgttggtcggactcgcatcttccgggcgttttctctttctttagcagttgtgctatgtctaggctagtggttcccaatgtgggtccttggacctgccgcatcagcctcacctgggaatttgtcacaaatgtacatgctaaggtcttatcccaaagctgctgaagtctgggcacagggcccagcaatctgtgcgtcagcaagtcctctaggtgattccaacgcagagaatttgagaaccattgttgttgagcaacaacaaagtattgctttctggaggcttcccatgtatttgagagaaaggaggaatgtgaggcggggtgggtagatttataaagtatttaaaggtactttaatactttaaagtatttaaaaatgtgatttaaaaatgtacatggtttcagtttttaatttcaacttttaaaaatgcatcttgtttgctacttaagccccactgttttgagggaaggaccagccaacggcacccaccccagctggctttagaccttccaaggttaggagaggtgtgacgtgaggagtaggctgacgtggggcaaccggaaagcatagtgtggggaaggacgagaacagagccactgatgatgctttctcttccccataggagacagtggtgaacagtccttcttcctagtcaatttggggaaaggcagagtatgttctacttagagaatgttctgctgtaacacatttgaaaagagtaaaggaagtgatggggaggaaaatcatgcaaggataactgttatcttgatttcccaccctgagattgggtggagggggagcacaaacatacattggggtaaatagaaatatatagcaaatgctacacttaagcttggagaccatggtctttccaattcagtgaattttttttttttgaaatggcattcaaactttgttttgctatggaaaacaaacaaaaaatcaaataaaatctcccccagaaattaggttatgatgcagccttgctgccagtagccttattacttatgagctgtggaaatatcaaaaacttggaataagactcattgatataaacagaataagccagatggcttactactgatcttgtacaaccgacaaactctaatgatctatcatccagccttggatatgtgatttagactttatgggagctaaacttgttggactcattcccagctgatatgctttcctttccatttttaatttataccactttaaatggagatatagaactttagttctcagaattgccaatctttacgtatattatatatgagcctggcaatttagagtcaaaaaatgaaaagtatgtcatgttattgaatttgaaattctctaagtttaagtgcatttaaaggaaaatgtgaaaatagaggtccatatctgttacaaaatagtttctttgaacctaaaaagccaaattttatttttcttctgcatttcacacatggtataaatataatactttaggctccaaacagtaatctaggaaatgaatgcataaaatatgacgttatcaatagaaattgttgacatagaaaaaatgatattcttgttcatagctacaagtttatattgtggggttggttggggacacagtggcactatattagagaaaggatagaaaatggaattcagctatggtaatccgttctgtaaacaaatagcatgaatggtgaaaagcaatctgccttgtaaactattttttaatgtagactagtcttagtatgaattgtctaagaacacatataaatgtggattatctaaatactgtctttcttcaaattccctgtcatcaatccaggcttaagacagtggttagttttgttttggagaaactggaaagaaagtggtcaaggtttttgagtcccaaaataaatagtatcttttgcttcctcagagggagactgaaggagcaaaaacagtagcttgacctgcagctgtactggtgggtgtccatgatggacaatgaaaacgcatcttatttgatggattgtagctgctagaattattaggagttgctgctttttttttgttttttggaaagaagacttgaccacaaattaattttgtcataaatatatttatttgtattacatagaaactcggctttaagcaaacagtgatatacataaatccctttttatcagaaatagggacagaaacactaacatttcacaaaaattcttatttgcaaaagtcaatgtagcaactgttttgcaagagaattccaaataaagtacatttcagcatttgctattagtttttaaacagctttgttgagatataattcatataccatataattcacccatttaaagtttttaatagtttaatagcttttaatatattatagatatgtgtaaccattgccacaattttagattttcatcaccacaaggagaaacgccataccctttatccaacacttttgccccatcaaccccagtcctaagcaaccgctaatttactttctgtctgtatagatttgcctattcttggcattttatagaaatagaataatataatatgtggtcttttgtgattggcttcttttacttgacataatgttttcaaggttcattcatgttatagcatgtgtcagtacttcattcttttttatggctgaataatatttcctaagaattttttttattgcggaataaaatgttccataagactgtatggatattccacattttgtttatccattcacccattaatggacatttgggttgttttcaccttttgtctactgtaagtagtgctgctatgaacatttgtgttgcaagcttttgtttcaacacctgttttctgttcttatgggtatatacctaggagtgggattgctgaatcatatggtaactctaagtttaagttattgaggaactgccaagctgtttctacagtggctgcaccattttacatcccccgccaagaaagtatgagaattccaatttcttcacatcctcactgccatttcttattttccatttttttattatagccatcttaatgggtatgaagtggtatattcattggcgttgtgttttgcattaatgatgtcgagtatcttttcatgtgcttgttgactgtttgtatatcttctttggaaaaatgtctattcacattttgctgattttttttttttttttgagattggaggctcgctctgttgcccaggctggagtgcagtggcgcgatctcagctcactgcaagctctgcctcccaggtacacgccattctcctgcctcagcctcccaagtagctgggactacaggcggccgccaccatgcctggctaatttttttgtattttttagtagagatggggtttcactgtgttagccaggatggtctcgatctcctgacctcgtgattcgcccgcctcggcctcccaaagtgctgggattacaggcatgagccaccgcgcccggccactgattttctttaaaaaatttatttccataggttttaggggaacaggtggtatttggttacgtgagtaagttctttagtggtgatttgtgagatttttgtgcactcgtcacccaaggagtatacacagaactcaatttctggtcttttgtccctcacccccttcccaccctttctccctgagtccccaaagtccattgtgtcattcttatgcctttacatcctcatagcttagctcccacttatgagtgagaacatatgatgttgagttttccattcctgagttacctcagttgcctatttttgaattgggttgtttgtatttgtgttgttgagttgtaaacattatttatatattcttaacagtagacccttttcagatatatgatcttgctattaatttgggggttgggaaatatgatactgacttaaatacaatactgttatgtattgttcactatattataggtgttcaccttatcaaggagcaagaaattagttttatatgtaaatgagttttaaagtgttaagtacggtacctgggtatatagtaaaacctaaataaactctaaagatggattgaaaacaaggatctgttctaaagaatcctgggggtcttgttttacagttatggattactttgaatattaaacactttacatttatctctaaggtatgataattcatggatagttaacacttaacctattttagagatgtcacaaagattgctgtgacttgtatgtggaatatgaatttagctaatttttgaacagcagattatagtacaatggttatattttgtctttatatttgctcactagaatggagccgatgagctcagcaggagaaaacatttgggtttattatgttccttatacaatatatgaagcaaccaaggaaatcttaagcattctcatgaaattggaattcatatgcaatttattttgtattcatgttgtggtataatatgaaggacaaatatataggaacagtatttgctacgtatgtttctcttgagtaaaataacttatgagttttaagaagaaatattgtttttacaaaaatgacagaaaattttagtaggtttcaaaaatatatataatcaaaataagaagctctaaaataactgcagtcaattagatgctgcttggcctcagtttgaataattggcaacactctctgaaatggtctgcctctatgtctctacccaaatctcatcttgaattgtagttcccataatccccacatgttgtgggaggaaccctgtgggaggtaattgaatcatgggggcggttaacccccatgctgttcttgtgatagtgagttctcatgagatctgatggtttcttttttttttctttttttttttaatacacattccccaaaactggattactggggtccagtattccaattatgagcatttttaatttattaaattttgttaaatattttagatcaaaatgttgaagtaatttacacataattcacatttcctgccacctccacagagctagatgtcatctctatagttctggtaatcatccaggtgaaaaatggtaatattttttaattatactttaagttctagggtacatgtgcacaacgtgcaggtttgttacatacgtatacatgtgccatcttggtgtgctgcacccattaactcgtcatttacattaggtatatctcctaatgctatccctcccccctccccccaccccacgacaggccccggtgtgtgatgttccccttcctgtgtccaagtgttctcattgttcaattcccacctatgagtgagaacatgcggtgtttggttttttgtccttgtgatagtttgctgagaataatggtttccagcttcatccatgtccctacaaaggacatgagctcatccttttttatggctgcaaagatctgatggtttcataaggggcttttcccctttgctcagcacttctctctcctgccaccatgagaagaaggatgtgtttgcatccccttctgccatcattgtaagtttcttgaggcatacccagccatgtggaactgtgagtcaattaaacctctttcctttaaaaatcacccactctcaggtatgtccttatagcagcatgagaacggactaatacactgtcattcaaaattaccagggaaccagatatagctgcttagtcttgaagctacgccatacctcttggtctgtctcagggtttatattgattgtctataatttccccaaaactgccactgattcatttttgttgtctcgctgcctgcttagacttctgctaatgtctttgtactgattgtttaggaaggtacaattccaattaggatctctaaactcctgtaagtatttgtttatttcatgatctcttatgaagttttgacattctaccttgtattgtgatcatctgtgagcaagcaccttgaagggaggaagcttattcagtgcttcgcatccctgctctgacatctcttctgggtgctccacacaggccctcaggaagtggctgttgattcagtatatttgctgagcaactgttcttcactaggattccaaatcctgctttgtttggtctctatttagagaatatggggagggatgccaagaaggactctagctcagttgatgcctttagcctatttctttcttgctctttgaagctgatgctccaagcaaatacattacaaccacttatgacatatgagtacatatagttttgtttagaggtggttgcccattctagagtgtagtggtgccatcagagctcactgcagcctcaacctcctgggctcaagccatcctcccacctcagcttcttgagaagctgggactacaggcacaagccatcatacctggtaacacaaacatttccttctgtgcacagagataactgtccacttcttacctttgggcatttggaattacacttttagagctctctctgtaattaagaatagctgagatcagtttagagatttgtgtgcatacagttagaatgcaaacttcttgttacttgtcattttctgaaatcctagaccagttgttttggaagtttgcagaatagctgttatttctgtaggttagtgtcttctttaggtagcaatttgtgttaaattagccagtatgtttcaagcatgactttaagtcatgaaggagatgagaccgtggaatgatgtgatttttgaaatagggactgaacagagtttaacctagaactgcaacacgaccatactgtaaaattaggtctcaatccaccaacccatttacacttgtttggtgaaagatactataataaccttaagtcatggctttgattaggcaattcttagttaattcattaatagatgatttaaataacctattacctttaactgtactgcatttctggaaacaccattgctgttttttagttcaaggagtacaattttcataatcttgatgaaagaaaaatgagaatattctgagacatatgaattcctttgttcagtcattcaacaaatattcatggaaggccttctttggggcagaagcatcaggcagtaggaaggatataggttttggagcagagctccgggtgtgaagcactgtgttaccatttattagctgggacagcttgaataattttattaacttctctgaacctctgatgttttgatgtatacaataggattaataattgctgttttacaggatacttctctaacccaaggcctgacatttaagttcaacaattgccaattttctcagcttgttctttgcttccctttaactccctcttcatttagcacacatacacatatgagtgtacacacacactcatatcagaacacagctgggggagtatacagattcactgataacctgacttccaattgaaagaagcaatcaaacctagaaatacacaattacttcactagtatttggcaagggctcttcaacacctgacaagttccggtaattcatccatcccactaattacatatatgtaccccttcctgcttcttctcttctgcttcctggagatagtctttaaatgacacattttttgcacag

SEQ ID NO: 332 - DNA, 24264 bp, Homo sapiens
ctaaggtaattttaaaagggaaattggctgctctctgacacttatcatcagaggaaaaatcacaatatgaaatgctgttagataggctgggagtggtggctcacgcctataatccagcactttgggaggctgaggcaggaggatcacttgaggccagaagttcaagaccagtctgggcaacatagtgagactctgtctctacaattttttgttttttaaatttaattagccaagtgtggtggtgcatgcctgtagtcctagctactccagaggctgaggtgggaggattgcttgagcccaggagtttgaggctgcagttgagctatgattcataccactgcactccaacttgaagagcctgaaaaaaaaaaaaaagtgctgtagacataaaggacatgactaagtaggttagaatatagtaagcgggccaggcgccgtggctcatgcctgtaatcccagtactctgggaggccgaggtgggcagattgcttaagctcaggagttcgagaccaacctgggcaacatgatgagacccccatctctacaaaagtacaaaaagttagccaggtgtggtggcacgcacctgtggtcctagctactcgggaggctgagctgggaggatctcttgagcctgggtggcagaggttgcagtgagccaagatcccaccactacactccagcctgggcgacagagtgagatgccatttcagaacaaaaacaaaaacaaaaaaagaatagagtaagtgaatgaaaagttgtgcatccattacacttttatttatttatttatttatttatttttgagacagggtctcttgctccatcatacaggctggagtgtagtggcaaaatcacagcttactgcagctttgaactcctgggctcaagcaatcttccagcctcagagtccagagtagctaggctttcaggtacatggcaccagacctggctaatttttttgtttgtttgtttgttttccttgagacggagtctcactctgtcacccaggctggagtgcagtggcgccatctcagctcactgcaagctctgcctcccaggttcacgccattctcccatctcagcctcccaagtagctgggactacaggcgcctgccaccacgcccagctaattttgtttttgtatttttagtagagatggggtttcaccatgttagccaggatggtctccatctcttgacctcatgatccgcccgcctcagcctcccaaagtgctgggattacaggcgtgagccaccgcgcctggccgacctggctaatttttaaatatttttgtgtaaagatagggtctcactatgttgcccaggctagtcttgaactccaggactcaggtgactctcccatcttgggtccattaagcttttaactacaaactacactgaaatatgaaagttattcagaatgaaatgaataagaatgcaaaattataatcataccgtaagaatactttctgagtaatcccagcactttgggaggccgagacgggtgagtcacctgaggtcgggagttccagaccagcctggccaacatggagaaaccccatctctactgaaaataacaacaacaaaaaaaattagctgggcgttgtggagggcaccagtaatcccagcgactcaggaggctgaggcaggagaatcgcttgaacccaggaggcacaggttgcagtgagccgagattgagccattgcactccagcctgggggacgggagtgaaactccgtatcaaaaaaaaaaaaaaatgaatactttctgaaagtatttattcatacaaataaagacttgacccgtgaggtaggaacacaaatgggccacggaatcactcattccacagaatataccgagtgcccttgaagtgctgggcactgctccaggattgggggcgtattggtgaaagagaagcaagctgcctgctcagatggcagggaatgggggaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacacagctgttgccacactcagtggaactgaatctatgtttgtcttccccggcatccttcaccccaactctccccgccacaacatacatcccatgccagcctggggaccctcaaaggtggcttcatcattaggtttgtggctgggtcccactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcggacccccactcccggctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccaggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaacggagaaaggccctgacagccacggtctgtgtgaggctcctgagatctcatgtacagaaagtgcttggcgtggagctgggcatgcagcaggggctgggcacacggtggcccaaaggagccctgggccttcactgatgggctgtgtggccactgacacacctaggcctcctcacctgtaagacagacaccattgtgccatcccatgttctcacccagaggctccttttctcttccagtgggaggccaagagcatttcgctcacttgctgatcctcagggacaccaagacctacatgcttgcttttgacgtgaacgatgagaagaactgggggctgtctgtctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccactcatttttaatacccgtgcagtggggaattgatactgtggttttcaatgtcacccacactgcagcacggccacagtcaccatcccgatttttgctacaaatgaaaattactttataatgagctccttaacacttttctttaaacctgtgtttggaagacttgcgttggtgtggccctgtgcccaatacctgtgaaatcacagcaccgatgagctggttccaatttttaaaatatatacatgcagtacttccatgactattcaaagaaaaacaattccttccatttgccatctgagatgaccaccagtggtgtgaactacctcctgcccccatctgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccctggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagttcaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggacgtgtcctcagggtgctcacctgggagacccagaagaaggagacaacacgtaagggtgaggctggtccctggaaatcagttgacatcttgcaaatgtggagccctgaggtggagccaagcccgaggcacagcccactcagtggcacaagccacgaagggccggcctcacccagacctgggggctcatgattgacagcctcttgttacgtgagggaagcagcactcctcccgtggcagaaaagttgggcctgagttgttccatctattccgtatgtgcagctgcgtacaccatacagggtgataagaccatgagcctgaggctctgacaccccagggtccagtcctgtgtcctcaggcaccactcccctttgtacctcctgtcccaacagccaagctccacagggccaagactacagcatcctttgctcagcacccaaaccactgctgtgcccacagcacggaggctggggacaccgagctgatgtcctcagaaggcaagtggacaggacagcctctggggtcccacagtggcctggaactgaaggctcagaacctaaaagaagtttccccatttcaatgttactttcagtaagacaccattttcaaccatactgaggaggatccgctgaaaaatgaaacagaaatgagtcgtgatgggcagggcagggagaagcaagggagacgagaagtggggaacatggaaggaaaagccacgtgaggaagaaaccagaggtcaagagaaaaagaatcatggaggtagaggaagcaaaaaacacacataacaaagaatgtggactttggagtcaaactaatgtgagtccaaacccaggctctctcccaaaccagtttgggcagatggcccagtggaacctcactctcctcatcagtaaaaagggggcagagtgagggtcctgagagctagtacagggactgtgtgaagtagacaatgcccagtgtttagcgtaagaatcagggtccagctggtgctccctaaacagcagctgctgttcactgttgaaaggcgctctggaaggccaggcgcggtggctcatgcttgtaatcccagcactgtgggaggccgaggtgggcggatcacctgaggtagggagttcgagaccagcctgaccaacgtggagaaaccccatctctcctaaaaatacaaaattagccaggcgtggtagcacatacctgtaatcccagcgactcgggaggctgaggcaagagaattgcttgaaaccagcaggggaggttgtggtgagccaagatcgagccattgcactccagcctgggcaacaagagcaaaatggcgaaactccatctccgagaaaaaaaaaaaaaagaatactttctgaaagtatttattcatacaaataaagacttgacccataaggtaggaacgcaaatgggccacggaatcactcattccacagtatacaccgagtgcccttgaagtgctgggcactgctccaggattgggggcatattggtgaaagagaagcaagctgcctgctcagatggcagggaatggggaaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggttggctttaatctccaccagactcttgccccgggactgtgatgggcgattggccacttctcctcgataacattactgtttttcttccgccttctggttgactttagccagaaccagtgcttctataactccagttacctgaatgtccagcgggagaatgggaccgtctccagatacggtgagggccagccctcaggcaggagggttcaccgtgggaacagggcaggccagcataaggtgggggctggatgtagagccctggaggctttgggcacagagaaataaccactaacatttttgagctcttaccacgtgctcagaaaaaatccctaagaagacactgagagaattagatgaggaaacataagaacagagacctcaaatagtttccccaaggtcacacagcttataattagaactagaattggaactccaggctggcttcagatctgcctctctctcacgccctctttaagatcctttgcaaaccaatggtagaagcctgtatgttggagaggtggtaccttcaactatgtcccccatcaccgcagaggtggcacatggcagggatctgatggagctgaactgacatcatttagcatcccgagcctcctctctgggcctcattttcctcctctgtaaaacggggagaaaggccctgacagccacagtctgtgtgaggctcctgagatctcatgtacagaaagtgcttggcgtggagctgggcacgcagcaggggctgggcacacggtggcccaaaggagacccgggccttcactgatgggctttgtggccccggacacacctaggactcctcacctgtaagacaggcaccattgtgccatcccatgttctcacccagaggctctttttctcttccagagggaggccgagaacatgttgctcacctgctgttccttagggacaccaagaccttgatgtttggttcctacctggacgatgagaagaactgggggctgtctttctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgtgcattcccaggtcagatgtcatgtacaccgactggaaaaaggtaaacgcaagggattggacagtgcccaccttgtccatggcccaacttgggcagccccagaggcccagagcaggaaagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccgctcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagtttaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggatgtgttcttagggtgctcacctgggagacccagaagaaggagataacacgtaagggtgaggctggtccctggaaatcagctgacatcctgcaaatgtggagccctgaggtggagccaagcccgaggcacagcccactcagtggcacaagccacaaagggccggcctcaccccaacctgggtgctcgtgattgacagcctcttgttacgtgagggaagcagcaccccttccgtggcagaaaagttgggcctgaattgtttgagcaattccacgtgtgcagctgcgtataccatccagggtgataggaccatgagcccgaggccctgatgtcctggggtctagtcctgtgtccacaggcaccactcccctttgtacctcctgtcccaacagccaagctccacagggccaagactacagcatcctttgctcagcacccaaaccacagctgtgcccacagcacggaggctggggacaccgagctgatgtcctcagaaggcaagtggacaggacagcctctggggtcccacaatgtcctggaactgaaggctcagaacctacaggaagtttgtccatttcagtgttactttcagtgagacaccattttcaaccatactcaggaggatccgctgaaaaatgaaacagaaatgagtcatgatgggcagagcagggagaagcaagggagacgagaagtggggaacatggaagaaaaagccacgtgaggaagaaaccagaggtcaagagaaaaagaatcatggaggtagaggaagcaaaaaacacacataacaaagaatgtggactttgggtcagaccaatgtgagtttaaatccaggttctctcccaaaccagtttgggcagatggcccattggaaccccactctcctcatcagtaaaaggggggcagagtgagggtcctgagggttagcacatggactgtgtgaagcagacaatgcccagtgcttagcaccggaatcagggtctagcaggtgctccctaaatggcaggtgctgtttgctactgaaagtactggaaggctgggcgccatggctcacgcctgtaatcccagcaatttgggaggctgaggtgggtggatcacctgaggctgggagtgcaagatcagcccgaccaacatggagaaaccctgtctctactaaaaatacaaaattagccagacgtggtggtgcatgcctgtaatcccagctactcgggaggctgaggcaagagaatcacttgaacccgggaggcggaggttgcagtgagccgagattccaccactgtaccccagcctgggcaaccagagcaaaactcagtctcaaaaaaaaaaaaaaaaagaaaaagaaaaaagaaaaaaaaaagaaagaaaggagcactggagagtccaggtgcatactcttgtagacagcaacttgctgtgtgcctcatttacatctctggcctcagtcaaaagggacttggctaggcagccccacctcaaggccctccgcagttgaaagatttatggttctgagataggcaaagggggaaaactggagaaacagaagccaccagagggaggcaggcagagcacccaacaggtcccctgggaaagggcttggctgggcatcaaacctaccaccccataaacttgacattgaaggcaaaagttaatgacatacagcagagacacggatggctttgggtattttttttgtcttcttttctttttttaagatcaatattcattcttcatttgccctcgtaacgaaaatagatttttaaatgcctcaaatatacaaacatcattgatgcacacacattccagaaatgcagaggtatgctgctgccacggggtaggggtgcgggaggcggcctggcctcatggccgcagaccgtgccccagcccgggcctggcaggtagctggccactgataaacgccactgggatcctaggagaagctggggaccatgcgtgaggtactgaaggggaccatggtggatggcatcctgggcactttgtagcttgtctgagggaaaggcctctgctgccatagaaaagctggacacatgtcaccctggggccctgacatcctaaaatgccccactgactaccagtcactaggagaaaggtctccggctatgcccttcccagtgatgcttgccccagagtgactggtcacaggtgggggacaggtttgctccagaaaccgtaggcctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggaggcctcgctcacagcacctctgtgaggggactggtgctcctgggaagtcacttctcttggtgaccgagctgacaccccctccacttggaaagcacagggactgagcaggcgggacctgtgctggagggagaccctcctggtgaggaactatgcgggccttctgggcctcagcagctccagcccactcctggcctggcaggccacctgcccacccacccacccatctgcctctgggcccccagtgaagtcagaagaggcaggagccccgcaggctgtgagcctggcgcaggtcggctgacagcgagcttctcatctgcctggtggtagagcggacgctctcggcagcctgcacggcccggctcagggccttgttgagctcctctaggtcgcccaggtcgagctggatggagtgccggtgtctccgggctggtgggggagaggctgtgggcggccacttggcagctggttgggctgaggtaggtcctgcaggcgcatagtacctgaggagagaagtgagtgggctcgttacacatggggagggctggggacaagccgaggagcaccgtgtgtggggtcaacccccttctaaatcccagctgggccagtggctcctactctctgggtctcagtttctttacctctaaaatgggaataatgggcacacatccagggatttcttagaaagatgaaggaagataacaacatgagtgcctgacccagaacaggtgttcaaggacaggaagttcaatctacctgttcatctgatttactgcccatctagtacatgccagccagcgtgccaggctctggggttacagtgggacaagaaaacatggactcctgcaatcttcttggagccggatcttggggaggccaggatcaccctaggcttgatagcaaaaccccctcatggaagaatatctgggggttccatttgccaagcaaggggtgctggagaaaggcaataattaataattaataatagtaataataataataatagggattctgcaggagtgggagggtctggccccatgtcctgggaagtgggtagaagagcatccttcctagcccagtcctataggaatgtgaggtgttgttttaaagtgctgtgggaatgggctgacaagcccattgagatgaagcacggatttccctaagaggtgacaatggcatccatcagggccactaagtttagggttcaaggaaaccagcagtgggcaagagggggtgtggcctcagcactgttaaataaagggtgtgtgtggtggaggagggagataaagaagcatggacctaaatcaggaataagtttaggaggacgcagcagagtcattcattggcatcttgcttggcacactgtaaactctggctttattcctgagcccctgctgtctaacttgcattgttatacagtgtgtagaaacagatgatccaaacagacatttctccaaaggagctattcaaatggacaatacgtacatgaaaagatgcatatccttagccatcaggaaatgcaaagtgaaaccactgcacaccctctaacatcaaaaaggacagatagcaacaagtgttgacaagaatgtggagaaactggaatcctcagcactgctggtgggaatgtaaatggtggagccactgtggaaaacagtctgacagttcctccaacagttaaacccagtgcctagcccagggctggcatcctcatctttggtacccatgtaccagttggtgcctttatctttattttacagatgagcaaagcggagctcagagaagctaagtgattcaggaggcagtagaatgcaccagccttagcagctcaggccctggagccctgccccaaatcccagtcattctgctgggctactcatgggactctggacaagctaagtcactttgcaaggcctctgttttcccacctaaaacgaccacagttagcaacctctcagcttagagctgatggaaaattcaggtaaaaagctggcactgcctggctccggtaagtgctccataaacgtgagctcctaagacccagagtcagacagctggaaggggcagccatgggttcacacctgggcccgactctccccacatatctaatgtgtgctaattggcaagcagcagatgctgataaaataatctgaactgtatgaacgggcttcttgcatccccaaaacagcagcctgcactccctcctctagggaccgtctggtgtaagtaactacagaggctcctcaaattacgatggggttatgcccctataaacccgctgtaaagtcgaaaaatcataaatcgaaccattgtaaaagtagggactgtctgggctgggttttcatacacccccaccttctgttaatttgatgaccaacttggcctgaaagttacccaaaactctccctagggccaacactgaaaaagtccctctgggctggaaagtctcggctgcaggggctatgggacggctgcccagcagggggcagcacaggcccactccgctttccaaactacactggtctcaaccactgggcccgttcagtcctgctgaccagcagctggagaaatttcagggtgtcaccagcgcaaattctagcagcattagaagcaccatcattattggcaacttctatgtactatgggctttccatgcattaattcattcaatcctcagcacaacccatttcgcagagaaggaaactgaggcataggtataacccgcccatcctgagttggaaacagcaacctggtgagttctgcccacaggcctgagcctggaagaatgtgaaatggggcctcaggagaagtaaagactccatggctaccgtggggtcaccaaattctgggcaaaacctttcccgatcaatgagttggaacactggcaggcgctttcccccgtgtctgctggaggtctgagcatgcagcattggttctcatctctgctggagtggaagattccttagcgacttgcttagactcagctgagagggcagcaagaaagcaaatttacataccgggcgcggtggctacaccttgtaatgccagtgctttgggaggccaatgcgggcagatcacctgaggccaggaggtcaagaccagcctggccaacatggcgaaacccatctctaccaaaaataccaaaaaaattagccgggtgtggtggcacactattgtattcccagctacttgagaggaggaggcatgagaatagcttgaatcttggagatgggggttgcagtgagccaagatggcgccactgcactccagcctgggcgacaaagccagaccctgtctcagaaaacacatatacataaaaaatttttaaaagcacatttataggcctggtccccgaatagaggaccagggctggatggcgccttgggtccctgctccaccaagcaccagccctcacagtgacgcaggccctcactgcctacacacccaggcttctggcaacacagccactgaagacatccagtcccaatcgactcatttcacagcaggggaagcaggcagagaagtagctgctgacagctgagacaagaagacaggtttcctacttctggggactgggcttttgtccctgcacaatcctatcatgttgaacccacttttactccttcttcttcctactagtgacaacactgagcaatagcaacattctctgtgatggcgaagctactgtttgctcagcaatgagcacgtgaccaaatggcaccacaaactccacacacttctcatttggttcctgccacgtgccacacttaatcctcacgcacaggattaagtacgtggttgagactcttcctccatttaacagatggggaagtggaggctctgagaggaagttagtttgccaaggccacagtgctactagggggcagatgggactccacggtagctctggccaactccaaacccaagccacttctgtctcggctgccctgcctctcctggcttgactgatgttacgtccagaatctgtgcaaaaagtcctacaatattcccgaccaggactccccagagatgtccaggtcatcaaaaacaaggaaggtctgaggatctgtcacagccgagggggcgtaaggaggcatggcaatcgcataccacatgggatcgtggatgggatcctggaacagagacaggactttggaggaaaacggcctgaaggaactacgaacttcagttaccaataatgtatggatattgcttcactaacgtggccaatgtgccacattattgtaagatattaataataggggaaactgtttgtgcaggagtgaggaggattgtgggaatctctctggactatctgctcaatttccctataaatctaaaactgtcctaaaaaataaagtctattaaaaaaaacccagtgctcatcacttacttgcggagaaaacccataaggaaaatggaagatggttaggattctcagtctccacaaagttataagctcccagagggcagggccctcttgctagtccccttcactgctgggtcccagggccgagcactctccttggtacatgggtttgttgagtgcctatatgagtgttggctttgttgagtgactatatgagtgttgggctcctactgcatgttatccacgcagggataaaacacaggaggagtatactgcatctcagctgccccacccaggtctgaatgctaacatattcagtgatctatagaaagaggctgggaaggtcagaatgaaggctcttacacagcggcaggtggataaggcatgatgggaaccgaggagatgtaggcaaaggctggaggggctggtgctgggggcgctgttgccagataccacagtccggggggtgggcgtggcgacgaccccgcctgcttgctcctctgcttggggctgggagttgaagatgcttttctcctcgtggtggccttctctgcccctatcagggagggaacagcacagagagacagagtctgaccacttggcagatccagccaaagatggagggtccacccagcccttcccctatgagagctggacaggccctaccctgtgagactccatgtcggggaggtctctctttggggaacaaatcctctgccccagttgctctgtcccagactggaacaacagctgctccagttaaactcacccaggtctaataaccctggtcaaggagagctgagggtctggctaagagaagaaacagtatttgtccctaccagaggtggctgagcctggaccatctgcctctgggggagacccaacttgaccacacaggggacactgaagggtatcagcgggaggcggtcccagtgggtcccctgtgacagcaccacctagaagaggaggaagagatgtcaggggaggattacatctaaatcatcagatcaggagcccccatgcaggccttctgcagcactgagctctcctcgggacccactgcggaggggacaagctgcctccatctgggtgatgacattgacaacaaccatgacagtgagagcaagcatttagtgagccaggccctctgctaagggccttcctgcattattttatcaaatccaacaagccactgggctagccactgtcctcactcccccactttacagatggggaaattaagggtccaagacgtcaagtaatttgccaagggtctcagagctgggaagcagtggtccttggatcctaagcccgggctctcccaaatgcagcccaaccccccgccccaaccacagtgagacagagccattctccatgtgggagtggcccagaacagtcccctggggaaccaggggggtcagtagaggcaaaagggaacaggaggagagtgggtgccattgttctcttcccacatacatccccaatgccacacctgggtgagttccagggctggtctgtttctctttcaggccttggctcaaccaccactccctctgggaagccctcccacccaccccggcagagtcaggcaccccccagccccactcgtgctcccctaccccagctttggccactctgctttgttgtgtgttccttggggacggggcccagggccccataggggtaagtgatgaatgaatgaatgaatgaatgaatgcatgcaggcatgaacggagaggcctgtcaggactctaacactagcacaggaagagcatagtggtgaaaaggtgggactctggagtcacaaagacctgggttcaaatcctgcttctaccacttgtaagctgtgtgcccttgggcaagttacttaatctctctgagccttggtgtccttgtctataaaatggacgtaatagtactgcagtacttagttcatagaactgtgaggattaatttatgcaaaacccttaacatgacaccctctacagagagggacttaataaatggcagctcattatcatcagtcattatcatcactattgcttgaaaagtcctagagaccatctcttccaatcctttcattatagatgtggtgactgaggtacagagaagtcaaggaactggcctaaggtcacacagcaagtcagtggcagaactgggactagaacccattgcctggattatcgggccactgctctctctgccactcctgtggacttgggggaaagtatgaggggtgaagggaggatggaggggagaataagacataatcactgatgccaggtcccctgctgcctggaggccacctatcaggacccttcaggaacttcttaaatcaaggagggtggcttcaggcagcagcacctgaagcaacagatgtgacggcaggacacccagaaaaatcctcttccctggtctgtccctataacccactgctaagttcagggcaggccagatcttgtcaagtacacactcccctgagggcaagaagctgcagccacagctgcctgggccagttttccaggtgccattccttacccgcatcctgggtcctaatgggccggcagtggggacaggagactgtgccattgccttttgggaccgccttaggggacagaacatggtattcgtggcctggggaaagaaaccagaactgtcagtatcagccctgtggatggatgcaaaatagaggaagattctggaataatgatctcctcttcctccaaatggttttaatagtctctgtctctctctcacgtgtgcacacggtgagtgtgcatacacacatcatgtgtaaaatatgtacatatttaagtatgacacacatacacacatatacgtcaccgaacatctttgtgtctgtttattgtaagctttctccagactcctattctgtttcatctcagatcctagaaccagctgacatccagtagcaaccaacacacccaggctaagtcaggatttgaaagcaggccaggaagaaatgataagcaaagcaacaataagaaatgaacaagtgatgctattccccacaccccgacttgctggtttggttctgaatggctcgggcacagggtcagtggtgttttctccccatgctctgagcggctgtaacatggggataaacatagcgcccatttcacaggcttgttgggagaactgaacggggccgtatccgtgtcgtgctccgcccagtgcctggcagatggaaagcagttgatgttatgagaaagctgggcggactgtggcctcctcacccagccccaccacctcctgccttacccacccctgagtttcaaataaggccttctgggtgacacctgaagccactgtggagcggtctcatcatctcatttccctcctgtgctgttctggctttgtgtatgtggagctgaacgtaattgctcttattttcccgacgcgacagatgaggaatctgagggtcagagaggctcagagccattttctgtgagactgacttcagagtctttggttttgacttctatactctcttcctctcattgtgttggaagcatttctccaggttaagctcactattaagggttaagatcacctttaaaggctaca

SEQ ID NO: 333 - DNA, 27335 bp, Homo sapiens
aatccatattatagttaaatatttatttggagtttactgtggactaggtattttacatcatagtaagcaaagtttcccaaatttaagttctttttatttctcattcatgacttttggcctgttctcatactacctattcattgtaacttttaaacttgaaagtctctttcaaaataaatgaatttatacttttaccataaatggaaatctagtaccatttttatgaatagaagatattatgaaggaatacaataaaaacaattttataagtctgggcatggtggctcacacctgtaacctcagcacttttgggggcctaggtgggaggatcacttgagcccaggagttcaagaccagtctggacagtatagggagacccccatctctataaaaaataaaaataaaaaaatcagctggccatggtggtgcatgcctgtggtctcagctaatctggtggctgaggtgggaggattgtttgagcctgggatgtcttgattcataaacacatgaagatgactaaaatctccttttaaatttgtttatactgctttttcttctatggctttctttttttcatagatcatgtcaatataaacacatactgagaaccaggagtttgagtgattctatatgaatgactgtatactatttaaattttgatgaactacagagtagtttgagcctaggaggttgaggctgcagtgagccatgattgcactatggcaacccagccaggatgacagggtgaaaccctttctcaaaaaaaaagttatgaaaaatatggtttcctgccaaactcataattactcctttattaaaaagggcaattagccctttttatgcaaggtgcttaaaaataaactagcacctcatttagatactctccttacgtaaataaaaaagattgaagaggagttgaaaaaagatttttttcctatgtgattgtttacttcagtatttgtatgtcatctaaaatggtgatataggacctgcattaaagtgttccacctgtattagtttgttaggcaatttatttaatcagaaaaaataaaataaatttacaatttaaaaatattttggaatttacacctgccacaaaatgagacagtttcttcgttcagatttcttactcatgagcaggcatcaattggttggaatcagagaggtttcttacctttaagttacaattgctttcctttgagttgctgtcacaaatctactgtcccccaagtagtttaccttatttcaaccataaatcatacaaaaatttacctatgaaaatttggatattattgtagataatactgtagaatttgctatggtttaaatttttaagagctttgaggtgcataaaaatacatctaagtgtacattgatttttagtaaatttatagtgttgtgcatccataatcacagtctagttttagaacatttatatcagccttaaaaagtactatgcccatttgtcatcaacctcttctcccattccagccttagaaaaccttggcctactttttgtccatttgatttagctttcctagaattttcatatcattggaatcatatggtatatggtcatttgtgtttggtttttatttagcataatgtttttgaggtgcatccaggtcataatatttcttttttcaaaatgtgtgtaaactaagggatacaagtgcagtttttttacagggacatattgcacagtggtaaagtctgggcttttagtgtaatcatcagctaaagaatgtgcattgtacacataagtaacttcttatcctttatccccttctcatccttctgagtctggtatctgttattccacactctatgtccatgtggtagtattcctttttgttgctgaatatttttccattatttgcatatgccgcatttctatctccattcaccagttgacaggtatttgagtcattgtgaataatactctcattttgaatgattgtgagtaatactgctgtaaacatttgtatacatgtctgtgtgtggataaatgttactcttctagagagatacctaggagtgcaactactaagtcatatggcaagtttaacttattggtaaagtgcaaaactttgttccaaagtgactgtagcattttacaaccccaccaataatgtatggaagtttctgtttctccacacccgttctagagggtttgtagtggtgtcttatttgtggctttaatttggtgtttttctaatgactaaaaaatgtttggcatgatttcatttgcttattagctatttatatatcttattccatttatatatcttattagccatttcgctatacctatgtagttaattatctattcaaatcctttgtccatttaaaaaaaaaacagtgatctgatcttgggtcactgcagccttgaactcttgggctcaagtgatccttccaccccagcctccctagtagctgggactacagatgcccaacagcatgcctcacttatttaaaaattttgtagagacagggtctccataagttgcccaggctggtcttaaactcccatcgtcaggctatcctccgaaagtgttggaattacaagtattagccatgatgcccagaccatttttgtttaagtggaatatttctcttattattcagttgtaagagttctttatatgtcttgatacaaattatttagcagatatatacttcgcaaagttctgcagcattaagtacattcacattatcatgtaaccattaccaccatcagtatccagaactttcattttcattttcccaaactgaagcttcgtaccctgtaaatggtaattcctggttttctcatcccatcagtccctggaaactactattgtattttctgtctttatgaatttgatttgtgtgggtacctcagacaagtggaaccacacactatttgtctttttgtgattgacttattgcactcagcatgtcttaagttttatccatgctgtagcatgtaccaaaatttccttccttcttaaggctgaatgatactccattgtatatgtacatactgcattttgttttattcattcatctgttgatggacacatgggctgcttttacctcttggatattgtgaataatgctgctgtgaacatgggtagacaaatatccagatccctgctttacttcttttgggtacatacccagaagtggacctgctgtttcatttggttattctataggttttttttttttttgagaaattttgcttttttttttaatgttaagaaattgccacatactgtgtttccacagtgtacatcattttacattcttaccagcaatacagtggttccagtttcttcacatccttgctagtacttgttttctgttgttttgatgattgccattccattgggtccaatgtggtatgtcatggttttggtttgcattttcctaatggttattaatgtcgagcatcttttatgtacttgtaagtcatgtgtatgccttctttgaaagtgtccgttgaagttctttgcccattgtttttcttgggttattttttgttgagttgtaacgcttcatgtattctgggtataatcctttatcagatatgtggtttctaatacagttatgctccatgtaatggcagtttgagatgttcctgtcaacagactgcattatatgatggtggccctataaaattctaatggagctgaaaaattcttcttgcctagtgacaatagaaattttatatagtgtaatgcattactttttctatgtttagaagtatttagatatagaaatatttaccattatggcacaattgcttatgtattcagtatagtaatatgctatataggcttgtatcctaggagcaatagggtataccttatagccaaggtgtgtagtaggccataacgtctaggtttgtgttaagtacccactgtgatgttcacatgatgacaaaattgcctagtgatgcatttcttggaacttatcccctcttgttaaagtgacacgtgactgtattttcttctgtttcaagggttacatttttactctctttgtagtagccattgatgcacagcattttcaattttgatgaagtctgtcttacctatttttttttgttgcctgtgctttcagtatcatatccaagaaattgttttcaaatccaaagtcatgaagtttttggcttgtgttttcttctaagagttttatagggtgaggtcttctgtttagagttttgatcactttgagacaatttttgtatatagtataagataagggtccagctttatttttttacatgtggatatccagttttcccagcactgtttgttgaaaagactttctttccttttcccctttgaatggtctaggtagccttgtggaaaataatttgactatttatgcaagagtgtatttctggactctgtgttttattctgttggtctatatgtgtatccttgtgccagtacgacagtattttgattgctgtagtcttctagtaagttttgatgtcaggaaatgtgagacgtccaactttgttattttcaagtttgttttgtctattcgaggtctcttgggaatccatatgaattttaggatggatttttctgtttctgctaaaaatgctgttaggattttgaaaggacttacattgactatgtagattgctttgggtagtattgacatcttaacaatattaaattttctaatccatgaacagaggatatcttttcatttatttgtgtctaatttctttcagtgatattttgcagttttcactgtagaagtcttttgcctgcttggttaggtttagtcctaagtactttattctttttgatgttacggtttgctgatttttctgtgttgattttgtattctgcagttttcctgaattcattcattctaacaggtttgttgttgttgtggaatctttagagtctttacatataagatcatgtcatcttcaaacatataattttacttattcatttccaagttagatttattttatttcatttccttgctgattgctctggctagggctttaggtattacgttgaatggaagtggtaagaatgggcatctttgtcttaattctgacctttgaggaaaagctttccatcttttcaccattgagtttgatgctggttacaagttgttgttttgttttttgtttttgtttgtttgttttttgtttgtgtgtgtgggggtgggtggtggtggtggtggtggtggtggtggtggtggtgatggtggtggtggtggtggtagtggtagtggttttttcttgctctgttgcccaggccggagtgcaatggtgtgatctcggcttactgcaaccgccacctcccgagttcaagcaattcttctgcctcagcctcccaagtagctgggattacaggcgcccgccaccatacccgactaatttcttgtatttttagtagagacagggttttgccatgttgttcagactggtctcgagctcctgacctcaggtgatccacctgtctcggcctcctgaagtgctgagattacagctgtgagccatcatgcctagccaggtataggttttttatatatggcctttttattatcttgagatagtttgcttctattcatagttttttgagtatttttagcatgaaaggatattgagttttatcagatgttttttctgactcaattgaaatgattatctgttggtggacacttaggttgattccatatctttgctaatgttaacagtgtggctatgaacttgggggtgcaaatatccctttgatgtatttattttgtttcttttggataaatacctaacagtgggattgctggatcatatggtagttctatttttacttttcgagaaatcttcatactgtttttggtaatggctgtactaatttatatttccaccacaggagttcccttttctctgcattctcatcaacatctgttatgttttctttttaataattgctattctaactgggttaagatgatatcttgtggttttgattttcattttcctgatgattagtgatgttgagcctcttttgatgtacctgttggccatccatatgtcttttgaaaaaatgtttatgtcttttgcccactttttaatgggaatgttttgttttaactgttgagttgtttgagttccttgtatattctggtttttagtttcttgtcagatgcatagtttgcaactattgtctaccattcaaaaggaaggttatttctttactctgttggattgtttcctttgctatgcacaaaacaagtctcaaaacattttaaaactctgggaggctgaagtgggagaatcatttgagccagggaggtaaaggctgcaatgagctatgattgtgccacttcactccagcctggcaacagagatagaccctatcttaaaaaagaaaaaaaaaattaaactcaaaactatatcaagtgtcttcttagaccacagtagaatcctcaaactagaaattaataccaagaggaacttagaaaactgtctaaataaatggtaattacatagaatactcctgaatgtccattggttctttttctgctcctttgatcttgtctttgccttctgtaacaccaaaaattcaaatagatcactttatggtgtcccatatgtcatgtaggctttgttcattcttatttattcttgttttgttttctgagttatttcaaaaatctgaaattcattcttctgcttgatatcatccattgctgaagcacttgaatgtattttttattccacttagtgaattcttcggtttgaggatttctgtttggttccttttttatgatatctatctttttggtgaatttttcattcatatcttgaattgtttttctgatttctttgtatttttgtgttctctatctcactgagtgtctttagtattattttgaatcctgttgctggcatttcataaatttcttttttattagaatctgttgctggggaattattgtgttcctttggagatgtcataatttcttgttttttttttttcacattacttgtatacttacaagttgatgtctgtacctctggtgtaacagttgcttcttccagttttttagattggctttcagagaggtagactttttcctgaagatctatccgtggtgttggttgggtagggcaccttgtctttgattctgggtgtgtgcagtagtgtatttttcatatgacctttttagccatatatagcattagtggtgtctgtgatttcctcagtggtttagggtgcaattgttagcagaggctgaggtgaagttctcctgggcagtgggatgctaggtaggccagtccttgggcaccagtggtggcagcagcagactgtgtgcctgtccttcggccccagggtacacaggcatggtgttagcaggtttaattgggttgattcttaggcctccatatggcttgcttaggtgctggtggttgcagtggatgaccaggtgagtgggtaggtccttggatccctgggcagtgcatgtggtatgggctatggcagtagttgtgatggtagcatcaggctgggtgggctgactctcaggcttccctgtaggagtgcgtatgtgtgagtggcagacagggtgaggcaatctctatgctccaatctctatgcttgggcccttgggggtatgtggtgccaggccaggtgggcctgtcttcaggccccctggtagagtgctcaggtagcaacagtggatagagagagccttgcctcagggcatgtgcatgtccactgtggccctgctactagaggggatagggttggtgtcggtgtcagtagcctcacaccagaggctggggtggggcaggtatggtatgctttgctccaagcagtgtcaggaacattgacactggcatgctgggagattctgtcctcaggacatgttcaagtgtgctgcagtcttgctgttagtggagatggggttactgtcagtggcagcaaccccaggctagcagggtttaggctctcagaagtgtacgctttggctctttttgtccttgtgatagcctccccagtataccctccccagtgcattgcacttgcctgttctccacagtgtaggattttatatatgctttaataccagggactctgccactctgctgggtccaagtggcattgcatcactgtaggcccccaggtggatgcagggaatgttagtagggctttactaatgtggaaatgcagggactcttgtgctcaagggcaggatgcagcctgttaagagctggactgaaaatgacaccatgctgtaactgtttaggtctcatgcaggtggtacaggacccagtgtgagctctctctctggagcagtgtcatcacatggtctctaagaagttctctatgctagtctctggaccccctctctgtaagctagggttgcaggagtccgtggtgggagtgtgagctgctgggtatctctcatttacctttcccccacactggagatctgctctgtgctccaggtcgataaaggccaagcaaacaaccttgcttccctcttcttccttgctttaggtgtttcctgtcacttctctgctaaattccagtgttgtgtcttagatgttctgttgaaagtgtgactcctccctgtttgggttttttttttgtgaaggaggcaagggctgatgtctctagtcagctatcttgaagcccctcctctatttttgctgttgttgcctgtgcttttcaggtcttatccaaaaaattccttgctcagaccaatataatgaatcatttcctttatgtttttcttccagtagtttcatagttttgggtcttacatttaagtctttaatcttttttttttttttttttttttattgagacagtctcaccctgtccttcattcttgagtgcagtggtgtgatctcagctcacttcaacctccacctcctgggttcaagtgattctcctgcctcagcctcccgagtagctgagattacaggtgcatgccaccatgcccagctaatttttgtatttttttttattagagatggggttttgccatgttggccaggttggtctcgaactcctgatctcaagtgatctgcccacctcggcctcccaaagtgctgggattacaggcatgagccaccgcacctagcctctttaatctattttgaaatgagttttgtgtatagtaagataagggtctaatttcattcttttgcatgtggctatccaggtttcccagcaccatttattagattatcctttctccaatgtgtgctcttggcacctgttttttgaaaatcagttggctgtaaaagcatggatttatttctgggctattttgttccattgttttatttgcttttattgccagtaccatggtgttttggttaatacagctttgtagtatattttgaagtcaggtagtgtaattccactaactttgttatttttgttcaagattgctttggctatttgaggtcctctgtggttcagtatgaattttaggcttgtgttttccactgctgtgaggcatatcattggtattttggtagggattacattggatctgtagatcactttgggtcatatggacaatttaacagtattaatttttccaatctataaacatgggatatctttccatgtatttgtgttttcttcattttattactgtttcatagttttcattgtagtgatcttttacttcttcaattaaattttttgttctttgggtttttttatagctattaataagtgggattgttttgttgatttcttttttcagctaattcactattagtgtatagaggcattactggtttttgtatattgattttgtattctacaactttactgaattattttgttctaccacttttttggtggcatctttagggtttctatatgtaagattgtgttacctgcaaatagtgttaatttgacttctcctttccaattaatttggatactttttattcttttttttttcttgcctaattgctctggctaggatttccagtactgcgttgaataaaagtggtgaaagatagtatccttgtcttattccagattagaggaaaagatttcaacttttccttattcagtagtgttagctatgggtttgtcatatatggcttttattgtgttgagttacattctttctattcttaatttgttaagagttgttgtcaagaatagatgttgagttttgtcaaatgctttttctgcctctcctgaaatgatcatggggtttttgccttttattctgttaatgtaatatatcacatttattgatttgtctgtgctgaaccatccttgcattcctgggatcagtcctacttgatcatgatgaattgttgaatttggtttgctaccattttgttgaggacttttgcatctgtgttcatcaggtatttatttttgtgaatgttgacgtctagttgtttgaatactattcattgcaaagactgtcttttctctgttgtacttcctttccttgtttgttaaagatcagttggcatatatttgtgtgtgtctatttctgggctctctattctgttccattgattgatttgtttattattttgttaataccacactttcttgactactttagctttatagtaagtcttgaagtcaggtaatgccggtcttccaacattgtcttctccagtattaagttgctagtcttggtcttttgcctctctgtatcaactttagagtgactttgttgatagccagaaaataaattgctgggaatttgattgagattgtattaaatctgtatatcaagttgggaagaactgacatattgtgacagtattgagtctttgtattcattaacatggtatatgtctccatttatttttttctttctttctttctttctttctttttttgagacggagtttcactctgtcacccaagctggagtgcaatggcgcagtcttggctcactgcagcctccgtctcctgggttcaagtgattctcctgcctcagcctcccgagtagctgtgactacaggtgcacaccactacgcccggctaatttttgtatttttagtagagatggggtttcactgtgttggccaggttggtctcaaacttttgacctggtgatctgcctgcctcagcctcccaaagtgctgggattacaggcatgcacaaccacacccagcctgtctccatttatttagctcttctttggtatctttcattagtgttttgtaacttttttctatagataaacgtattgtgttacatagttttttaaaaatgctttttacattttttatgtttttgagacagcatcttactctatcacttaggctggagtgcagtgacatgatctcagctcactgcaacctctgcctcccaggctcgagcaatctcccacttcagcctcctgagtagctgggactacaggtgtgtgccaccatgcccagctaatttttgtattgttttgtttgtagagacaaggtttcaccatgttgcccaggctgcaagtgtgtattttttgtttttgtttgtttggtttcttttttttggaggtagagtctcactcttgctacccaggctggagtgcaatggtgtggtcttgactcactgcagcctctgcctcccgggttcaagcgattctcctgccacattctcccgagtagctgggattacaggtgactgccaccatgtccagctaatttttgtaattttttagtagagacggggtttcaccatgttggcgggctggtctcgaactcctgacctcaggtgatttgtctatcttggcctcccaaagtgttgggattacaggcgtgagccactgtgcccagctttgtttttgtttttgagattcagtttctgttgcctagggtggagtgcagtagcgcagtctcagctcactgcaacctgtacctcccaggtttaagcagttcttctgcctcagcctcctgagtagctgggattaatttttgtatttttagtagagatgtaaccacacctggctaatttttgtatttttagtagagatgggtttcaccatgttggccaggctggtcttgaactcctgaccttaagtgatctgcctgccttggcctttcaaagtgtagggattacaggcatgagctactgcgcctggcctgcaaatgtgtttataatgacaaattccacttttttattgctggtatatagaaaatttattgacttttgtatattaatcttggatcctgtaaccttgctatagttacttattctaggaggatttttgggtcaattctgtcaaattttctacatagatgatcacattatctatgagtaaagacagttttatttattccttcccaatctctttaccttttattcctttttgtggtcttattgaattagctgggacttccactattctgttgaaaagctgctgtgagtggagacatccttcccttgttcctgatcttagcaggaaagcgttgagctgtaggtttctcatagatcttctttatcacgttgaaaaaatttctttctattcccgagaggtttttttaaaatcatgaatgagtgttgttctgtagtttgctcagtgttttttgtttatttgttttgttttatggagacagagtctcgctcttttgcccaggctggagtgcagtctcacaatctcagctcactgcaacctccacctctcaggttcaagtgattctcctgcctcagcctcccaaatagctggcattataggcgcctgccaccacaccgggctaatttttgtatttttagtagagatggggtttcaccatattggccaggctggtcgcaaactcctgacctcaggtgatctgccaacctcagcctcccaaagtgctgggattacaggcatgagccgtggcgcccggccttgctcagcgtttttatcttggttgttagatttgttaagtgctttttctgtgtttattgaaataatcatgtgatttttctgtagcctgttgatgtgatggattatattaattgagttttgaatgccgaaccaggcttgtatttctggggtatatcgtatttggttatggtgtttaattttttttaataccttgttggatttgatttgctaatattttgttgagaggttttatatctatgttcataagagatgttgatctgtagtgtttttttgtttttgtttttgagacagagtctcgctttgtcacctaggctggagtgcagtgttgttgtgatctcggctcactgcaagctctgcctcccaggttcacgctattctcctgcctcagcctcctgagtagctgggactacaggcgcctgccaccacgcccagctaatttttttgtatttttagtagaaacggggtttcactgtgttagccaggatggtctccatctcctaaccttgtgatccgcccaccatggcctcccaaagtgctgggattacaggcatgagccaccgcgcctggcctgtagttttcttttcatgtaatatccttttctgattttggtattaagggaatgctggactcaaaattaggaagtactcctgcttctatcttgtggaaggctttgtaaagaattggtgtaatttctcccttaaacgtttggtagacttcacctatgaacacatttagtcctggttctttctgttttggatgattattaattattaattcagtttctttaataatacaggcgtaggtttaggtctttgttttggttgatatgcttgcaatgttgaaagccgatagtttaatatcaatattgtcttttattttactgtaaaaatactttgaatactctgttatcttaaattttatttgtgtatttttatgagatattgataaaaaatacaacttttttttttttttaatcacacagcctagtgtgttaattgtaacctacaaggagcctgcaaaatcatctactcagtttggatcctacaagcaagctgaatggaggccagatagtaccatgatagctgtatcagtaagtagattttaccgctaaatagtgttttcttatgaaatcattacatcgcatttaaatttgattctcttagatgactttctttcagtcttttgcactcataagtatttattttattctgataggaattgctttactgattattctatgtggattactcctactatagcttttcttctgactctgctacttccttaacaaagcacctatatccctaaacatagcacctgtatccttttctgtttgttgttctcactttactgttttgcccttgaagtctaactgctttactaattattctgtgcgtgttactcctactatagcttctgttttgactctgctgcttccttccatccctaaacatagcacctatatccttttctgtttgttgttctcactttactgttttgtccttgaagtcttatctagttttttaaaacatattcacatgatattcttgaatttatatttaaattcctcccttccattccaaaagatattccagaaaataataagctttatgtgcatatgttatactaaaatttccatatccatttggatctgtttctcctttttttcttctgttctattaaacgtgcctagatatgtttaattttaccttttcagttcatgtttcatcactgtctaaggctgtcattatgacttaatatgcattagcagtaatatatgtggttaattaacattattgagcacctcctatccgatgagtacaattgtaatcagtttacatggatcatcccatttaatctttagataagtgctttgaagtagatattattatccttcataatggatgtgtaaattgaggatctgaaaaattgtcttatccaaggttacatgcgtagtgtatattagagagataaggtataaacttagctactcagcttccatttactatatccttatatctaatttatctctttgcgttggtccctttctagtccatactgtatataacactgactaggttaatagtctgaaatgttcatatgatgaaaaatactgagtagttctacgcttcctatagcaggagtttgcagatgactgaccatgtaccaaatatgccctggtgcctgtttgtacacagaccataatgtaagaatagtttttacatatttaaataatcaaaacaagtcaaagaagaatatttgctacagttgaaaattatgtgatacttaaatttcagtgtccataactaaaattttactggggcacgaaaatcctcactgatttatgtattgtctgtaacttctttcaagctacaatagcagattgaattgaagttcttacagcaagtgtatgtggtgctctcattgctttgctcttctgttcaatgcactgtgtagtaacacagttgtaacttcataacatttcaagtgtacacatattgccattctgtgacattttatattatttttattctagtacatactcatgtcaaaagaaccaaagaagacaaaaagactttgttttgtttttaaagcacactgtagtgtggtttcttttattattgaattagatggcaaaatattgtatttattattcaatggcactatagctatgccaaaagaatataagctgacatcactagactaagcacttatcagaatgtactgaaggttaagttagaagaattaaaaaatttagcacagaacagctcaccacaaaattccttcacaaaaataaaatatgaaaatgaaagtgcagtaaaagtaagtttgcttagtttttgataaattgacagatgttataatactgctcagttgtaaatttcagtggtccatgtgaagtatgaattgactaagaattactgtgaatgacctgcagaacaattccagatgaaaaaaattctcaaaggagttgagaaaatactaattcagtacaacccgaagtagaatctaagaagttgtattaattgatagtagtaaaaatccacatggagcagcaaaagacttagttggacagatttacaaagtttgtgaaaatataagacttttaaaacctatggttagtgtaagttttttcagagatggaagcaggaatatcttgaattgccctcctccacagctgttatggcttgggtagtgataaaagtttattggaaagtttttttgtttttttttttaccgagactgacttttttttttttctttacttgaaggaccaccatctaccacttaacagacactaaataactttggaaaatagcttttgctgtattagaaaatgttttcaaatatgaattatgtaaaatgtcattaaggaccagcattaatagatgaaaatttgcactcaattttgatgatagggaaaagtactttaaaccccaatttaccaaaaaggttatttccacaaaaagaatctaattctcattagtggatgtatattaccaaaaaaagttgtactttatgttaaatgttacagtacaatatgttaaagaactattcttttcccattgaacggtcttggtagtcttgttgaaaatcaattggccattggtatttggggttatttctggatgctccattctgtttcattgttatatatgtctgtccttattccagtaccacagtttttaaattactgtggctttgtagtaacttttgaaatcaggaagtggaatcctccaattttattgttgtatttcaggatataagtcatgtcaacccattgtcaacccattgtaagttgaaaataccataagtaaaaaatttaacagccccaaacatccatcataatgtcgtaagttgaaccatcataagttcagtatcatctatagttttgactattctgagccagtccctaagatgctatatgactgtttgaactggttttctatttctgtaaaaaataccattgggaatttggtagagactgcattgaatctgtagttctctttgggaagcattaatttaagtcttccagcctatgaacatgcaatgtcttatcaattatttagaccttcaatttctgtaaggagtgttttctggtgttcagtatgcaagtctttttcctgcttcattaaatttatttttaagttttaaatttctttttgatgctattgtaaatggaattgtttttaagtttccttttcagttgttcattccaagtgtgtagacatatatctgattttttccaacttaacttcagggtacatgtgtaggatgtgtgggtttgttgcataggtaaacatgtgctatggtggtttccttgcacagattatgccatcacctaggtattaagcccagcatccattagctattcttccagatgctctccctcatcctgcgccctgcccctccatcctctaacagaccccagtgtatgttgtttcccccatgtgtccatatgttctcatcattcagctcccacttataagtgaaaacatgtggtatttgattttctgttcctgtgttagtttgctgaggataatggtttccagctccaaccatgtccctgcaaaggatatgatcttgttcctttttgtggctgcatagtattccatcgtgtatatgtaccacatttcttttattcagtctatcatcgggggacattcaggttgattccatgtctttgctattgtgaatagtgctgcagtgaatatatgcatgcatgaatgtttgtaatagaatgatttatattttggggggtatacccagtaatgagattattgggtcaaacggtatttctgcctctaggtctttgaggaattgcctactgtcttccataatggttgaactaatttccactcctaccaacagtgtaaaagcattcctttttctccacaacctaaccagcacctgttgttttttgactttttagtaatagccattctggcttgtgtgagacggtatctcattgtggttttgacttgaatttctctaataatcagtgatgttgagctttttaaaatgtatttgttggccacatttatgtcttcttttgagaagtgtctgttcatgtcctttgcccacttcttaatgggattttttttttcttgtaagttattaagttcattgtagatgctggatattagacctttctttgtcagattaatagattccaaaaatttgctaccattctgttgtttatctgctcactccaatgatagtttctgttgctgtgcagaagctcttcagttcgattagatcccatttgtcaatttttgcttttgttgcaattgcttttgtcatccttgtcgtgaaatctctgcctgtgcctgtgtcccaaatggtattgtctagattttcttcctgggttttacatttaaatctttaatcaatcttgagttcattttcctttagggtgtaaggaaggggtccagtttcaattttctgcatacagctagccagtactcccagcaccatatattacatggggaatcctttccccattgcttgtgtttgtcaggtttgctaagatcagatggtgtaggtgggtgttcttgtttctgggttctctattctgttacgttggtctatgtgtttattcttgtgccagtaccatgctgttttggttactgtagccctgtgttacagttttaagtcaggtagcatgatgcctctggccttgttctttttgctttgattgccttggctattcggactctttgttggttccatatgaattttaaaatagcttttttctaattccgtgaagaatgtcagtggtagtttaatggggatagcattgaatctataaattactttgggtagtataaccattttcacaatattgactcttcctagccatgaacatggaatgtttttccatttgttcgtgtcatctgtcatttgtttgaaagttggtttgtagttccccttgaagaggttcttcacctcccttgttagctgtattgctaggtattttattcatttgtgaccaactgtgaatgggagttcattcatgatttggctgtctgcttgcctgttgatgtataagaatgctaatgatttttgcacattaattttctatccttagactttgctgaagttgcttatcagcttacaaagcttttgggctgaggcaatggggttttctaatataggatcatgtcatctgcaaacaaagatagtttaattttctctcttcctatttgaataccctttatttctttctcttgcctgattgccccagccagaactgccaatactatgttgaataggactggtgagagagggcatccttgtcttgtgccttttttcaaggggaatgcttccagcttttgtccattcattatgatattggctgtgggtttgtcatatatgactcttattattttgaagtatgttccttcaatatctggtttattgagagtttttaacctaaagcgatgttgaattttattaaagaccttttccgcatctattgagataatcatgtggtttttgtgttcagttctgtttatgtgatgaatcacatttattgaattgtgtatgttgaaccagtcttgcattccggggatgaagtctacttggacatgatggataaactttttgatgggctactggatatttgccagtattttgttgagaatttttgcattgatgttcatcaagcatattggcctgaggttttctttttttttgttttgtctctgccaggttttggtatcaagatgatgctggcctcatagaatgaattaaggaggaatccctaattttcaattgttttggaatagtttcagtagaaataataccagctcttctttgtacctctggtagaattcagctgtgaatctgtctgtcctgggctggtttttttttttgggttgctaggctctttattacttctcaatttcaggactcattattggtctattcagagattcagtttcttcctggttcagtcttagggagggtgtatgtgtccagaaaagtatccatttcttctagattttctatttaatgtgcattgatgcatttatagtattctctgatgattgtttgtatttctttggggtcaggatgatatcccctttatcatttctgattgtgtttatttaaatcttctcttttcttctttattaatctagctagcagtctatgtattctattaatttttttaaataaccagctcttggattcattgatcgtttgaatggtctttcatgtctctatctccttcagttctgctctgatcttggttatatcttgtcttctgctagcttttgggtttgttcttgtttctctagttctcttagttgtggtgttaggttgttaacttgagatctttgtagctttttgatgtgggcatgtagtgctataaatttccctcaacactgctttagctgcatcccagagattctggtacattgtctctttgttctcattagtttcaaaggacttcttgatttctgccttaatttcattatttactcaagtcactcaggagcaggctgttcaatttccatgtagttgtgtggttttgagtgaatttcttaattcttctgagtgaatttttttgagtgttgtggtctgagagactgttatcatttcagttcttttgcatttgctgaagagtgttttacttccgattatgtgatcaaatttagagtaagtgccttgtgatgatgagaacaattagtttctgttgttttaggatggagagttctgtagatatctgtcaggtccacttgatctagagctaagttcagatcatgaatatctgttaattttctgtcttggtgatctgcctaatattgtcaatggtgtgttaagtctgctactattattgtgtgggagtctaagtctttttgaaggtctctaagaacttgctttaggaatctgggtgttcctatactgtgtgtgcatatatggaggatatttggcgcttattaaattgaaccctttatgtaacgccctttgccttttttatcttttttcatttaaagtctgttttgtgagaaactaggatcgcagtccgtggttctttctgttttccatttgcttggtaaattttcctccatccctttattttgggatgtgtgtctttgcacatgatatgggtcttttgaagacagcataccgctgggtcttggttctttatttagcttgccattctgtgtcttttaattggagcatttagcccatttacatttaaggttagtattgttatgtgtggatttgatcctgtcatcaagatactagttggttattttgcagacttatgtggttccttcatagtgtcactgatctgtttacttcagtgtgtttttgtagtggctggtaatggtttttcctttccatatttagtgcttccttcaggagctcttgcaaagcaggtctgatggttacgaattccctcagcgtttgcttgtctgaacaggatcttgtttctcctttgcttataaagcttagtttcgccagatatgaaattctgggttggaaattctttactttaagaatgtttaatattggccaggtgtggtggctcacacctgtaatcccagcactttgggaggccaaggcgggcggataacgaggtcaagagatcgacaccatcctggccaacattgtgaaaaaccccatctctactaaaaatacaaaaataattagctgagtgtcgtggcgcatacctgtagtcccagctactcaggaggctgaggcaggagaattgcttgaacccagaaggcagaggttgcagtgagctgagattgcaccactgcactccagcctggcaacggagcgagactctgtcaaaaaaaaaaaagaatgtttaatattggccccaatctcttctggcttttagggttttcactgagaggtctattgttagtctcatgggcctccccttcgtaggtgacctggtctttctgtctgactgcccttaacatttttctttcattttgaccttgcagaatctgatgattatatgtcttggggttgatcttctcagggaatatcttactgaggttttctgcatttcctgaatttgaatgttggcctgtcttcctaggttggggaagttctcctggatgatatcctgaaatatgttttccaacttcgttccattctccccatctctttcaggtaccccagtcagtcttaggttcagtttatttacataatcccacatttctcagaggttttattcattttcattcttttttctctattcttgtccgcttatcttatttcagcaagatagtcttcaagctctgagattcttttctccacttggtctattctgctattaatagttgtgattgcattgtgaagttcttgtagtatgtttctgagctctaacaggtcggttatgttgctctctaaactggctcctcctagtattgtcagtggtgtgttccagtctcccactattattgtgtgggagtttaagtctctttcaaggtccctaagaacttgctttgtgaatctgggtgttcctacattgggagcgtatatattgaggacatttagctcttcttgttgaattgaaccctttattgttatgtaatgccctttgtcttttttgatcttgtagtgtgtttctcagctctaataggtcagttaacttcctctctaaactggctgcttatctctcacattgtcagtggtgtgttaaagtctcccactattattgtgtgggagtctaagtctctttgaaggtctctaagaacttggcacgtcctgtattgttttgtcatgtttcttactttgcattgggttaaaacttgctcctttagctcagtgaagttcgttgttacccaccttccaaagcctacttctgtcattcagctttctcagcctcagcccagttgtgagcccttgctggagaggtgttgtggtcatttggaggagaataggcactctggttttttgagtttttagcatttttgcattgattaatttcttatctttgtgggcttatctgcctttgatctttgaggttgctgacctttgaatggggttttttgtagggtcttttttgttgatattgttgttttctgtttgtttttcttttaacaggccactcttccatagaactgctgccatttgtgggggtctactccagaccctagttgcctcgatttttcctgtacctggaggtatcaccagggagggctgcaaaacagcaaagatggcagcctccttcttctttggaagctccttcacaggggggtactgacctgttgttagctcagatgtgcctggaggaggtggctggagacctctgttgggagatgtcacccagtcaggaggaacgggatcagggacccacttaaagaagcagtctggctgcagcaggtgtgctgtgttggggattccttcagccccccaattggtatgggctctccaggacccacaggctggactgattgagaagcctgaatgccagtgtggcagcctaccccaccactcaggtatactccgtcctggggggaaattagagctctgtctaattgggggtggctcaagaccccagctgggaagacccactaccccatgaggaggagtggattgaggtctcacgtaaagaagcagtctggccatgatctggcagtgtggctgtgctacactgcaggaaacctttctcttccatgctgtatggatatatgtgatttttgtgtattgattttatatcctacgactttgctaactttattagctctaataatttttgtgtgcattatttatacatctctgtggtctgatttggatgcctttatctcgttttcttgtttaattgctcttggtggaactttcaatactatgttgaattaagtggtaaaagtgggtatccttatcttgttcttgttctagcgggaaggctttcagtctgtcaccattgagtataatgttggctttaggtttttcatatatggtctttattatgttgaggttatttacttctgttcttagtttctggcatgcttttattgttaaaggtgttaaattttgtcaaatgctctctttgcgtcaattgagaaacgtggattttttcttcatcctgttaatgtagtgtatttcattgattgattttcctacattgaatcatccttgcattcagtgaatgaatcccactttgtcacgatgtatgaagtatttgctgaggacttttgcatctgtattcacacaatatattgatttatattgattaccaaaactcaagtcagttttggtagattgtatgtttttagaactttgtcagtttcatctggcttgtctgatttgttggaatacaactctttattgtattctcataatctctgttatttatgcaaaattactggtaatgttctttctgatttttgtgatttgaatcatctcccttttttcttaacttacctagaggtttatcagttttgttgatttttcaaagagtcaacttttggctggatgtgatggctcatgtctgtaatcccagcactttgggaagctgaggcgggaggattgcttgaggcagggagttacaggggagcctgggggacatagcataatgccatcgctacaaaaaataaacttagccaggtgagttggcacatgattgtagtcctagctgctcaggagggtgagtcaggaggatcacctgtgcccaggagttcaaggttaccatgagttttgatcttgtcacagcactccagcctgggcaatagagcaagactccgtatcaggaaaaaaacaatttttgttaaagtgtattttctttattgtttttccattctctttttattttgctctaacttttattatttcctttcttctgctagcttcgggattactttgctctttgttatttagttattttatgtgcacatttaggttatttatttgaaatgtccctccaccgccaccttttttttttttttttttgagacagcttcctgttttgttgcccaggctgaaatgcagtggcatgatcatagctcactgcagtcttgatttcctgggcttaagtaatcctctccctcagcctccctagtagctgggaccataggcacgcaccaccacgcctggctgattttgtttaatttttgtagagatgtgatctcactacgttggccaggctggtctcaaactcctaggctcaagcgatcatcctgccttggcctgtcaagtgctgggattacaggcatgagccaccgcactgggcctgagatgtgcctttttaagtgtggatgtctactgttccaacctctgccagttacccagctccaaagttgcttccacatttttgggtatctttatagcagcaccccactctctgcagtaccaatttactgtattagttctttctcatgctgctataaagaactgcccaagactgggtaatttataaaggaaagaggtttaattgacttacagttctacatggctggggaggcctcaggaaaattacaatcatggcagcaggggaaacaaacatgtccctcttcacgtggtggcaggagagaagtgctgagcagagggagaaaagccacctattaaagtaccatcagatctcgtaagaactcactcattatcacgagaacaccgtgagggtaccacctctgtgattcaattacctcccgccaggtccctcccatgacacaggggattatgggaactacaattcaagatgaaatttggttggggacacagccaaaccatatcactgaggaacccttatatttgataagctgcttctctgttaatgttttcaaaattctgtcttttggtttcagcagtttgattctagtgtgtctcagtgtgggtctctgagtttatcctttttggaatttcttggatttgtatattcacggatttcattaaggctcctgacattttcaaccatttctctttcctccatacttctattcctatattatgtatgttgttgtgattaatggtgccccacaggtcccccagactctgcttatttttctttattcttctttttgctccttagattgcataatttcaaatgtcttattttcaagtacatttatcttttccgtctgctcaaatttgctattgaatttctgtagtgaatttttcattttagttactgtactttttatcttcagaattttttcagttcctttaaaaaaaattttcccttttatcgatattctcattttgtttagacattgttttcttgattttctttagttttttgcccatggtctcctttagctcattgaacatatttaagagtgttgatttaatgtctcagattaataattcaaatgtctgggcttccttagggatggtttctgccatattctttattttctatgactgggccatacttttctgtttctttttatgtgttgtaatttttcattgagaactggactgagtattatgttgtggtgactttggaaatctaattctcctagccctcagagattgctggggttctgctccttgattactgaagagttccttttatgattttttgaaactctttttgcatagtatgtatttcttctgatgggtggtctctgaagtttctcttttgttttctctgttgccagccagtcatgtaagatttccttatcctactcccaagagaggggagattttggtgcacccatcacccaagcagtgtacactgtgtacccaatttgtagtcttttatccctcacccgcctcccacccttttccctgagtccccaaagtccattgtatcattattatgtctttgtgttctcacagcttagctcccaattatgagtgagaacgtaggatgtttggttttccattcctgaattacttcacttagaataatagtcttcaattccatccaggttgctgcaaatgccattattttgctcctttttgtgactgagtagtattcgatggtgtatatatataccacattttctttatccacttgttgattgatgggcatttgattgtcatcttgcccatatgacatcaaaattcagcagatgtcttgagggtaaaattggtgttaaagaaaaaattatcgaataatacttgttgaaacacagtaaggaaaacttttttggggactatcgcagtatatatagggaacactgcagtgggttcttgcagtggcaaagagagattgggctcacttcttcagcatgggcaagtgggaatttatagccaaggagcagtgtgggagtcaatggatagaaaattaataagaggaaacatcaggggtaatggggattctggctaaaacaacaggattcttgctgaagacagaccagggtgatcagacatcacttaggggagattggaggatgagccacctaatcagatatcaagtgtgggggtcttgctaaactggattttataaggaaatgcacagatggacctaagagaagaaggttcaggagcctgactaaagtttgactaagcacagaatctttgtcactggttatgtgtttgaggcacatcaggtctccagttagtatgga

SEQ ID NO: 334 - DNA, 27722 bp, Homo sapiens
acctatgaaaatttggatattattgtagataatactgtagaatttgctatggtttaaatttttaagagctttgaggtgcataaaaatacatctaagtgtacattgatttttagtaaatttatagtgttgtgcatccataatcacagtctagttttagaacatttatatcagccttaaaaagtactatgcccatttgtcatcaacctcttctcccattccagccttagaaaaccttggcctactttttgtccatttgatttagctttcctagaattttcatatcattggaatcatatggtatatggtcatttgtgtttggtttttatttagcataatgtttttgaggtgcatccaggtcataatatttcttttttcaaaatgtgtgtaaactaagggatacaagtgcagtttttttacagggacatattgcacagtggtaaagtctgggcttttagtgtaatcatcagctaaagaatgtgcattgtacacataagtaacttcttatcctttatccccttctcatccttctgagtctggtatctgttattccacactctatgtccatgtggtagtattcctttttgttgctgaatatttttccattatttgcatatgccgcatttctatctccattcaccagttgacaggtatttgagtcattgtgaataatactctcattttgaatgattgtgagtaatactgctgtaaacatttgtatacatgtctgtgtgtggataaatgttactcttctagagagatacctaggagtgcaactactaagtcatatggcaagtttaacttattggtaaagtgcaaaactttgttccaaagtgactgtagcattttacaaccccaccaataatgtatggaagtttctgtttctccacacccgttctagagggtttgtagtggtgtcttatttgtggctttaatttggtgtttttctaatgactaaaaaatgtttggcatgatttcatttgcttattagctatttatatatcttattccatttatatatcttattagccatttcgctatacctatgtagttaattatctattcaaatcctttgtccatttaaaaaaaaaacagtgatctgatcttgggtcactgcagccttgaactcttgggctcaagtgatccttccaccccagcctccctagtagctgggactacagatgcccaacagcatgcctcacttatttaaaaattttgtagagacagggtctccataagttgcccaggctggtcttaaactcccatcgtcaggctatcctccgaaagtgttggaattacaagtattagccatgatgcccagaccatttttgtttaagtggaatatttctcttattattcagttgtaagagttctttatatgtcttgatacaaattatttagcagatatatacttcgcaaagttctgcagcattaagtacattcacattatcatgtaaccattaccaccatcagtatccagaactttcattttcattttcccaaactgaagcttcgtaccctgtaaatggtaattcctggttttctcatcccatcagtccctggaaactactattgtattttctgtctttatgaatttgatttgtgtgggtacctcagacaagtggaaccacacactatttgtctttttgtgattgacttattgcactcagcatgtcttaagttttatccatgctgtagcatgtaccaaaatttccttccttcttaaggctgaatgatactccattgtatatgtacatactgcattttgttttattcattcatctgttgatggacacatgggctgcttttacctcttggatattgtgaataatgctgctgtgaacatgggtagacaaatatccagatccctgctttacttcttttgggtacatacccagaagtggacctgctgtttcatttggttattctataggttttttttttttttgagaaattttgcttttttttttaatgttaagaaattgccacatactgtgtttccacagtgtacatcattttacattcttaccagcaatacagtggttccagtttcttcacatccttgctagtacttgttttctgttgttttgatgattgccattccattgggtccaatgtggtatgtcatggttttggtttgcattttcctaatggttattaatgtcgagcatcttttatgtacttgtaagtcatgtgtatgccttctttgaaagtgtccgttgaagttctttgcccattgtttttcttgggttattttttgttgagttgtaacgcttcatgtattctgggtataatcctttatcagatatgtggtttctaatacagttatgctccatgtaatggcagtttgagatgttcctgtcaacagactgcattatatgatggtggccctataaaattctaatggagctgaaaaattcttcttgcctagtgacaatagaaattttatatagtgtaatgcattactttttctatgtttagaagtatttagatatagaaatatttaccattatggcacaattgcttatgtattcagtatagtaatatgctatataggcttgtatcctaggagcaatagggtataccttatagccaaggtgtgtagtaggccataacgtctaggtttgtgttaagtacccactgtgatgttcacatgatgacaaaattgcctagtgatgcatttcttggaacttatcccctcttgttaaagtgacacgtgactgtattttcttctgtttcaagggttacatttttactctctttgtagtagccattgatgcacagcattttcaattttgatgaagtctgtcttacctatttttttttgttgcctgtgctttcagtatcatatccaagaaattgttttcaaatccaaagtcatgaagtttttggcttgtgttttcttctaagagttttatagggtgaggtcttctgtttagagttttgatcactttgagacaatttttgtatatagtataagataagggtccagctttatttttttacatgtggatatccagttttcccagcactgtttgttgaaaagactttctttccttttcccctttgaatggtctaggtagccttgtggaaaataatttgactatttatgcaagagtgtatttctggactctgtgttttattctgttggtctatatgtgtatccttgtgccagtacgacagtattttgattgctgtagtcttctagtaagttttgatgtcaggaaatgtgagacgtccaactttgttattttcaagtttgttttgtctattcgaggtctcttgggaatccatatgaattttaggatggatttttctgtttctgctaaaaatgctgttaggattttgaaaggacttacattgactatgtagattgctttgggtagtattgacatcttaacaatattaaattttctaatccatgaacagaggatatcttttcatttatttgtgtctaatttctttcagtgatattttgcagttttcactgtagaagtcttttgcctgcttggttaggtttagtcctaagtactttattctttttgatgttacggtttgctgatttttctgtgttgattttgtattctgcagttttcctgaattcattcattctaacaggtttgttgttgttgtggaatctttagagtctttacatataagatcatgtcatcttcaaacatataattttacttattcatttccaagttagatttattttatttcatttccttgctgattgctctggctagggctttaggtattacgttgaatggaagtggtaagaatgggcatctttgtcttaattctgacctttgaggaaaagctttccatcttttcaccattgagtttgatgctggttacaagttgttgttttgttttttgtttttgtttgtttgttttttgtttgtgtgtgtgggggtgggtggtggtggtggtggtggtggtggtggtggtggtgatggtggtggtggtggtggtagtggtagtggttttttcttgctctgttgcccaggccggagtgcaatggtgtgatctcggcttactgcaaccgccacctcccgagttcaagcaattcttctgcctcagcctcccaagtagctgggattacaggcgcccgccaccatacccgactaatttcttgtatttttagtagagacagggttttgccatgttgttcagactggtctcgagctcctgacctcaggtgatccacctgtctcggcctcctgaagtgctgagattacagctgtgagccatcatgcctagccaggtataggttttttatatatggcctttttattatcttgagatagtttgcttctattcatagttttttgagtatttttagcatgaaaggatattgagttttatcagatgttttttctgactcaattgaaatgattatctgttggtggacacttaggttgattccatatctttgctaatgttaacagtgtggctatgaacttgggggtgcaaatatccctttgatgtatttattttgtttcttttggataaatacctaacagtgggattgctggatcatatggtagttctatttttacttttcgagaaatcttcatactgtttttggtaatggctgtactaatttatatttccaccacaggagttcccttttctctgcattctcatcaacatctgttatgttttctttttaataattgctattctaactgggttaagatgatatcttgtggttttgattttcattttcctgatgattagtgatgttgagcctcttttgatgtacctgttggccatccatatgtcttttgaaaaaatgtttatgtcttttgcccactttttaatgggaatgttttgttttaactgttgagttgtttgagttccttgtatattctggtttttagtttcttgtcagatgcatagtttgcaactattgtctaccattcaaaaggaaggttatttctttactctgttggattgtttcctttgctatgcacaaaacaagtctcaaaacattttaaaactctgggaggctgaagtgggagaatcatttgagccagggaggtaaaggctgcaatgagctatgattgtgccacttcactccagcctggcaacagagatagaccctatcttaaaaaagaaaaaaaaaattaaactcaaaactatatcaagtgtcttcttagaccacagtagaatcctcaaactagaaattaataccaagaggaacttagaaaactgtctaaataaatggtaattacatagaatactcctgaatgtccattggttctttttctgctcctttgatcttgtctttgccttctgtaacaccaaaaattcaaatagatcactttatggtgtcccatatgtcatgtaggctttgttcattcttatttattcttgttttgttttctgagttatttcaaaaatctgaaattcattcttctgcttgatatcatccattgctgaagcacttgaatgtattttttattccacttagtgaattcttcggtttgaggatttctgtttggttccttttttatgatatctatctttttggtgaatttttcattcatatcttgaattgtttttctgatttctttgtatttttgtgttctctatctcactgagtgtctttagtattattttgaatcctgttgctggcatttcataaatttcttttttattagaatctgttgctggggaattattgtgttcctttggagatgtcataatttcttgttttttttttttcacattacttgtatacttacaagttgatgtctgtacctctggtgtaacagttgcttcttccagttttttagattggctttcagagaggtagactttttcctgaagatctatccgtggtgttggttgggtagggcaccttgtctttgattctgggtgtgtgcagtagtgtatttttcatatgacctttttagccatatatagcattagtggtgtctgtgatttcctcagtggtttagggtgcaattgttagcagaggctgaggtgaagttctcctgggcagtgggatgctaggtaggccagtccttgggcaccagtggtggcagcagcagactgtgtgcctgtccttcggccccagggtacacaggcatggtgttagcaggtttaattgggttgattcttaggcctccatatggcttgcttaggtgctggtggttgcagtggatgaccaggtgagtgggtaggtccttggatccctgggcagtgcatgtggtatgggctatggcagtagttgtgatggtagcatcaggctgggtgggctgactctcaggcttccctgtaggagtgcgtatgtgtgagtggcagacagggtgaggcaatctctatgctccaatctctatgcttgggcccttgggggtatgtggtgccaggccaggtgggcctgtcttcaggccccctggtagagtgctcaggtagcaacagtggatagagagagccttgcctcagggcatgtgcatgtccactgtggccctgctactagaggggatagggttggtgtcggtgtcagtagcctcacaccagaggctggggtggggcaggtatggtatgctttgctccaagcagtgtcaggaacattgacactggcatgctgggagattctgtcctcaggacatgttcaagtgtgctgcagtcttgctgttagtggagatggggttactgtcagtggcagcaaccccaggctagcagggtttaggctctcagaagtgtacgctttggctctttttgtccttgtgatagcctccccagtataccctccccagtgcattgcacttgcctgttctccacagtgtaggattttatatatgctttaataccagggactctgccactctgctgggtccaagtggcattgcatcactgtaggcccccaggtggatgcagggaatgttagtagggctttactaatgtggaaatgcagggactcttgtgctcaagggcaggatgcagcctgttaagagctggactgaaaatgacaccatgctgtaactgtttaggtctcatgcaggtggtacaggacccagtgtgagctctctctctggagcagtgtcatcacatggtctctaagaagttctctatgctagtctctggaccccctctctgtaagctagggttgcaggagtccgtggtgggagtgtgagctgctgggtatctctcatttacctttcccccacactggagatctgctctgtgctccaggtcgataaaggccaagcaaacaaccttgcttccctcttcttccttgctttaggtgtttcctgtcacttctctgctaaattccagtgttgtgtcttagatgttctgttgaaagtgtgactcctccctgtttgggttttttttttgtgaaggaggcaagggctgatgtctctagtcagctatcttgaagcccctcctctatttttgctgttgttgcctgtgcttttcaggtcttatccaaaaaattccttgctcagaccaatataatgaatcatttcctttatgtttttcttccagtagtttcatagttttgggtcttacatttaagtctttaatcttttttttttttttttttttttattgagacagtctcaccctgtccttcattcttgagtgcagtggtgtgatctcagctcacttcaacctccacctcctgggttcaagtgattctcctgcctcagcctcccgagtagctgagattacaggtgcatgccaccatgcccagctaatttttgtatttttttttattagagatggggttttgccatgttggccaggttggtctcgaactcctgatctcaagtgatctgcccacctcggcctcccaaagtgctgggattacaggcatgagccaccgcacctagcctctttaatctattttgaaatgagttttgtgtatagtaagataagggtctaatttcattcttttgcatgtggctatccaggtttcccagcaccatttattagattatcctttctccaatgtgtgctcttggcacctgttttttgaaaatcagttggctgtaaaagcatggatttatttctgggctattttgttccattgttttatttgcttttattgccagtaccatggtgttttggttaatacagctttgtagtatattttgaagtcaggtagtgtaattccactaactttgttatttttgttcaagattgctttggctatttgaggtcctctgtggttcagtatgaattttaggcttgtgttttccactgctgtgaggcatatcattggtattttggtagggattacattggatctgtagatcactttgggtcatatggacaatttaacagtattaatttttccaatctataaacatgggatatctttccatgtatttgtgttttcttcattttattactgtttcatagttttcattgtagtgatcttttacttcttcaattaaattttttgttctttgggtttttttatagctattaataagtgggattgttttgttgatttcttttttcagctaattcactattagtgtatagaggcattactggtttttgtatattgattttgtattctacaactttactgaattattttgttctaccacttttttggtggcatctttagggtttctatatgtaagattgtgttacctgcaaatagtgttaatttgacttctcctttccaattaatttggatactttttattcttttttttttcttgcctaattgctctggctaggatttccagtactgcgttgaataaaagtggtgaaagatagtatccttgtcttattccagattagaggaaaagatttcaacttttccttattcagtagtgttagctatgggtttgtcatatatggcttttattgtgttgagttacattctttctattcttaatttgttaagagttgttgtcaagaatagatgttgagttttgtcaaatgctttttctgcctctcctgaaatgatcatggggtttttgccttttattctgttaatgtaatatatcacatttattgatttgtctgtgctgaaccatccttgcattcctgggatcagtcctacttgatcatgatgaattgttgaatttggtttgctaccattttgttgaggacttttgcatctgtgttcatcaggtatttatttttgtgaatgttgacgtctagttgtttgaatactattcattgcaaagactgtcttttctctgttgtacttcctttccttgtttgttaaagatcagttggcatatatttgtgtgtgtctatttctgggctctctattctgttccattgattgatttgtttattattttgttaataccacactttcttgactactttagctttatagtaagtcttgaagtcaggtaatgccggtcttccaacattgtcttctccagtattaagttgctagtcttggtcttttgcctctctgtatcaactttagagtgactttgttgatagccagaaaataaattgctgggaatttgattgagattgtattaaatctgtatatcaagttgggaagaactgacatattgtgacagtattgagtctttgtattcattaacatggtatatgtctccatttatttttttctttctttctttctttctttctttttttgagacggagtttcactctgtcacccaagctggagtgcaatggcgcagtcttggctcactgcagcctccgtctcctgggttcaagtgattctcctgcctcagcctcccgagtagctgtgactacaggtgcacaccactacgcccggctaatttttgtatttttagtagagatggggtttcactgtgttggccaggttggtctcaaacttttgacctggtgatctgcctgcctcagcctcccaaagtgctgggattacaggcatgcacaaccacacccagcctgtctccatttatttagctcttctttggtatctttcattagtgttttgtaacttttttctatagataaacgtattgtgttacatagttttttaaaaatgctttttacattttttatgtttttgagacagcatcttactctatcacttaggctggagtgcagtgacatgatctcagctcactgcaacctctgcctcccaggctcgagcaatctcccacttcagcctcctgagtagctgggactacaggtgtgtgccaccatgcccagctaatttttgtattgttttgtttgtagagacaaggtttcaccatgttgcccaggctgcaagtgtgtattttttgtttttgtttgtttggtttcttttttttggaggtagagtctcactcttgctacccaggctggagtgcaatggtgtggtcttgactcactgcagcctctgcctcccgggttcaagcgattctcctgccacattctcccgagtagctgggattacaggtgactgccaccatgtccagctaatttttgtaattttttagtagagacggggtttcaccatgttggcgggctggtctcgaactcctgacctcaggtgatttgtctatcttggcctcccaaagtgttgggattacaggcgtgagccactgtgcccagctttgtttttgtttttgagattcagtttctgttgcctagggtggagtgcagtagcgcagtctcagctcactgcaacctgtacctcccaggtttaagcagttcttctgcctcagcctcctgagtagctgggattaatttttgtatttttagtagagatgtaaccacacctggctaatttttgtatttttagtagagatgggtttcaccatgttggccaggctggtcttgaactcctgaccttaagtgatctgcctgccttggcctttcaaagtgtagggattacaggcatgagctactgcgcctggcctgcaaatgtgtttataatgacaaattccacttttttattgctggtatatagaaaatttattgacttttgtatattaatcttggatcctgtaaccttgctatagttacttattctaggaggatttttgggtcaattctgtcaaattttctacatagatgatcacattatctatgagtaaagacagttttatttattccttcccaatctctttaccttttattcctttttgtggtcttattgaattagctgggacttccactattctgttgaaaagctgctgtgagtggagacatccttcccttgttcctgatcttagcaggaaagcgttgagctgtaggtttctcatagatcttctttatcacgttgaaaaaatttctttctattcccgagaggtttttttaaaatcatgaatgagtgttgttctgtagtttgctcagtgttttttgtttatttgttttgttttatggagacagagtctcgctcttttgcccaggctggagtgcagtctcacaatctcagctcactgcaacctccacctctcaggttcaagtgattctcctgcctcagcctcccaaatagctggcattataggcgcctgccaccacaccgggctaatttttgtatttttagtagagatggggtttcaccatattggccaggctggtcgcaaactcctgacctcaggtgatctgccaacctcagcctcccaaagtgctgggattacaggcatgagccgtggcgcccggccttgctcagcgtttttatcttggttgttagatttgttaagtgctttttctgtgtttattgaaataatcatgtgatttttctgtagcctgttgatgtgatggattatattaattgagttttgaatgccgaaccaggcttgtatttctggggtatatcgtatttggttatggtgtttaattttttttaataccttgttggatttgatttgctaatattttgttgagaggttttatatctatgttcataagagatgttgatctgtagtgtttttttgtttttgtttttgagacagagtctcgctttgtcacctaggctggagtgcagtgttgttgtgatctcggctcactgcaagctctgcctcccaggttcacgctattctcctgcctcagcctcctgagtagctgggactacaggcgcctgccaccacgcccagctaatttttttgtatttttagtagaaacggggtttcactgtgttagccaggatggtctccatctcctaaccttgtgatccgcccaccatggcctcccaaagtgctgggattacaggcatgagccaccgcgcctggcctgtagttttcttttcatgtaatatccttttctgattttggtattaagggaatgctggactcaaaattaggaagtactcctgcttctatcttgtggaaggctttgtaaagaattggtgtaatttctcccttaaacgtttggtagacttcacctatgaacacatttagtcctggttctttctgttttggatgattattaattattaattcagtttctttaataatacaggcgtaggtttaggtctttgttttggttgatatgcttgcaatgttgaaagccgatagtttaatatcaatattgtcttttattttactgtaaaaatactttgaatactctgttatcttaaattttatttgtgtatttttatgagatattgataaaaaatacaacttttttttttttttaatcacacagcctagtgtgttaattgtaacctacaaggagcctgcaaaatcatctactcagtttggatcctacaagcaagctgaatggaggccagatagtaccatgatagctgtatcagtaagtagattttaccgctaaatagtgttttcttatgaaatcattacatcgcatttaaatttgattctcttagatgactttctttcagtcttttgcactcataagtatttattttattctgataggaattgctttactgattattctatgtggattactcctactatagcttttcttctgactctgctacttccttaacaaagcacctatatccctaaacatagcacctgtatccttttctgtttgttgttctcactttactgttttgcccttgaagtctaactgctttactaattattctgtgcgtgttactcctactatagcttctgttttgactctgctgcttccttccatccctaaacatagcacctatatccttttctgtttgttgttctcactttactgttttgtccttgaagtcttatctagttttttaaaacatattcacatgatattcttgaatttatatttaaattcctcccttccattccaaaagatattccagaaaataataagctttatgtgcatatgttatactaaaatttccatatccatttggatctgtttctcctttttttcttctgttctattaaacgtgcctagatatgtttaattttaccttttcagttcatgtttcatcactgtctaaggctgtcattatgacttaatatgcattagcagtaatatatgtggttaattaacattattgagcacctcctatccgatgagtacaattgtaatcagtttacatggatcatcccatttaatctttagataagtgctttgaagtagatattattatccttcataatggatgtgtaaattgaggatctgaaaaattgtcttatccaaggttacatgcgtagtgtatattagagagataaggtataaacttagctactcagcttccatttactatatccttatatctaatttatctctttgcgttggtccctttctagtccatactgtatataacactgactaggttaatagtctgaaatgttcatatgatgaaaaatactgagtagttctacgcttcctatagcaggagtttgcagatgactgaccatgtaccaaatatgccctggtgcctgtttgtacacagaccataatgtaagaatagtttttacatatttaaataatcaaaacaagtcaaagaagaatatttgctacagttgaaaattatgtgatacttaaatttcagtgtccataactaaaattttactggggcacgaaaatcctcactgatttatgtattgtctgtaacttctttcaagctacaatagcagattgaattgaagttcttacagcaagtgtatgtggtgctctcattgctttgctcttctgttcaatgcactgtgtagtaacacagttgtaacttcataacatttcaagtgtacacatattgccattctgtgacattttatattatttttattctagtacatactcatgtcaaaagaaccaaagaagacaaaaagactttgttttgtttttaaagcacactgtagtgtggtttcttttattattgaattagatggcaaaatattgtatttattattcaatggcactatagctatgccaaaagaatataagctgacatcactagactaagcacttatcagaatgtactgaaggttaagttagaagaattaaaaaatttagcacagaacagctcaccacaaaattccttcacaaaaataaaatatgaaaatgaaagtgcagtaaaagtaagtttgcttagtttttgataaattgacagatgttataatactgctcagttgtaaatttcagtggtccatgtgaagtatgaattgactaagaattactgtgaatgacctgcagaacaattccagatgaaaaaaattctcaaaggagttgagaaaatactaattcagtacaacccgaagtagaatctaagaagttgtattaattgatagtagtaaaaatccacatggagcagcaaaagacttagttggacagatttacaaagtttgtgaaaatataagacttttaaaacctatggttagtgtaagttttttcagagatggaagcaggaatatcttgaattgccctcctccacagctgttatggcttgggtagtgataaaagtttattggaaagtttttttgtttttttttttaccgagactgacttttttttttttctttacttgaaggaccaccatctaccacttaacagacactaaataactttggaaaatagcttttgctgtattagaaaatgttttcaaatatgaattatgtaaaatgtcattaaggaccagcattaatagatgaaaatttgcactcaattttgatgatagggaaaagtactttaaaccccaatttaccaaaaaggttatttccacaaaaagaatctaattctcattagtggatgtatattaccaaaaaaagttgtactttatgttaaatgttacagtacaatatgttaaagaactattcttttcccattgaacggtcttggtagtcttgttgaaaatcaattggccattggtatttggggttatttctggatgctccattctgtttcattgttatatatgtctgtccttattccagtaccacagtttttaaattactgtggctttgtagtaacttttgaaatcaggaagtggaatcctccaattttattgttgtatttcaggatataagtcatgtcaacccattgtcaacccattgtaagttgaaaataccataagtaaaaaatttaacagccccaaacatccatcataatgtcgtaagttgaaccatcataagttcagtatcatctatagttttgactattctgagccagtccctaagatgctatatgactgtttgaactggttttctatttctgtaaaaaataccattgggaatttggtagagactgcattgaatctgtagttctctttgggaagcattaatttaagtcttccagcctatgaacatgcaatgtcttatcaattatttagaccttcaatttctgtaaggagtgttttctggtgttcagtatgcaagtctttttcctgcttcattaaatttatttttaagttttaaatttctttttgatgctattgtaaatggaattgtttttaagtttccttttcagttgttcattccaagtgtgtagacatatatctgattttttccaacttaacttcagggtacatgtgtaggatgtgtgggtttgttgcataggtaaacatgtgctatggtggtttccttgcacagattatgccatcacctaggtattaagcccagcatccattagctattcttccagatgctctccctcatcctgcgccctgcccctccatcctctaacagaccccagtgtatgttgtttcccccatgtgtccatatgttctcatcattcagctcccacttataagtgaaaacatgtggtatttgattttctgttcctgtgttagtttgctgaggataatggtttccagctccaaccatgtccctgcaaaggatatgatcttgttcctttttgtggctgcatagtattccatcgtgtatatgtaccacatttcttttattcagtctatcatcgggggacattcaggttgattccatgtctttgctattgtgaatagtgctgcagtgaatatatgcatgcatgaatgtttgtaatagaatgatttatattttggggggtatacccagtaatgagattattgggtcaaacggtatttctgcctctaggtctttgaggaattgcctactgtcttccataatggttgaactaatttccactcctaccaacagtgtaaaagcattcctttttctccacaacctaaccagcacctgttgttttttgactttttagtaatagccattctggcttgtgtgagacggtatctcattgtggttttgacttgaatttctctaataatcagtgatgttgagctttttaaaatgtatttgttggccacatttatgtcttcttttgagaagtgtctgttcatgtcctttgcccacttcttaatgggattttttttttcttgtaagttattaagttcattgtagatgctggatattagacctttctttgtcagattaatagattccaaaaatttgctaccattctgttgtttatctgctcactccaatgatagtttctgttgctgtgcagaagctcttcagttcgattagatcccatttgtcaatttttgcttttgttgcaattgcttttgtcatccttgtcgtgaaatctctgcctgtgcctgtgtcccaaatggtattgtctagattttcttcctgggttttacatttaaatctttaatcaatcttgagttcattttcctttagggtgtaaggaaggggtccagtttcaattttctgcatacagctagccagtactcccagcaccatatattacatggggaatcctttccccattgcttgtgtttgtcaggtttgctaagatcagatggtgtaggtgggtgttcttgtttctgggttctctattctgttacgttggtctatgtgtttattcttgtgccagtaccatgctgttttggttactgtagccctgtgttacagttttaagtcaggtagcatgatgcctctggccttgttctttttgctttgattgccttggctattcggactctttgttggttccatatgaattttaaaatagcttttttctaattccgtgaagaatgtcagtggtagtttaatggggatagcattgaatctataaattactttgggtagtataaccattttcacaatattgactcttcctagccatgaacatggaatgtttttccatttgttcgtgtcatctgtcatttgtttgaaagttggtttgtagttccccttgaagaggttcttcacctcccttgttagctgtattgctaggtattttattcatttgtgaccaactgtgaatgggagttcattcatgatttggctgtctgcttgcctgttgatgtataagaatgctaatgatttttgcacattaattttctatccttagactttgctgaagttgcttatcagcttacaaagcttttgggctgaggcaatggggttttctaatataggatcatgtcatctgcaaacaaagatagtttaattttctctcttcctatttgaataccctttatttctttctcttgcctgattgccccagccagaactgccaatactatgttgaataggactggtgagagagggcatccttgtcttgtgccttttttcaaggggaatgcttccagcttttgtccattcattatgatattggctgtgggtttgtcatatatgactcttattattttgaagtatgttccttcaatatctggtttattgagagtttttaacctaaagcgatgttgaattttattaaagaccttttccgcatctattgagataatcatgtggtttttgtgttcagttctgtttatgtgatgaatcacatttattgaattgtgtatgttgaaccagtcttgcattccggggatgaagtctacttggacatgatggataaactttttgatgggctactggatatttgccagtattttgttgagaatttttgcattgatgttcatcaagcatattggcctgaggttttctttttttttgttttgtctctgccaggttttggtatcaagatgatgctggcctcatagaatgaattaaggaggaatccctaattttcaattgttttggaatagtttcagtagaaataataccagctcttctttgtacctctggtagaattcagctgtgaatctgtctgtcctgggctggtttttttttttgggttgctaggctctttattacttctcaatttcaggactcattattggtctattcagagattcagtttcttcctggttcagtcttagggagggtgtatgtgtccagaaaagtatccatttcttctagattttctatttaatgtgcattgatgcatttatagtattctctgatgattgtttgtatttctttggggtcaggatgatatcccctttatcatttctgattgtgtttatttaaatcttctcttttcttctttattaatctagctagcagtctatgtattctattaatttttttaaataaccagctcttggattcattgatcgtttgaatggtctttcatgtctctatctccttcagttctgctctgatcttggttatatcttgtcttctgctagcttttgggtttgttcttgtttctctagttctcttagttgtggtgttaggttgttaacttgagatctttgtagctttttgatgtgggcatgtagtgctataaatttccctcaacactgctttagctgcatcccagagattctggtacattgtctctttgttctcattagtttcaaaggacttcttgatttctgccttaatttcattatttactcaagtcactcaggagcaggctgttcaatttccatgtagttgtgtggttttgagtgaatttcttaattcttctgagtgaatttttttgagtgttgtggtctgagagactgttatcatttcagttcttttgcatttgctgaagagtgttttacttccgattatgtgatcaaatttagagtaagtgccttgtgatgatgagaacaattagtttctgttgttttaggatggagagttctgtagatatctgtcaggtccacttgatctagagctaagttcagatcatgaatatctgttaattttctgtcttggtgatctgcctaatattgtcaatggtgtgttaagtctgctactattattgtgtgggagtctaagtctttttgaaggtctctaagaacttgctttaggaatctgggtgttcctatactgtgtgtgcatatatggaggatatttggcgcttattaaattgaaccctttatgtaacgccctttgccttttttatcttttttcatttaaagtctgttttgtgagaaactaggatcgcagtccgtggttctttctgttttccatttgcttggtaaattttcctccatccctttattttgggatgtgtgtctttgcacatgatatgggtcttttgaagacagcataccgctgggtcttggttctttatttagcttgccattctgtgtcttttaattggagcatttagcccatttacatttaaggttagtattgttatgtgtggatttgatcctgtcatcaagatactagttggttattttgcagacttatgtggttccttcatagtgtcactgatctgtttacttcagtgtgtttttgtagtggctggtaatggtttttcctttccatatttagtgcttccttcaggagctcttgcaaagcaggtctgatggttacgaattccctcagcgtttgcttgtctgaacaggatcttgtttctcctttgcttataaagcttagtttcgccagatatgaaattctgggttggaaattctttactttaagaatgtttaatattggccaggtgtggtggctcacacctgtaatcccagcactttgggaggccaaggcgggcggataacgaggtcaagagatcgacaccatcctggccaacattgtgaaaaaccccatctctactaaaaatacaaaaataattagctgagtgtcgtggcgcatacctgtagtcccagctactcaggaggctgaggcaggagaattgcttgaacccagaaggcagaggttgcagtgagctgagattgcaccactgcactccagcctggcaacggagcgagactctgtcaaaaaaaaaaaagaatgtttaatattggccccaatctcttctggcttttagggttttcactgagaggtctattgttagtctcatgggcctccccttcgtaggtgacctggtctttctgtctgactgcccttaacatttttctttcattttgaccttgcagaatctgatgattatatgtcttggggttgatcttctcagggaatatcttactgaggttttctgcatttcctgaatttgaatgttggcctgtcttcctaggttggggaagttctcctggatgatatcctgaaatatgttttccaacttcgttccattctccccatctctttcaggtaccccagtcagtcttaggttcagtttatttacataatcccacatttctcagaggttttattcattttcattcttttttctctattcttgtccgcttatcttatttcagcaagatagtcttcaagctctgagattcttttctccacttggtctattctgctattaatagttgtgattgcattgtgaagttcttgtagtatgtttctgagctctaacaggtcggttatgttgctctctaaactggctcctcctagtattgtcagtggtgtgttccagtctcccactattattgtgtgggagtttaagtctctttcaaggtccctaagaacttgctttgtgaatctgggtgttcctacattgggagcgtatatattgaggacatttagctcttcttgttgaattgaaccctttattgttatgtaatgccctttgtcttttttgatcttgtagtgtgtttctcagctctaataggtcagttaacttcctctctaaactggctgcttatctctcacattgtcagtggtgtgttaaagtctcccactattattgtgtgggagtctaagtctctttgaaggtctctaagaacttggcacgtcctgtattgttttgtcatgtttcttactttgcattgggttaaaacttgctcctttagctcagtgaagttcgttgttacccaccttccaaagcctacttctgtcattcagctttctcagcctcagcccagttgtgagcccttgctggagaggtgttgtggtcatttggaggagaataggcactctggttttttgagtttttagcatttttgcattgattaatttcttatctttgtgggcttatctgcctttgatctttgaggttgctgacctttgaatggggttttttgtagggtcttttttgttgatattgttgttttctgtttgtttttcttttaacaggccactcttccatagaactgctgccatttgtgggggtctactccagaccctagttgcctcgatttttcctgtacctggaggtatcaccagggagggctgcaaaacagcaaagatggcagcctccttcttctttggaagctccttcacaggggggtactgacctgttgttagctcagatgtgcctggaggaggtggctggagacctctgttgggagatgtcacccagtcaggaggaacgggatcagggacccacttaaagaagcagtctggctgcagcaggtgtgctgtgttggggattccttcagccccccaattggtatgggctctccaggacccacaggctggactgattgagaagcctgaatgccagtgtggcagcctaccccaccactcaggtatactccgtcctggggggaaattagagctctgtctaattgggggtggctcaagaccccagctgggaagacccactaccccatgaggaggagtggattgaggtctcacgtaaagaagcagtctggccatgatctggcagtgtggctgtgctacactgcaggaaacctttctcttccatgctgtatggatatatgtgatttttgtgtattgattttatatcctacgactttgctaactttattagctctaataatttttgtgtgcattatttatacatctctgtggtctgatttggatgcctttatctcgttttcttgtttaattgctcttggtggaactttcaatactatgttgaattaagtggtaaaagtgggtatccttatcttgttcttgttctagcgggaaggctttcagtctgtcaccattgagtataatgttggctttaggtttttcatatatggtctttattatgttgaggttatttacttctgttcttagtttctggcatgcttttattgttaaaggtgttaaattttgtcaaatgctctctttgcgtcaattgagaaacgtggattttttcttcatcctgttaatgtagtgtatttcattgattgattttcctacattgaatcatccttgcattcagtgaatgaatcccactttgtcacgatgtatgaagtatttgctgaggacttttgcatctgtattcacacaatatattgatttatattgattaccaaaactcaagtcagttttggtagattgtatgtttttagaactttgtcagtttcatctggcttgtctgatttgttggaatacaactctttattgtattctcataatctctgttatttatgcaaaattactggtaatgttctttctgatttttgtgatttgaatcatctcccttttttcttaacttacctagaggtttatcagttttgttgatttttcaaagagtcaacttttggctggatgtgatggctcatgtctgtaatcccagcactttgggaagctgaggcgggaggattgcttgaggcagggagttacaggggagcctgggggacatagcataatgccatcgctacaaaaaataaacttagccaggtgagttggcacatgattgtagtcctagctgctcaggagggtgagtcaggaggatcacctgtgcccaggagttcaaggttaccatgagttttgatcttgtcacagcactccagcctgggcaatagagcaagactccgtatcaggaaaaaaacaatttttgttaaagtgtattttctttattgtttttccattctctttttattttgctctaacttttattatttcctttcttctgctagcttcgggattactttgctctttgttatttagttattttatgtgcacatttaggttatttatttgaaatgtccctccaccgccaccttttttttttttttttttgagacagcttcctgttttgttgcccaggctgaaatgcagtggcatgatcatagctcactgcagtcttgatttcctgggcttaagtaatcctctccctcagcctccctagtagctgggaccataggcacgcaccaccacgcctggctgattttgtttaatttttgtagagatgtgatctcactacgttggccaggctggtctcaaactcctaggctcaagcgatcatcctgccttggcctgtcaagtgctgggattacaggcatgagccaccgcactgggcctgagatgtgcctttttaagtgtggatgtctactgttccaacctctgccagttacccagctccaaagttgcttccacatttttgggtatctttatagcagcaccccactctctgcagtaccaatttactgtattagttctttctcatgctgctataaagaactgcccaagactgggtaatttataaaggaaagaggtttaattgacttacagttctacatggctggggaggcctcaggaaaattacaatcatggcagcaggggaaacaaacatgtccctcttcacgtggtggcaggagagaagtgctgagcagagggagaaaagccacctattaaagtaccatcagatctcgtaagaactcactcattatcacgagaacaccgtgagggtaccacctctgtgattcaattacctcccgccaggtccctcccatgacacaggggattatgggaactacaattcaagatgaaatttggttggggacacagccaaaccatatcactgaggaacccttatatttgataagctgcttctctgttaatgttttcaaaattctgtcttttggtttcagcagtttgattctagtgtgtctcagtgtgggtctctgagtttatcctttttggaatttcttggatttgtatattcacggatttcattaaggctcctgacattttcaaccatttctctttcctccatacttctattcctatattatgtatgttgttgtgattaatggtgccccacaggtcccccagactctgcttatttttctttattcttctttttgctccttagattgcataatttcaaatgtcttattttcaagtacatttatcttttccgtctgctcaaatttgctattgaatttctgtagtgaatttttcattttagttactgtactttttatcttcagaattttttcagttcctttaaaaaaaattttcccttttatcgatattctcattttgtttagacattgttttcttgattttctttagttttttgcccatggtctcctttagctcattgaacatatttaagagtgttgatttaatgtctcagattaataattcaaatgtctgggcttccttagggatggtttctgccatattctttattttctatgactgggccatacttttctgtttctttttatgtgttgtaatttttcattgagaactggactgagtattatgttgtggtgactttggaaatctaattctcctagccctcagagattgctggggttctgctccttgattactgaagagttccttttatgattttttgaaactctttttgcatagtatgtatttcttctgatgggtggtctctgaagtttctcttttgttttctctgttgccagccagtcatgtaagatttccttatcctactcccaagagaggggagattttggtgcacccatcacccaagcagtgtacactgtgtacccaatttgtagtcttttatccctcacccgcctcccacccttttccctgagtccccaaagtccattgtatcattattatgtctttgtgttctcacagcttagctcccaattatgagtgagaacgtaggatgtttggttttccattcctgaattacttcacttagaataatagtcttcaattccatccaggttgctgcaaatgccattattttgctcctttttgtgactgagtagtattcgatggtgtatatatataccacattttctttatccacttgttgattgatgggcatttgattgtcatcttgcccatatgacatcaaaattcagcagatgtcttgagggtaaaattggtgttaaagaaaaaattatcgaataatacttgttgaaacacagtaaggaaaacttttttggggactatcgcagtatatatagggaacactgcagtgggttcttgcagtggcaaagagagattgggctcacttcttcagcatgggcaagtgggaatttatagccaaggagcagtgtgggagtcaatggatagaaaattaataagaggaaacatcaggggtaatggggattctggctaaaacaacaggattcttgctgaagacagaccagggtgatcagacatcacttaggggagattggaggatgagccacctaatcagatatcaagtgtgggggtcttgctaaactggattttataaggaaatgcacagatggacctaagagaagaaggttcaggagcctgactaaagtttgactaagcacagaatctttgtcactggttatgtgtttgaggcacatcaggtctccagttagtatggatacctgtgcatctcacaaatacaggaaattttactttgcctgtatgaagtttgctttcgagcccttgagccccttctgcagcttctaagttcagcagatgtcttgtgggaaaaattggctgtggagttgaggcatttcaagtctgattatttcttcaaccctatgtaactgccaagagctttgctgatttttctttgctccagcaggcgtctgcctgaactaagtctgctgctttcttagcctgtgcccagaattggtgaatgctcttaggggaaaaaaaatcagcttacttctgaacagccctcctactatgaattttaatcagtctaggccttattgattccatagcttgcctgatgcctttaaaaatataattttttatgttttctgcctttttctagctgttgggagagttggtctgccatgacctacttattgtatattactgtgcagtagaattcttaaccatgtaatataaaattgccttaatactccttttatgattttttgagtcatttcatttttatatataaaatccaaagcattatataaagatggaatgagcccagatatatccattaaaactattgtaactgcccaacagtttcgttttgcctgctgcctgaatacaattgatttatcaagacagaggaattgcaatagagaaagtttaattcatgaagagctggctgaacagaagcgccatagttttattattcaaataagtcttccccaatatttggaggctagggtttttcaaggatagtttggtggggcagggaatgggtgctgctgattggttagggaggcagtcagaggtgtggaaaatggtcttcatgtcgagtccacttctgagtaggaccacaggaccaggaccagttggtgggtccacgtggagccctccgccgtcagaaatgcaaaaacctgagaaggtatctgaaaaggccaatcttaggttctacagtagtgatgttacctgcaggagtaattggggaagttgcaaatcttgtgacctctggaataatgactggtaattgtttacatttacactttagcagaattcaggctcctctcctcctcctaatgtcttgctaaacagatgatacaaaaatatcagtgacctttctaaactattaccaaataatacagagatggctctctgtattatttattttattattattattattatttttttttttttgagacggcatcttgctctgtcacccagactggagtggagtggcgcagcgcaatctctgctcactgcaacctccgcctcccaggttcaagcagttctccctgccttaccctcccaagtagttgggattacaggtgctcgccaccaggcccaactaatttttgtattcttagtagcgacagggttttgccatgttggccaggctggtctctaactcctgacctcaggtgacccgcctgccccggcctcccgaagtgttgggattatgggcatgagtcactgcacccagcctgtattattttatatcataatgaaagaaatgaaaataaaaaagaacctgttttgcaggcagaggctacaaaaactttgaacaactagtagaaatggtttaagttaatttctaaattctgagaagatagaaggactaagcccccattcctaactcctctcctcttc

SEQ ID NO: 335 - DNA, 28396 bp, Homo sapiens
atcctaagtcctcacgaggacaggaaatcaaatacgtggggctttagggcacctctactcaccactgaccccggtggtccaggtggccccaggggtcctgggattccttctctccctggggggcctgccagaccctaccagaaaaatggggcaagagaggcagagagtgacttgggaaccctcctaccctctgccccctcaagactgggaacccccaaggcagggccccctcctcacccaccatggattcaccatgcccctacatgctgttcccagcccctcacccgctctccactagggcctggctgacccatctctcctcgagggcctgtctgacccgggaacccaacaacaccaggagcaccgggcaggccagggaggcccagatctccctgaaataaaaacagcaaagggagggaatggtcaatgcaggacccctcccaggactctcatcagaactccctcttcctcctgtgggggcccggcctgctgcccctacaactggtgatggggcattgacttaccttcacacctggagggccaggaggcccaggggagcccgggaccccgactcctgggtcaccctttgaggaaaagaggcatcggatcaagctcagggagtctcacgaccaggaccccagcagggacccttctgggtacacataccttgaaacctttgggtcctggagcccctttctgaccctaagaaaacccagcaaacagcatttgagagggtaggaacatgagcacagagttcagacacgggctgaaaatattcccaggggagttctgatgtgaccatgaacacatgggaactcagacatgcgaccaagaattggctcacaggagctcagacatgaccatggcctatctcaggacagcacagacagagggacgctcagatactaccatagacaggtgggagttcaggcatggcacaggcacagggagcccacacgcgagtgcagacatctggctccacagacgtgagtgcggacacacgggcgctcagaggggaaccccaacacgtccactcccgggtagagcaggcatggccacaggctgaacgctggcagccaggggcaggggaaaggaggattgtaaacacaggaccaaggagaggttcacaagaactcaggtgtgtcctgggatctgggagatcagaccagagcacacgtgtgcccagatgtggtgagaaacagaccaaggatgggcacacagaagccaagacagggcccccagagctcagagtgtggaagccgacagtgtgtggctccctgtgatccagagagcaggctcctggatgttgggacatgcagcccgactcaggggctcagacatgtgccccggcccaagagtggccccttatgcccgccatcacactcctcaggccaggctcgcccttgcctaggccccggactcacatcttccccagggtctccgggctcccctgcacggccagcttcaccctgcacagaatggcaggtgaggggtgtctggactgagccttctctgctcagtagtcaggccccagggccaacccacctcaccttctcgcctcgcggccctggcagtcctcggtcacctttggctccctgttgacagaggtcaggaggcaacacaggcatcagtcacagaaagatgagactccggagggaggcatggggccagagcttaaatatgcggtctactatgaaagctgagggtcatgagggtgggtaaactatgggtcgaaggtcagaagttaggccactggagagacaggacccccagaacatctgctgtcagaagttccctacttaccggctcacccaccaggtctccagcaaggcctccaggggctccctggtaagggggagaggtcagtgggattccttggcccccaccagttgaccccccctcactggcagccccacacacactcaccttctctccctttgctccagggagcccgaccacagcctgtggggaatgctagtgagtttcctcctcctcccccgcccccaccctgccacccccatggcatttggaaacaggcttgtgggtgaggcagaggagttgctgcagggggtggaagtcagggtcaaagatcacctgtccaggggcccccgtggggccaggttctcctttaggtccgacagggccaggcagacctggtgacccctatggcagagcagcgtgaggaactcagtgcctctccaccaccacccctgctgccccactcctcatatttcaggcccacagctgggcaccacaccctagcgagctgcccccagaacacatactggcacaccagggctccctctgtctccatcttttccactggcaccatctcgacctggggctcccggcttccctgtctccccctgagagggaagagctctgtcagggctgcctgtcgacccttgacccctggagcccaacccttgacccccagaactcaccacttgtccaggcaaacctggagacccctgtggaccctgacggagaacaagtcggatgtcagggtgacaatggacacaggacgacatgagagaacatgggccccaaggagtgaaaacacggtgtccctacaggggccacagggactcactcaccacaaggcctgaagggccggggggtccaggaagtcccacagctccagtaggtccagtcaggccctggaggaagagaaagttcagggcagtgccaaccccacccatctccctatgaccctaacctgtgagctaggccactcacccgtcctggaggtcctgtctctccaggctccccctgcaaacaacccagagactgcatgagcagagcccacgtggccagggctcctggagctcatcctcattgcaggagatgacagcccaggaggttggcgcacactaccccaggcatggacacagcttgaaggagcctcctcctcctatccacacacctagactcaccttcaggccagaaggtccttggggtcctgcagggccagcaagaccctagagaaaagggtcaagggcagggaacagggctcagggattaacacagagaaggcctggctcatcagctgtggccaatgcctatcccagcccttccagaccctcaccaggcagtgttccctggtcactcaccggggcaccaggtggtccagggtctccatgaccaccctgttgtggcgaaaaagagtctgatgagggggagttagccgcaccccaccaaggaaactgaggcagtactggtcactggggcagggcacaggatgggggcaagacaggtgaaggttcttgggtactcaccactgggccaggggggcctcttggaccctgcagaccctacatagagagggcactgatgagcctcaatctgggcctcacttgggcctgttcccaacctctgggggctttttccttgggggtcaatttccatacctcaccctttccagtcacagataatacctacccatggactgcctctcatagatagcacacacgggcctgcacacacacatccacatacaaccacacacagacacaggcacacacaggcacacacagacacaggcacacacaagcaggcacacacagagaggcacacagacacaggtacacacaaacacacacacacagacatgcacacacacagcagcagcagcacctagcggagggtccggagcctggggccaggtgcttcagccaccactcaccggcttcccttcaggcccagccataccacgctctcctggtagaccctgcagagaataggtttaaggccttagtttcccagttccaacttcccctccacccaccatccccctagacagagtcaggacccagacagtcccaggcagtacagaccccagccctgcacacaggacaatacatgtgagagccaccttcttgcacatgtgtggctgttgggcaaggacttaccgggttgccgtcctgacccctcggtccaggctctccccggtctcctttgatgcctggcacaccctgaaggcagagtgtcgtgccctgagcccccagtccctgccacgtgcccaggtgcatatgcacaccacctctagtgtgcccccagaaaggagggggactctatggaagggtggagagaggcctcaccctgtctcctttgggaccttggtcaccattgctgcccggctccccctgtggggatgagatgtcaagtcagtccctagtgccatggcagagggtggccccgagctgattccacacactgaccttagcacccttgagtccagggggtccctgttctccagagagtccaggacctggctcatccacagacacctacaaacacaaggtcacaggggagagatgtctctgtcatagaggcatgggggagtcatcacagatctcaggatcacagagggttatagggtcagaaattccagggttatggcacacactaccatatttctggggaccaagctaagggtggcttcctggtcactagtcacaggactaaggcagggatggggtgatcaccttggggccagggggtccggggggcccaggggttccagggagtccaggagggccatctctgccctgcaggaaacaagaaaatggggtggcagccccagcacagcctccagacagcctgccccacgaagcccatcgcagcccacctgttctccacgttctcctttctctccccgttctccctgaaatgcaaatagcgggtgagggccaagcccatggggggtcccacccctcccaacccctcttccctcactctcctggccagcccccagcctcaccctctctcctggccttcctgcctctcccacacccccagccctgcctgggagcccgggaataccaggctttccaggctccccggcaaggccggaaggcccgggggggcccctctccccaagggccagaccaggtggcccctgagggccagggtctccacggtcgcccttcagcccgcgttctccaggaaagccgatggggccctgcaggagtggaagagagaatgctggtggctgtacagctacaccccactccacggggcacaacccactgagccacttctgctcacctccttgcctggggggccctgttcgcctgagtcccccttggggcctcgacgccgttcgggcacaggcaggaagctaccagagctctcatcccaggtctccacgatctcccgcagggcagatgcctgagggacagcaagaggtcagaggagcggggtgcgtcgccgcagcccctatgcctgtgggcaccactagccccaagggcccccacttgtccctacccccagcccctaaacaacccaccttgatgccagcagtttccagcaaccgatccacattctggggacaaagtctgggtgaagggctgcccatgacagagaagctcctgccttctgccccgcacggcctcaggaaagcaccttcacacccttttccctaggcctcttgcccagagcaccctttagcacttggttgaggcatggctggagactcctgggagcccctttctggtgtgtccccactgcccaagttcccttgagtgtgggctacaagaaccccaatggggcagggcactgaacacacagcacagaacctatggagcctcatggcaaggggaaggggatggcaaggtggccccaatgggcatgcaaaacagagtcaaggggacatcccaagcctggctcaccggcacacttccaggctctcctcgcaggccacgctctccagggaggccctggagagatgaagacaaactgctaggaaccagcctatgggtgtgcatgtgcacatgtgggtgctgtggctacctgggcatgtggaaaaggtgggggcctcacctgctcccctttggatccagtctccccacggtcaccctgaaaacaagaatgaccaggtggggaaatggcccccagcctggtcagccccctcaccacgccccctacccaacatccgcactcaccttggggcccgtgcctcctgggacaccaggaaaaccctgagatacggcagaacacaaaggggtcacaaaggcccatggcttcccaggagggttgcccattgaaacatcatggcttctaatgctctgaagtcccagaatgacccaggacactcacctggccaggagggcccactggccctgggaggcctggaggcccctggggtccaaggataccaggagctccacgctcacccttggggccatcacgaccctgtgaaggatgcagccagcatcagcaccctgagacctcagaaaagagtggagtcatattcccccagggtcagggtcaggggtcagaggttgcagaaaactccaatactcacttctctcccagaggcgcctgaatctcctttctctccctaaggaagacaaggatgcttcaggcatggctccaagcagagaccagagagaccccaggtgggggactttaccttcctcccgtcttctccagggtccccaggttctccctgtgggcagaggactcacatcagcccaaacattcactggtgtctggctgcaagacactaccttgctagatttcagatgactgtgactgtatttctgtgcctgtagctccatggttgtgtgtgtcttggagcatggcctgtggccgtctgagtgagctgctacatgtctaagggtgtgcctgcataggcctgctcaccccaacaggcaactgcacacatgtcctttgactctggctctctagaggtagctccacatttatgcatctctgggttggtgatcgtccacatgtcctgggtgtgtgcatatccatgtgtgtcttagtacatgtacccatgggtctgtgtgtcctggtctgtttgcacatcttggcccatgtctgcatatgggcatgggcttatacatgtctccaaagagcatgggcttatacatgccttgagagccatgtgtcttggcatctgtctgcaactcttgtgtgtagctcaatgtgtatgaccataagcgtgtgggtgaccatataaagtcatgggccagcatgtcctagcacatgtcacaggtcagagccatccatgtgtgtctcaccatgtctcaacacaggtccacatgcggtcttgggtccatgtcttagcacatgagtctgggtggaagtgtctgggtatcaacatgtctctaagtgccccaaatgtggctacacaccagtgtgtttgtgcctgtcgacctgtctgtggctcttcacctgtgcctatggctgtgggttatctgggcatgtgtcagcccatcctggcataaattggcccattcacctaactccctatgtgtctgtgaggctgcctgtgtgtgcatatagaactatgtttccaggcctggcgcaatggctcacgcctgtaatcccagcactttaggaggccgaggcgggcggatcacctgaggtcagtttgtgatcagcctgactaacatggagaaaccccatctctactaaaaatacaaaattagccaggcatggtggcgcatgcctgtaatcccagttactcgggaggttgaggcaggagaatcacttgaacccgagagtcgaaggttgcagtgagctgagattgtgccactgcactccaacctgggcaacaagagcgaaactccatctcaaaaaaaaaaaaactatgtttctggatgcatctgtatgtctgggccaggatgcatgtgtctacacgtgtgcctcatgtgttgctacagatcttggctgtgtaggtgtgctggcgtttcttggcaggtttcgccgcagctgccctggacacactcacgttttttccattcaggccaggtttgccatcctcgcctggctttccctgtgggaacagatcactggttggatgtcggggatcgggtgagggtagtaagggggaaaagggggtaacatgaaagtctggtctcaccggtaatccagggggaccagaggggccagggaggccctgttctccacggaggcctggaagcccctggaaaaagtctttgttaagatttatagggcctctgagatatcccttggggcacaccccatggactaagaggaccccaaaaagatctccctccagggtagagacccccaggactgagaggtcccattgagatccctcaggcacagaccccatggatgggggcccctgctgagactcccaagggaagaacccccaggacttggagggcctatgaagacccccaaggcaaagaaggtcagaaagggggattctactaaaacctgtgtgccagggactgagaccctcccaaaggcaaggctgaaccgaccccccaccaactctctcggatgctgtgactatgatgatctggttggagcttacgcagccccgagccccctctgtcccagcatctcccctcacttacgtctctccctgggtccccagctttgcctgcagcaccctgaggagagactcaaagtcagttcatcatggtcatggggtcaggggctctagtccctgtgagcctaaggcctgcatggcaagaacatgccccacccaggcagggctctgggagaagacacagacaacaggtctcgccccagagctcgtcaaggccaagaccaaccaatgaggctggggtctagggtcctcatgtgaaggggtaggggaaggggacaaccaggcaggactaccaagactcacattcggcccagagggcccagcggctcctggtttcccatccagtccgctccggccatccagcccagggggaccccggtcaccctgtggaaaatagagtggtaagaggccaccaaggctgaggtggatctgataacccaggctcatgtcctgagaaacccccacaccctctcaccttttctcctgctgggcctcggacacctgggtccccctggagggaacagggtcagataagaggtgagggtaagatggggacttggcagacggggcaaagtgcatcactcacctgtgggcctgggggtccccgaaacccttcaatgccctgaggataggggaggaagaaatcagagcaggccctcccatgcctgcacccccgaggaccaatcacactcaccctttccccaggggctccagggaggccaggatcacccttgggccctcgaggaccctcttgtccgcggtccccaggctctccctgtggcagagataagcttgctgaggaacagccttgaagccaagccatgcccaaggtagaacctgctgggaggggcactggggtctttcttaccctccacccacagaccctaataccttctctctggctccaggtcctgtgtctacctgtggggggaatgaccagtgagaagaatggctcaacaaggggaagaggagttggcgaggggatacagggtctgtgaggggctccagggatccgcggaggtttcagagggacagtgggggaagtgggagttagtggaaggaatgaggggacatgatgtggagccaaaggggcaagtgagaacaatgacagaggaccagacccagcgcagcccttaccagccgtcccgggggtcctgggggaccctgggaaaggaaatgattatagtcaataggagccctcaggtcccaggccatggctctggtttgccccaggctcaactctgcccccaagttccccgaagcaccccaatgccagcccccagcaggcatgggtggccatccatgcttcccacctggacctccagaccccttgtgtgaaggcacactggcagcagcgccaggggaccctccatcccttctgagcccaggacaccagccctactcaccggctccccacggtcacccttgggtccagatgatccagggctgccctgcagaaaggcaggggtcagggccactcaaggtaggcagcagtttgggagagctttggaagcaccatgaggactcatgggaatgttggtagccttcagatgcgtgtgtgcaggggtcaaaggaagtgaagattgggagggtttagcattacagggttggggggtaggatcaggtattgggaattggctggttggagggttaaggttggggtgaggagtcataggctgggactcacatttcgtccatcctctccaggatctccctggtctcccttttcacccacaggcccccgaactccaggtgccccctaagaagagcagctggcctgagacagaccctcccaatattttgcaggtgcccctatgacccgctacactgccccaggttccccattactccaaaatccacatcagaggttcccatcaccccatgcctccctgcagggactcccatcaccccttacccccctcagcctttcctatcaccttcatgcccacctcccatcacccctgttacttctctctgccaagactcacccgaaggccacgctcgcctgcttttccaggcaaacccgggtcaccctggtgatagagagaaaagtcatactgcacagggcagtcaggatctaactcactcagggagaggggacagagaagggtctgagcagcagctggacaggaggcagggagtggatggatgaactggtggagcaccagcctactgggatcctagttcaagggtaaaggatcagaaaccacagtgggaaggagtctcaccggaggaccctcgtcacctttctctccaacttcaccctgtgaaacatgagagtcagccctggttccaagaacccccatgatgctggcaacagccctactcccttacccgccatgactcccccgactccagcctcttacatctcgtcctcgggggccaacaggtcctggggggccaggccgcccagggtctcccttctctccaggaggccctgagtcaccctgtggaggaggcaagagggaggtgatgcaggacgctcgaagcaagcagttctcaaggggaggggaccccagaagccttgaggttgcccagggtaacgggtactcactgggggtcctgctctgccagtaaggccaatgggaccctgaaggggacagaaggggggcaggacttagtcagggtcccaccacctcatctccctctgtcacactccccattcccacattgattcacccggtctccagggtctcccttggggccagggtctccaggaagaaccaagccgggtgggccctgtggatggaaggataagaagtcaggaagacaaccttcaccaactgccccctaaacacttcgcttcacttacccgttccccttggactccggtagctcctctgggcccagcgggccccacatctccctggaggtgacaaagaccatcagtgctagtcccaggctccagttaaccccctgacccagcaagtcctgtgaccccccaagtcccatagataggccctatgacctagacctcaaccctgtagaaacctccccttgccccataccaggcttaccttttctcctttgggtccagcaacagcaggtccctgaaaacaaacaggacagatacagcttggccctgccttggggttgtatgatcaaagtcttcattggaatggaggtcacatggaattggaagtcatacagctcagtccccgcccagaagtcacagagtcaccgctgacagcagggaaggggttatacaaaatggactgacacaaagagctcatgacctgcatggcggtcttggggtcacaggatcatagccaagagtctgggggcaggttctagcagaaggagagccgcagagctcccagcctgctcacgggcccagcactgtggaatcacagcccagatagtgttctataggagggtcactgctcaagggctgtgctgtgctcagagcgccatcctcccgtcactcaccaccactgcagggtccccagggcgaccaggctccccctgtggagagaggataggagcagggacaggtcagggagtcacctaggagcccaaaatcccagtgtcccatctgccacatccctagtaccagacagtgccacccccagccgaggacccaccttctctccttggcggccagtgggtcctggtggcccctgaatgtagagaaagtgtgagcccaggaggggaagggaaaggggagggacacacaaaagtcccactcctggtcccaccacagtcacagactcacttcaggacccttggctccaggacgtccagcaacccctggcagcccctggaggagaggaagggaagagctgtgcaggtgggtggggacgggggatatggacagacagggctagaggctggggtgggggctggagaggggtcagggaagattgggatttaggttggcaggggtaagacttggcaggagaacagagaccaggtcagtgaaaatcaaggtcagttcagcagggtcagaggttcaaagccaggtccctggggctgagggttagagcctgtatcagcagggataagtggtcattgaggaggggtgaggagcaggggtagcaggggtcaagggcaagaagtcagaaccagaaagggcacagccaggtcagctggtatgagcattgcagccagtgggtttacccgggatcccgctgggcctgggggtccacgttcgccctgatggaaaagaagaggtcagagctgagttgggcccagatcctccagggcccttggcaccccccaggttgcacttaccttctctccagcctcacccaggggccctggaaagccccggtcaccctgaagagagagggtgagagaaagacagagagagagagggttggtggcggggcttgaacgtcaaaccccagacaaggggtcccaaactccaaccaccccctccaaaaccacgacctctgacctggagggaactcttatctccttatcttccagcctcccctaacaccatggggagcccagagtagcacccctcacacctgaatcccccaactggtactcactttggggccaatagctccaggaggtccccgtgggccctggaagggatgaatttgggggttcagagatttgggtttgggcatgaggatggagcagtggttgatgattgaggtaggggctggagctgtgcccaccatattcagaatccctggcccctccactcacctgctcacccggagacccaggttgtcctgggaggcctggagctccatcctcagagtcaccctgaaggagaaacacacgggtgggaagaccgaagggaggccctgcccccagcacgcagcctcccaccccagaactgggacatcatcaagtcagccttcctactttttctcctttctttccaggggggccaacggggccttggggtccagggcttccgggaagaccctaggaagaagtgagtaaaaatatgagccaagaactatgaagcccagcacccaaccactgccccaggagagacccacacccctgagcagggcccccagcagagcctcaaggcccctcaccggcagcccaggctccccaggagcaatgccaccttcacctggtccagggggaccctgggagagaacagcaggtcagggaatgaacaggggaatcagactccaagccacccctagcacaacctgtccctcacttacccgctccccacgatcgcctttgtcaccctagaaaacagatgacgaccccatgaccctgggccacacctcactcccaaagataccaggagtgatgagggtcatggggtccaattggatttcaaggattttgggagaactgaggcgtcatggtgaggatgggggtaatcaaagggtcacaagggccagagtaactggcaggggttatgtgggttcaaatggggtcaccaggtctctgcatcacatggcactcatgaggctgtcaccttcatggctgttccaggaagccctggggggccacggggtcctgggtcccccagtggtccacgaggtccaggggggccctgatggaggagacaaagtataaggtgcaaccccacagacctcactctcgcccccctcgtgttggtccccccactacacatcacttgcctccacataccctgcacttaccgatggtccagggtcccctttccgcccaggaagcccaggtccttcacctccgatgacttgtccgggagccccctgtaaggacagagagcagtgggcaggattcaggctatgggggccttgagctggaagaagcccctagacatgtccagctattcctattcgcgccttaggccctgcacagggtctggtgtggggcagtcctgctcctccctgggacatcccggccgcctcccttcccccttcacctaccggctccccctttgggcctcgaggtcctcgctctccctgaggacgaaacagagcagagggtggtgcttgggctcaggcgaatgtcaacgtgggcactgcaccaccaccccaggctcccaccctgtggaagaaccctgggaagacacttagagagcaaagaagggaaggcaccttaccgggtccccacgagggccaggcaaccctggagagccctgcaaatggaggccagaggcagaacagtcggagccaccccacccactcaggcagcgcccaccctgacctgcaggacaaggcttgctcacctttaggccaggggctccaggggtcccaggattcccggcgcggccagggctgcctggacgcccatctgctccagggaagccctgaggaggtgaagaggtcaggacaggaagggaccctcccccaaggcccctggtttgctggaggggcctcaccccatcaacaaggggtcgcctaccccactgacccccaagtgttattgggggtggaacagtgaggcagagaaatggcccctcagagcttcacagagcccaattccaggcacaagggcagcgacaaggcagagggcttccctgcctctgggacttggagctgctgctcaggctctgcagcggggctagaggccccactggcccttctatttcagagtgtcccccaaagtctctgtggtggtttataacctccagctgggcttctaggaattcccgatgattctaactctgcttcttccttctctcttgtaaaaaccccgagacagctttgaggagtgcctcagagaaacctcgatggtctccacactcaccctctcgcccttggcagtggcacttccagggggcccctgggggccgggagcaccggtcctgccctgaaagaagatagcagttaggtggggataagccagtcagggtgcagggacagatgtgggggacactcaccgggaggccagggtcgccaggaggcccaacttgtcctctcaggccctaggaagggtaatcagtgagacctgtgctgccaacctctcctgccccactgacactcaacccattctctattccccgcccgcaggggcactcaccatctctccaggttcccccttctggccctggggaaagacatgtcagatgtgggtcagagtggctagccccaggtgcagcctctgttcacctctcgatgagggactcttacctttggacaatacactgggcagggctctggccggggctgcggacatagggtctctttgaggttgaacatttctaccaagaacccccagaccccttatattctaccacccagtcccccagaggcctcttccaaacctgagtagtgaaggatgcctgacacagggctgtggccagaccactgactgcctggtccaggcttggcccatcatccacggcgaagaaggtctggacagagtccatacccggcgccaagcgacgcagctgctctgggtccgctccagccattcccaacatcaccacattaagccctaaggtggggtccagtggctgcatgatagccttttcagggccacccctattcccagaccccttccccatcagcctactccttaccagaagcctgggcctcacggatggggctgaatatgtcacctctcaagggttcatccactagcagaaccatcacccctggtacgtgctggcggcgcccaggagcatctggtgccaacatgtatctgtgagctgtgaccacggctgtgcctggaaggaaggacatgtcagaaccctggggcaccaagctcccagtggatagccccaggagtccatgcctgctgcagtcctcacccaggttgttcccacttgggtccatgtagggcatgtcacggatcctttgcaagataatgccaaggtcatgggagccattcagtgggaacagtggggagggccgatgactgtaagacagcaggccaacctggggtggaaggaaacacagagcctgaggaggatgacagagcagggatgggggtgcacagagcctggagaaacacatcagggtgtgtgtgaccaaaccctatctattagggagtcagcagtgatggcaggatagggagccaggcagtaggtgaggtctggagcctgtgagagagctgggagaatgcctgaacctattgggtggtcaggagatggtaactggtatggagcctgggtggggggcctcagggagaggtagaatctggctgccccagggccaaacctgaactgcctgtggcccaagaggcccaagtgccaacaccagacgctccaggaccctcctcgtagcctccgcacggtgagcattgtcttgagtggcatgtggtaggaacaccacatccgccaggccacgggggcacactgtaggaaggggaacaagttactgaagcgggcagcccacccagacacacctttctgcccttcccactacgcccactatacctggcgtctgtgtgacagatgcctcaggaccccgcacaccatccaggacaggcgtcagggagaagatgtaagagacgccaggctctagccctgtcacccgctgggagcttgagatccctggaagtgtctgcggggacccaggcacttctgcaggagacagaacttgattaaaaagctgtctccacagagccccaactgccagcccacccaaatcctggcctccccctcaccctggccagggcctctgagtggccgccaggataggatgtagctggatgccctggacactggagtccaggccaaagtcaccgagtcgatcgaggtgtccaccacacgtagttcaatgcttggaacacgaggtgactctgaaggaggaatgaaagatcgaggatcagaggctgagtcctgagaacccagaagggagagatctgagatcctgggtccggtttgtcttattgaagcatcatgggaggtcatgctggggtcacccagggtcagagggtgaggggtaggggtacaggaggagtcactcagagtcggggtgcaggaagtcagggtgggtcatcagcaggggaggagcacgccaaggtgaggcaggcttaccagtgcgcgcagtcacctctgcagagggcccttctccagctggccctaggacactcagcctcacgcggtactgtgtcgctggctccagcccgtccaggtgatagctgctgagctcgggccccaggacccgggactgttcctggccacctggggcaggcgtgagggtgggggccaagagcatgtgggatagtgacacctgggggcattaaagggcctgcccacttcactggctctgttaactgggttcaccctcctgactgatcttcctcatcctcactgaccctgcccactttacggaccctgccagactgaccctccatgaactcattgatcccacccacttcattgattgatcttacctactgtcacggatcccgcagacccccagtgacagaccccgcccaccatcactgtcctcgcctaccttgcggagtctgccacagccctgcccccaatggtccctaacttcctcctggggacacctctcaccctcaggttgccagtgcagaaggaagccctgcgctctgggcaccggctcccagcgcagcctcagcgagtgctccccgcgctgcaccacgtgaagcgtccccagggctggcggagcctcaggcgctggagagaaagctcaggaatcagggaggctctgcccccatggcccctgcaccaatcccaggcccaccctggcacacgcaccccgcccagcctctcagacccctctccctcctctcagaccctgcccccaaaggctcactaccaatcctggtcctttctccaatccagagcacaagcccggatccccaaaccatccacaccacccatccgaagctctccagcgcatgctctgcctacgcgtagtgacaacaatggagacaggtgtgccctcgcggtccccgacaagtgcagtcactcgcactgagtagctgactccaccttcgagaccccggatctctgcagagtctgtgtttcctgggagtatctggtgcctcatggggccgcctggccaggtgggcatacagcaatggttaggggtgagcagtcccagccaggaaggacaggggtggcgtcagggagccataccttcactccggccccaggccagtctgtaagctgtggctccagtgacccctacccaggtgatccgtagaacgtcgctggaagcattgaggatctgcagcctcgacacacgacccacaggctcaggggctggggacagaggcaaggtaaggggtcctggtagagaacagagaggcagtgcaggaatggttgacgcaggggtgatctgaaagtcagtgtgaggttagtgtggacaggtcactttaggcagccctgaggaggaggaggtcagtgccttggggtgggcagtgtggggccaccaggaggtcaccgtgggtggacacttaatcagtgtggggtgggtcagtgtggacaggacagtcactgagcaggggggtggaggcagctgggcaatcaggaacacacagcagggcagggtagctaatgcggtgtggctagtagctggccagggtccactcaccagtcctcacaaccacagaggcagggggcccatccacgccagccacatgggccctcacatgcaccgtatactcagtatctggctccagtccatccagctcagccaccgtggcctccccagaaaccaactgggatttctctgggcctgggaacagggatggaggcagctccagggctagcaaactctgtgccccagagccccacctggacccccaataaacccccagcccccattccaccctgacctgccccctcccaaaccccagtccccaccgtgggctgagtgccaggaaaccctgtatcctgtggcgccaggaaccctggtccaggtaatggtgacagatgagctgctggcctgagtcacatggaccgtcctcactgggcccagtgggtctagtggggagaggcaatggggagtctgctggaacaggcaggaaggagtggggctatctgataggggaagatgatgggagtctaacaggagacgggaatttgatagaggagatggtgaataggtccagtggaggagtggggaggtggaggttttaggaagcagtgagcaggtctgatggaggagaaagtgtaaatctcagaggagatttgggtccagcaaaaaagggatgggggtctgagggttgaagtggtggatatttgagggcaaaggctgtgggagtcttaggagagaagcggaggaatctgaatacggggagggcttaaggggagacagctgaaactgaagaggaagcagcgtctctgagggaggagggagtgggattctgaagggggaggcaggagttctggggagaagcaagggtctgcaagggaaggcatgggggtctgaaagagcaatggaggcagagagccaagggacgggggcagggcctgacccgttcgagccacgatgactgcagcagggccctcctctctgcctcgcagtaccgacacagccacctggtaggtggttccaggctgcagccctgtgatgtctgtggcagtagagtctgggggcagtgtctggctggactccggacctgaggtcagagggaaatgctggcatggctcctgcctgtcccctctggcacccataccctcattggtccctttggcagtccccccacacaccccacactgaccactgcctgtgctccagctaatccgaaatccactggctccagggacgggtccccaggccaccctcactcgcgttgcatctgacaccacaacccgcagccctggaacagcaagtggagtttccggctctaggagttacagacagaagtcagaagtcagaaccaggaccagagtgaggcaggcagctgtcctccacaagcctcctgcagtactcaccccggcggacagtgaggacactggcactgccctcacggggacccactcgagcagacacccgcacagtgtagctaagcccagcctgaacgtcatccaagtcgaatgctgtctgactcccaggaagcaccagggtccgctcaacccctaagagagaagtcagggtaggtgggcaggggtcagaaagagacagggatgtgggacgatggcagtgatggacagggacgcagagtgagaagggccatgggggtggggatgtggggtggtggggaccagagagctgggatatggctgaaaaaagtgagtgcaagacaaggacataggatgaaaggggccagtgatggtcagggacactggaggacaggagtctgtgggatcttagcatgtaggatgacaggagtcagtggactgcagtgagaactgatgagccattgacagacactgatgtgggatggcagaggtcagtgctggatggggacatgcaatgagaggttggtgtacagtggtcaccactagggtaacagaaagacaggtgattgagcttgtggctgtgcagaggtgaaagccgtggatggggtgtggggcagggaggagattggttggggtagggtaggggcagacacaccctgttgacagttcagggctcagtgccatcttgggaagcagatggataacgagacagggaggagactatagggacccaggtgtggaaggagagggctggaggtacactcagacccctcaggctggaacttcagtgtgtgtggtgggggtgctggctgcgtccacctcaccctgggtgctgcgcacaatgatgcggtactgggtggcaccagggactgggctccaggacactcgcacccgctgcccgggcagctcggtggcttgcaggtctgttacagggctcacaggcagctctggtcctgttggagagcacagcatagaggcagcctggggctccgacacctcccccactcactggcccagcccacagagccctcaccagtgggaaccacggttgcaggggtggccacctcgtggccctccagcagagtgtagagtgtgaggcggtactcagtgcccggctgcagcccatccaactggtagcgggtcacatcagagggcagtaccaccttctgcggtggctccaagcctgcaagataacagggtcagaccagcagaggccatgccctgacccttgcctgtccatcccttcccccgcactgaccagtctcacgccgccattccaaccggtagccacgggcctcaggcaccaagttccaggaaaggaggatggatgtggggcccaggatgaccgggcgcagggtctgctcaacagaagcgtctgcccagggcacatgggatgtcagtggcctccgggccttgccctgcctgcccgtcccagcctgaagaaagtgcccagccttctcaccagtgcgagccatcagggaagtggcgggccccacactgcggccaaatagggtgctcacggtcacctcatagtccgtgccaggctccaagtcacgcagcaacactgaaccctgcccagggcccagctcctgctgctgtgtgggcccacctgcatgggggacaccaaggggccagtgggccttgcagactcaggactctacagccttgtctgaggcgcggggactcccctcagcccacatctctcactcaccactgaggacccgccatgtcacacggtagccagtggcacctggcacactccgccaggccaccaggaggctgtgggctgtggtattctggatggtcagttccggcccttctagggcagctgggggagagtcccaccagggattcatggagtcagaagtgggagggggtactggggtcgggggttaggtgaatggggtcagaggctggcagaattgctcactggtccgagctgtcccgctcacagcctccccgatgctgttggcgtagagggcaatcacagtcacttggtactcggtcagtggccggagaccccgcagccgcacactggtctcaccagctgggacgttcacctgcccagggcaagaggtcactttatcttgcccagccaagtccccagccaccacctatcactcctgacatcctacctcctgccgctcactcggcagtggctgtcccagccccgtcagaggagtgtactggaccttgtagccagtcacagggccactggccgctgtccactgtactctcaaggattggctgcttggctcagacagcaccaggtctcgtggagcagaggtcgagtcatccgctgggaatgcgggatcaggggatcaggcaggaggattggggtgggcatgtatgatgcagagttggggtcggggtcaggagcacataggatggaatcagcactgccaagtggggattggggtccggggtctaggtcagggtacaccgtgtgggcaggaactcacgaggtcgggtcacaggcacgccaccagcagtcgtgcacactctccgggaaacgaggggcagtagtgtcctcaagatgctgaagtcattgacgaagaagaagaagtcactggtgggctgtgaggcaactcgcttcagctcctcagggtcagcattcttgatccctgaagtgacgacccatcaggactcagtcacccacatgctctctgactgcccccaccccccagctgacctgtcactcctgctcggtccttacccacagcaaatagcttgaccccctgccccttcagcctttgggcagctgtgtccaccaggtcctgggacttcccgtctgtgatcaggatgcagacctgggacaggtgcaggggtcaaatcacggttcccctggacacttcatttggggtcatcttgggaggcatggtaggggtagggatcaccttggggacaccaggtcgggccagctggggcaggaagacatggtcagccacatggagaattgcagcccctgtgcgagtgttgccccccttgtagctaagctcacggatggcgcggatcacatcacccccagagccaagtgcatccaggccgaactctgtcctgttggagggtaggggtggcaacaggctaggactcaggatctcttctggccctggccttgaggaggcctctagggtgagggttacgggtatcaggctctcttgaggggtcccttcgttctgtcattctccacacccacttgcctctggaacccccaggttaacaaactccccaggggctcctttgtgcaccatctgcaggtgggcctgggcagacctgaaggagcccttaggggctcacagtctgtggggaacaagatgctgcttaattaaataattgcaggaggaggggtccagatgtaggaaagtggatgctggccagatggagcacctctggtgaacggctgcaagggttagagggctagaacgtggagaatccaacaggcgtgggggccccctcctgggctccccatctccagatcagaaaacacagcctcactgtcttgcaccttcctgtcttgcagtagcctggaggtgcctcagggcacgaaggttctacctagggaatccttacctctgtctccaaaggaggtcctggctagggggtctctaggttccccaaaacttgtttctgcaaagacctggcctggggtttccagggtctcctccctctctggggaaggagtcttggtggggatctcgtggtccccagcccccagggcccctactcaccgtgggtcatcgctgtactgcactgtggcaaagcgcacaccctgtgcactggctgctccagagaaaggcagcaccagcccttcgagaaagctgcggacctcgcggaaattgctgcggccaatggatgaggagccatccagtaagaacacaatgtcagcggcgtaaaggcgcgtgcaggtcactggggcgggcaggagagatcagggcctcttctgggaggccaaccacccgcctacccgcacggtggcctcactgggacttgggatggtggggagagtaggcctcatcttatgcaaaccagggccgaatcggcctgagcctgagggccttggagggagttgagctcggtgggtcccagagcagactcccgcggagggttgggggtgtgcgggggagggagagtcgccagcacgggtgtggacttgggactgaggtcagcctctaggggccggcgtggattggcataaggcaggggaccccgcacgcatccagggagccagaatttgggtaggaacaggataggaggcggtttagggaacccagcaccgatcgcggagggttcggggagtcccagaattaggaggaatccgcggggcgtcgtggagttggctgggttgtgggcggggggtgttggggatgaaggccgagtggagcggagggtggcacggtgcagtgccccgggccgggtcctcccttgcggtgcccacctctctccctgtgctgggctcgcactcggggcgcctctgccaggatcccggcgcagagcgcggccaccagaagccgcagcgtcatcctaggcagtaaaagccgtcagctaggacccccgcctctgtcccttgctcccccgtggccttggcaggtccgagcccagcgcccctccagcccgagtcctggtcttgcctgcgcgtccgcccgctcccgccgccgccgctgcagtctctcgggcagagcagagaaaagtccctgatctcggggggcggagcggcaggcgggaacccaggcacccgccctcacccatatccctgagaggtcgccgccccccccacccctcccccagacaaacgatatgacgcacttaactataaaccccccgaccccccgtggcttctgggaatttcccagaaggttctgcatgggcagatgctgagggagtacccctaactccatctaaggtcacaggtcttggctgctttaggtcaatcacagtgaccaggctgaggagtggacaggttcctgcagagccacaaggcagcagcgccgtggggggtggggctgcagttggggatgactcacccccaatccagtgggggtgcccagacaagccctcaggccatgggtcccgccggccactcctgtgattcagccatctgtctggtgggcctcctgggccccacccggatctccttgacaggcaagaagccctggcaaatgagtgactctgggccggtcttagggaaaccaaggtccccttggcctggatccaagtaactcaccccctctttgtaggggataagccggaaggaggagagaacctgtgtcatgcttatgcatacatcccagtgtcccacatcccctaccatgtcacaggcagatgcaatccagctgtgcctgcagggagggggccgcccatctgtggagggcgggaccacccacagtgacagctcatctctcaggaatcgagccctccatgccccaggccaggtccccctacctacatgtcctcacccacaggcatcctctccttccatctacttttcttgtaggtccctgccacccatctcccctaccaggccgaggtccccttgggccccttcctcctttcctcactgccctcatggtacctgtagcttccagcttcataactgccccctaccttactcctgtccccttacccaggctgacttcacaccctcccccagcttcgcttctgaggctgtggacagtcctccaacacacaccacgccagggccactgtccgaaggaggtggggctctgtatatgcatatctctccattagatgggtgacactaaggcagagaggcactgctaagaagggcaggcccccatctgggtcctgctccccctttttttcctgctaatcctgaataactctgggcagcccagaaagcacatctatactcaccaaggctgctgggccccttctaatatgcccggccccacagcctcccctgggatccacagggagatatggggacagcactggctggactcctccacagcccgaggactctggtgtggccagagctggaggcagtgaagaccatccatgctgcctgctttcctattgcccaaggaaggctggggctctatcccttattactgaccccccaaactatcctggggcatagtgctatgaccttattccaaggtcagggtctcctcagccatgtcccaggaccccccatccctgcaaggtgtgctccaggtggggggctgcagagaaccaggtatgttatcacacaggcagccccttccccctaagactgtcacctcctcccgtgcagccagggcgggcaagagcaggccagtggcatggacagtacggtacagacatatgtgcacacgtgggccagtcttaggggagacaggaggcccagctgggagggtgggtgctcaggcaaacctcatcagaattgaggtgcctccaaaagaaaggacaggctgctgtgagagggtctctcaaagggtgctgggagaggctgttgagaaggtaggagtaaggttggaatgactccacgtctggagcttctatgagactcacgagcaggagtgtggccctctgaagccccagctctggcctcctgggaggaacacagcctagggcacagcccgaggccagtgcctacctgcaaccccatcagggcggtggagcccccagagcacatccttctccctcccaagctttccctgaacatttccttccctggcctcagtcactacctcaccccatctgtttccaaccagggcctctttatcaggtcccagccccacacatcccactgtaccctggacaccaccaaactcctcactggactatggaagattaccctcctccaacccactcgtgcctccgcgtctcccagccctgctgggaatgtagtcctctttgtgtcccctacagctggctccagttcgtgtggccatgacctctgttctgccacagcacagctcaccaagactgatacagaaatatggcctgagagtccccatgctgaatctcaactctgaccaagtcacttctcttcacagtaacctccaacacacctccccagcatggctccagggtaaagaccagagtccctggcttggtacgcaaggtcccttagaaccagaccactcccagcaactcaagctctcgtgtccagcacacctgtagcctctaagggccaggctgggcttagaaatgaagccccatcctccaggagctcaaacttgacaacagacttggcacttgttcccctgcctgggtgttgcacctccatgagcacccagggttgggcctgtcagggttctgcgctgcccagcatcttctctccagccgttcacaaagtagaatgatctgcgcaatgccccagtcccgggccgtagaaggtgcttaacaaatgtctccgaattggcaacgtatggcaaccaatggtgagggaaaggcagtggggcagggtgatagtgatacaagggttccttgggctacttccaagctacgatgctggggggacttctgaacagccatcttctaaaagaccttgtcccagcaccctgcttgtgactgccaggcagcgacttcctcaaaggaaaattgggcccctcgctttcaacttccccctgggatcccagagaacctgactgtggaagcactggggggtgcaggaggagcagcctacctgcgcacccaccatggggaccagagccaaaagagataacagagggactaggtagctaagagctgtaccaggtcctggctgcctcaggaaaatggggaggggattgtcaggccagcagctctggacttgcctgggacaaatgtagtagagggagggggctcgggccccactgagctcagggctattcttggagcctgagtcagcggaggcaaaggattcctgccctgcttgtccaggcagcagttagaaaccaaatgagaacactatgccccaggctatcctcctcccagaatgcagagtaaacacacacaagaggcatccttggagacaccccttggccccttctggtccaccagggaccaccagggggtgacttggcacaaggtccacagtgaggggtttcccacctgagcctgcagggattccaggctgggactcctacaggggcaaaggctgggtttacacttcctatggactcccacagcccaatcttgggaccagctggctgaggaactcccctaagtggctgagtggaaacatctgggctcagctccctgtaggcatcaaagacttccggcctcagctgcaacccccacgcttgcccctggctgaggacacatcagcctgtgggaaggcaggaggatccaggagccacagaactagagggaagtccttgctccccatctactgccccatggactcc

SEQ ID NO: 336 - DNA, 28992 bp, Homo sapiens
aatccatattatagttaaatatttatttggagtttactgtggactaggtattttacatcatagtaagcaaagtttcccaaatttaagttctttttatttctcattcatgacttttggcctgttctcatactacctattcattgtaacttttaaacttgaaagtctctttcaaaataaatgaatttatacttttaccataaatggaaatctagtaccatttttatgaatagaagatattatgaaggaatacaataaaaacaattttataagtctgggcatggtggctcacacctgtaacctcagcacttttgggggcctaggtgggaggatcacttgagcccaggagttcaagaccagtctggacagtatagggagacccccatctctataaaaaataaaaataaaaaaatcagctggccatggtggtgcatgcctgtggtctcagctaatctggtggctgaggtgggaggattgtttgagcctgggatgtcttgattcataaacacatgaagatgactaaaatctccttttaaatttgtttatactgctttttcttctatggctttctttttttcatagatcatgtcaatataaacacatactgagaaccaggagtttgagtgattctatatgaatgactgtatactatttaaattttgatgaactacagagtagtttgagcctaggaggttgaggctgcagtgagccatgattgcactatggcaacccagccaggatgacagggtgaaaccctttctcaaaaaaaaagttatgaaaaatatggtttcctgccaaactcataattactcctttattaaaaagggcaattagccctttttatgcaaggtgcttaaaaataaactagcacctcatttagatactctccttacgtaaataaaaaagattgaagaggagttgaaaaaagatttttttcctatgtgattgtttacttcagtatttgtatgtcatctaaaatggtgatataggacctgcattaaagtgttccacctgtattagtttgttaggcaatttatttaatcagaaaaaataaaataaatttacaatttaaaaatattttggaatttacacctgccacaaaatgagacagtttcttcgttcagatttcttactcatgagcaggcatcaattggttggaatcagagaggtttcttacctttaagttacaattgctttcctttgagttgctgtcacaaatctactgtcccccaagtagtttaccttatttcaaccataaatcatacaaaaatttacctatgaaaatttggatattattgtagataatactgtagaatttgctatggtttaaatttttaagagctttgaggtgcataaaaatacatctaagtgtacattgatttttagtaaatttatagtgttgtgcatccataatcacagtctagttttagaacatttatatcagccttaaaaagtactatgcccatttgtcatcaacctcttctcccattccagccttagaaaaccttggcctactttttgtccatttgatttagctttcctagaattttcatatcattggaatcatatggtatatggtcatttgtgtttggtttttatttagcataatgtttttgaggtgcatccaggtcataatatttcttttttcaaaatgtgtgtaaactaagggatacaagtgcagtttttttacagggacatattgcacagtggtaaagtctgggcttttagtgtaatcatcagctaaagaatgtgcattgtacacataagtaacttcttatcctttatccccttctcatccttctgagtctggtatctgttattccacactctatgtccatgtggtagtattcctttttgttgctgaatatttttccattatttgcatatgccgcatttctatctccattcaccagttgacaggtatttgagtcattgtgaataatactctcattttgaatgattgtgagtaatactgctgtaaacatttgtatacatgtctgtgtgtggataaatgttactcttctagagagatacctaggagtgcaactactaagtcatatggcaagtttaacttattggtaaagtgcaaaactttgttccaaagtgactgtagcattttacaaccccaccaataatgtatggaagtttctgtttctccacacccgttctagagggtttgtagtggtgtcttatttgtggctttaatttggtgtttttctaatgactaaaaaatgtttggcatgatttcatttgcttattagctatttatatatcttattccatttatatatcttattagccatttcgctatacctatgtagttaattatctattcaaatcctttgtccatttaaaaaaaaaacagtgatctgatcttgggtcactgcagccttgaactcttgggctcaagtgatccttccaccccagcctccctagtagctgggactacagatgcccaacagcatgcctcacttatttaaaaattttgtagagacagggtctccataagttgcccaggctggtcttaaactcccatcgtcaggctatcctccgaaagtgttggaattacaagtattagccatgatgcccagaccatttttgtttaagtggaatatttctcttattattcagttgtaagagttctttatatgtcttgatacaaattatttagcagatatatacttcgcaaagttctgcagcattaagtacattcacattatcatgtaaccattaccaccatcagtatccagaactttcattttcattttcccaaactgaagcttcgtaccctgtaaatggtaattcctggttttctcatcccatcagtccctggaaactactattgtattttctgtctttatgaatttgatttgtgtgggtacctcagacaagtggaaccacacactatttgtctttttgtgattgacttattgcactcagcatgtcttaagttttatccatgctgtagcatgtaccaaaatttccttccttcttaaggctgaatgatactccattgtatatgtacatactgcattttgttttattcattcatctgttgatggacacatgggctgcttttacctcttggatattgtgaataatgctgctgtgaacatgggtagacaaatatccagatccctgctttacttcttttgggtacatacccagaagtggacctgctgtttcatttggttattctataggttttttttttttttgagaaattttgcttttttttttaatgttaagaaattgccacatactgtgtttccacagtgtacatcattttacattcttaccagcaatacagtggttccagtttcttcacatccttgctagtacttgttttctgttgttttgatgattgccattccattgggtccaatgtggtatgtcatggttttggtttgcattttcctaatggttattaatgtcgagcatcttttatgtacttgtaagtcatgtgtatgccttctttgaaagtgtccgttgaagttctttgcccattgtttttcttgggttattttttgttgagttgtaacgcttcatgtattctgggtataatcctttatcagatatgtggtttctaatacagttatgctccatgtaatggcagtttgagatgttcctgtcaacagactgcattatatgatggtggccctataaaattctaatggagctgaaaaattcttcttgcctagtgacaatagaaattttatatagtgtaatgcattactttttctatgtttagaagtatttagatatagaaatatttaccattatggcacaattgcttatgtattcagtatagtaatatgctatataggcttgtatcctaggagcaatagggtataccttatagccaaggtgtgtagtaggccataacgtctaggtttgtgttaagtacccactgtgatgttcacatgatgacaaaattgcctagtgatgcatttcttggaacttatcccctcttgttaaagtgacacgtgactgtattttcttctgtttcaagggttacatttttactctctttgtagtagccattgatgcacagcattttcaattttgatgaagtctgtcttacctatttttttttgttgcctgtgctttcagtatcatatccaagaaattgttttcaaatccaaagtcatgaagtttttggcttgtgttttcttctaagagttttatagggtgaggtcttctgtttagagttttgatcactttgagacaatttttgtatatagtataagataagggtccagctttatttttttacatgtggatatccagttttcccagcactgtttgttgaaaagactttctttccttttcccctttgaatggtctaggtagccttgtggaaaataatttgactatttatgcaagagtgtatttctggactctgtgttttattctgttggtctatatgtgtatccttgtgccagtacgacagtattttgattgctgtagtcttctagtaagttttgatgtcaggaaatgtgagacgtccaactttgttattttcaagtttgttttgtctattcgaggtctcttgggaatccatatgaattttaggatggatttttctgtttctgctaaaaatgctgttaggattttgaaaggacttacattgactatgtagattgctttgggtagtattgacatcttaacaatattaaattttctaatccatgaacagaggatatcttttcatttatttgtgtctaatttctttcagtgatattttgcagttttcactgtagaagtcttttgcctgcttggttaggtttagtcctaagtactttattctttttgatgttacggtttgctgatttttctgtgttgattttgtattctgcagttttcctgaattcattcattctaacaggtttgttgttgttgtggaatctttagagtctttacatataagatcatgtcatcttcaaacatataattttacttattcatttccaagttagatttattttatttcatttccttgctgattgctctggctagggctttaggtattacgttgaatggaagtggtaagaatgggcatctttgtcttaattctgacctttgaggaaaagctttccatcttttcaccattgagtttgatgctggttacaagttgttgttttgttttttgtttttgtttgtttgttttttgtttgtgtgtgtgggggtgggtggtggtggtggtggtggtggtggtggtggtggtgatggtggtggtggtggtggtagtggtagtggttttttcttgctctgttgcccaggccggagtgcaatggtgtgatctcggcttactgcaaccgccacctcccgagttcaagcaattcttctgcctcagcctcccaagtagctgggattacaggcgcccgccaccatacccgactaatttcttgtatttttagtagagacagggttttgccatgttgttcagactggtctcgagctcctgacctcaggtgatccacctgtctcggcctcctgaagtgctgagattacagctgtgagccatcatgcctagccaggtataggttttttatatatggcctttttattatcttgagatagtttgcttctattcatagttttttgagtatttttagcatgaaaggatattgagttttatcagatgttttttctgactcaattgaaatgattatctgttggtggacacttaggttgattccatatctttgctaatgttaacagtgtggctatgaacttgggggtgcaaatatccctttgatgtatttattttgtttcttttggataaatacctaacagtgggattgctggatcatatggtagttctatttttacttttcgagaaatcttcatactgtttttggtaatggctgtactaatttatatttccaccacaggagttcccttttctctgcattctcatcaacatctgttatgttttctttttaataattgctattctaactgggttaagatgatatcttgtggttttgattttcattttcctgatgattagtgatgttgagcctcttttgatgtacctgttggccatccatatgtcttttgaaaaaatgtttatgtcttttgcccactttttaatgggaatgttttgttttaactgttgagttgtttgagttccttgtatattctggtttttagtttcttgtcagatgcatagtttgcaactattgtctaccattcaaaaggaaggttatttctttactctgttggattgtttcctttgctatgcacaaaacaagtctcaaaacattttaaaactctgggaggctgaagtgggagaatcatttgagccagggaggtaaaggctgcaatgagctatgattgtgccacttcactccagcctggcaacagagatagaccctatcttaaaaaagaaaaaaaaaattaaactcaaaactatatcaagtgtcttcttagaccacagtagaatcctcaaactagaaattaataccaagaggaacttagaaaactgtctaaataaatggtaattacatagaatactcctgaatgtccattggttctttttctgctcctttgatcttgtctttgccttctgtaacaccaaaaattcaaatagatcactttatggtgtcccatatgtcatgtaggctttgttcattcttatttattcttgttttgttttctgagttatttcaaaaatctgaaattcattcttctgcttgatatcatccattgctgaagcacttgaatgtattttttattccacttagtgaattcttcggtttgaggatttctgtttggttccttttttatgatatctatctttttggtgaatttttcattcatatcttgaattgtttttctgatttctttgtatttttgtgttctctatctcactgagtgtctttagtattattttgaatcctgttgctggcatttcataaatttcttttttattagaatctgttgctggggaattattgtgttcctttggagatgtcataatttcttgttttttttttttcacattacttgtatacttacaagttgatgtctgtacctctggtgtaacagttgcttcttccagttttttagattggctttcagagaggtagactttttcctgaagatctatccgtggtgttggttgggtagggcaccttgtctttgattctgggtgtgtgcagtagtgtatttttcatatgacctttttagccatatatagcattagtggtgtctgtgatttcctcagtggtttagggtgcaattgttagcagaggctgaggtgaagttctcctgggcagtgggatgctaggtaggccagtccttgggcaccagtggtggcagcagcagactgtgtgcctgtccttcggccccagggtacacaggcatggtgttagcaggtttaattgggttgattcttaggcctccatatggcttgcttaggtgctggtggttgcagtggatgaccaggtgagtgggtaggtccttggatccctgggcagtgcatgtggtatgggctatggcagtagttgtgatggtagcatcaggctgggtgggctgactctcaggcttccctgtaggagtgcgtatgtgtgagtggcagacagggtgaggcaatctctatgctccaatctctatgcttgggcccttgggggtatgtggtgccaggccaggtgggcctgtcttcaggccccctggtagagtgctcaggtagcaacagtggatagagagagccttgcctcagggcatgtgcatgtccactgtggccctgctactagaggggatagggttggtgtcggtgtcagtagcctcacaccagaggctggggtggggcaggtatggtatgctttgctccaagcagtgtcaggaacattgacactggcatgctgggagattctgtcctcaggacatgttcaagtgtgctgcagtcttgctgttagtggagatggggttactgtcagtggcagcaaccccaggctagcagggtttaggctctcagaagtgtacgctttggctctttttgtccttgtgatagcctccccagtataccctccccagtgcattgcacttgcctgttctccacagtgtaggattttatatatgctttaataccagggactctgccactctgctgggtccaagtggcattgcatcactgtaggcccccaggtggatgcagggaatgttagtagggctttactaatgtggaaatgcagggactcttgtgctcaagggcaggatgcagcctgttaagagctggactgaaaatgacaccatgctgtaactgtttaggtctcatgcaggtggtacaggacccagtgtgagctctctctctggagcagtgtcatcacatggtctctaagaagttctctatgctagtctctggaccccctctctgtaagctagggttgcaggagtccgtggtgggagtgtgagctgctgggtatctctcatttacctttcccccacactggagatctgctctgtgctccaggtcgataaaggccaagcaaacaaccttgcttccctcttcttccttgctttaggtgtttcctgtcacttctctgctaaattccagtgttgtgtcttagatgttctgttgaaagtgtgactcctccctgtttgggttttttttttgtgaaggaggcaagggctgatgtctctagtcagctatcttgaagcccctcctctatttttgctgttgttgcctgtgcttttcaggtcttatccaaaaaattccttgctcagaccaatataatgaatcatttcctttatgtttttcttccagtagtttcatagttttgggtcttacatttaagtctttaatcttttttttttttttttttttttattgagacagtctcaccctgtccttcattcttgagtgcagtggtgtgatctcagctcacttcaacctccacctcctgggttcaagtgattctcctgcctcagcctcccgagtagctgagattacaggtgcatgccaccatgcccagctaatttttgtatttttttttattagagatggggttttgccatgttggccaggttggtctcgaactcctgatctcaagtgatctgcccacctcggcctcccaaagtgctgggattacaggcatgagccaccgcacctagcctctttaatctattttgaaatgagttttgtgtatagtaagataagggtctaatttcattcttttgcatgtggctatccaggtttcccagcaccatttattagattatcctttctccaatgtgtgctcttggcacctgttttttgaaaatcagttggctgtaaaagcatggatttatttctgggctattttgttccattgttttatttgcttttattgccagtaccatggtgttttggttaatacagctttgtagtatattttgaagtcaggtagtgtaattccactaactttgttatttttgttcaagattgctttggctatttgaggtcctctgtggttcagtatgaattttaggcttgtgttttccactgctgtgaggcatatcattggtattttggtagggattacattggatctgtagatcactttgggtcatatggacaatttaacagtattaatttttccaatctataaacatgggatatctttccatgtatttgtgttttcttcattttattactgtttcatagttttcattgtagtgatcttttacttcttcaattaaattttttgttctttgggtttttttatagctattaataagtgggattgttttgttgatttcttttttcagctaattcactattagtgtatagaggcattactggtttttgtatattgattttgtattctacaactttactgaattattttgttctaccacttttttggtggcatctttagggtttctatatgtaagattgtgttacctgcaaatagtgttaatttgacttctcctttccaattaatttggatactttttattcttttttttttcttgcctaattgctctggctaggatttccagtactgcgttgaataaaagtggtgaaagatagtatccttgtcttattccagattagaggaaaagatttcaacttttccttattcagtagtgttagctatgggtttgtcatatatggcttttattgtgttgagttacattctttctattcttaatttgttaagagttgttgtcaagaatagatgttgagttttgtcaaatgctttttctgcctctcctgaaatgatcatggggtttttgccttttattctgttaatgtaatatatcacatttattgatttgtctgtgctgaaccatccttgcattcctgggatcagtcctacttgatcatgatgaattgttgaatttggtttgctaccattttgttgaggacttttgcatctgtgttcatcaggtatttatttttgtgaatgttgacgtctagttgtttgaatactattcattgcaaagactgtcttttctctgttgtacttcctttccttgtttgttaaagatcagttggcatatatttgtgtgtgtctatttctgggctctctattctgttccattgattgatttgtttattattttgttaataccacactttcttgactactttagctttatagtaagtcttgaagtcaggtaatgccggtcttccaacattgtcttctccagtattaagttgctagtcttggtcttttgcctctctgtatcaactttagagtgactttgttgatagccagaaaataaattgctgggaatttgattgagattgtattaaatctgtatatcaagttgggaagaactgacatattgtgacagtattgagtctttgtattcattaacatggtatatgtctccatttatttttttctttctttctttctttctttctttttttgagacggagtttcactctgtcacccaagctggagtgcaatggcgcagtcttggctcactgcagcctccgtctcctgggttcaagtgattctcctgcctcagcctcccgagtagctgtgactacaggtgcacaccactacgcccggctaatttttgtatttttagtagagatggggtttcactgtgttggccaggttggtctcaaacttttgacctggtgatctgcctgcctcagcctcccaaagtgctgggattacaggcatgcacaaccacacccagcctgtctccatttatttagctcttctttggtatctttcattagtgttttgtaacttttttctatagataaacgtattgtgttacatagttttttaaaaatgctttttacattttttatgtttttgagacagcatcttactctatcacttaggctggagtgcagtgacatgatctcagctcactgcaacctctgcctcccaggctcgagcaatctcccacttcagcctcctgagtagctgggactacaggtgtgtgccaccatgcccagctaatttttgtattgttttgtttgtagagacaaggtttcaccatgttgcccaggctgcaagtgtgtattttttgtttttgtttgtttggtttcttttttttggaggtagagtctcactcttgctacccaggctggagtgcaatggtgtggtcttgactcactgcagcctctgcctcccgggttcaagcgattctcctgccacattctcccgagtagctgggattacaggtgactgccaccatgtccagctaatttttgtaattttttagtagagacggggtttcaccatgttggcgggctggtctcgaactcctgacctcaggtgatttgtctatcttggcctcccaaagtgttgggattacaggcgtgagccactgtgcccagctttgtttttgtttttgagattcagtttctgttgcctagggtggagtgcagtagcgcagtctcagctcactgcaacctgtacctcccaggtttaagcagttcttctgcctcagcctcctgagtagctgggattaatttttgtatttttagtagagatgtaaccacacctggctaatttttgtatttttagtagagatgggtttcaccatgttggccaggctggtcttgaactcctgaccttaagtgatctgcctgccttggcctttcaaagtgtagggattacaggcatgagctactgcgcctggcctgcaaatgtgtttataatgacaaattccacttttttattgctggtatatagaaaatttattgacttttgtatattaatcttggatcctgtaaccttgctatagttacttattctaggaggatttttgggtcaattctgtcaaattttctacatagatgatcacattatctatgagtaaagacagttttatttattccttcccaatctctttaccttttattcctttttgtggtcttattgaattagctgggacttccactattctgttgaaaagctgctgtgagtggagacatccttcccttgttcctgatcttagcaggaaagcgttgagctgtaggtttctcatagatcttctttatcacgttgaaaaaatttctttctattcccgagaggtttttttaaaatcatgaatgagtgttgttctgtagtttgctcagtgttttttgtttatttgttttgttttatggagacagagtctcgctcttttgcccaggctggagtgcagtctcacaatctcagctcactgcaacctccacctctcaggttcaagtgattctcctgcctcagcctcccaaatagctggcattataggcgcctgccaccacaccgggctaatttttgtatttttagtagagatggggtttcaccatattggccaggctggtcgcaaactcctgacctcaggtgatctgccaacctcagcctcccaaagtgctgggattacaggcatgagccgtggcgcccggccttgctcagcgtttttatcttggttgttagatttgttaagtgctttttctgtgtttattgaaataatcatgtgatttttctgtagcctgttgatgtgatggattatattaattgagttttgaatgccgaaccaggcttgtatttctggggtatatcgtatttggttatggtgtttaattttttttaataccttgttggatttgatttgctaatattttgttgagaggttttatatctatgttcataagagatgttgatctgtagtgtttttttgtttttgtttttgagacagagtctcgctttgtcacctaggctggagtgcagtgttgttgtgatctcggctcactgcaagctctgcctcccaggttcacgctattctcctgcctcagcctcctgagtagctgggactacaggcgcctgccaccacgcccagctaatttttttgtatttttagtagaaacggggtttcactgtgttagccaggatggtctccatctcctaaccttgtgatccgcccaccatggcctcccaaagtgctgggattacaggcatgagccaccgcgcctggcctgtagttttcttttcatgtaatatccttttctgattttggtattaagggaatgctggactcaaaattaggaagtactcctgcttctatcttgtggaaggctttgtaaagaattggtgtaatttctcccttaaacgtttggtagacttcacctatgaacacatttagtcctggttctttctgttttggatgattattaattattaattcagtttctttaataatacaggcgtaggtttaggtctttgttttggttgatatgcttgcaatgttgaaagccgatagtttaatatcaatattgtcttttattttactgtaaaaatactttgaatactctgttatcttaaattttatttgtgtatttttatgagatattgataaaaaatacaacttttttttttttttaatcacacagcctagtgtgttaattgtaacctacaaggagcctgcaaaatcatctactcagtttggatcctacaagcaagctgaatggaggccagatagtaccatgatagctgtatcagtaagtagattttaccgctaaatagtgttttcttatgaaatcattacatcgcatttaaatttgattctcttagatgactttctttcagtcttttgcactcataagtatttattttattctgataggaattgctttactgattattctatgtggattactcctactatagcttttcttctgactctgctacttccttaacaaagcacctatatccctaaacatagcacctgtatccttttctgtttgttgttctcactttactgttttgcccttgaagtctaactgctttactaattattctgtgcgtgttactcctactatagcttctgttttgactctgctgcttccttccatccctaaacatagcacctatatccttttctgtttgttgttctcactttactgttttgtccttgaagtcttatctagttttttaaaacatattcacatgatattcttgaatttatatttaaattcctcccttccattccaaaagatattccagaaaataataagctttatgtgcatatgttatactaaaatttccatatccatttggatctgtttctcctttttttcttctgttctattaaacgtgcctagatatgtttaattttaccttttcagttcatgtttcatcactgtctaaggctgtcattatgacttaatatgcattagcagtaatatatgtggttaattaacattattgagcacctcctatccgatgagtacaattgtaatcagtttacatggatcatcccatttaatctttagataagtgctttgaagtagatattattatccttcataatggatgtgtaaattgaggatctgaaaaattgtcttatccaaggttacatgcgtagtgtatattagagagataaggtataaacttagctactcagcttccatttactatatccttatatctaatttatctctttgcgttggtccctttctagtccatactgtatataacactgactaggttaatagtctgaaatgttcatatgatgaaaaatactgagtagttctacgcttcctatagcaggagtttgcagatgactgaccatgtaccaaatatgccctggtgcctgtttgtacacagaccataatgtaagaatagtttttacatatttaaataatcaaaacaagtcaaagaagaatatttgctacagttgaaaattatgtgatacttaaatttcagtgtccataactaaaattttactggggcacgaaaatcctcactgatttatgtattgtctgtaacttctttcaagctacaatagcagattgaattgaagttcttacagcaagtgtatgtggtgctctcattgctttgctcttctgttcaatgcactgtgtagtaacacagttgtaacttcataacatttcaagtgtacacatattgccattctgtgacattttatattatttttattctagtacatactcatgtcaaaagaaccaaagaagacaaaaagactttgttttgtttttaaagcacactgtagtgtggtttcttttattattgaattagatggcaaaatattgtatttattattcaatggcactatagctatgccaaaagaatataagctgacatcactagactaagcacttatcagaatgtactgaaggttaagttagaagaattaaaaaatttagcacagaacagctcaccacaaaattccttcacaaaaataaaatatgaaaatgaaagtgcagtaaaagtaagtttgcttagtttttgataaattgacagatgttataatactgctcagttgtaaatttcagtggtccatgtgaagtatgaattgactaagaattactgtgaatgacctgcagaacaattccagatgaaaaaaattctcaaaggagttgagaaaatactaattcagtacaacccgaagtagaatctaagaagttgtattaattgatagtagtaaaaatccacatggagcagcaaaagacttagttggacagatttacaaagtttgtgaaaatataagacttttaaaacctatggttagtgtaagttttttcagagatggaagcaggaatatcttgaattgccctcctccacagctgttatggcttgggtagtgataaaagtttattggaaagtttttttgtttttttttttaccgagactgacttttttttttttctttacttgaaggaccaccatctaccacttaacagacactaaataactttggaaaatagcttttgctgtattagaaaatgttttcaaatatgaattatgtaaaatgtcattaaggaccagcattaatagatgaaaatttgcactcaattttgatgatagggaaaagtactttaaaccccaatttaccaaaaaggttatttccacaaaaagaatctaattctcattagtggatgtatattaccaaaaaaagttgtactttatgttaaatgttacagtacaatatgttaaagaactattcttttcccattgaacggtcttggtagtcttgttgaaaatcaattggccattggtatttggggttatttctggatgctccattctgtttcattgttatatatgtctgtccttattccagtaccacagtttttaaattactgtggctttgtagtaacttttgaaatcaggaagtggaatcctccaattttattgttgtatttcaggatataagtcatgtcaacccattgtcaacccattgtaagttgaaaataccataagtaaaaaatttaacagccccaaacatccatcataatgtcgtaagttgaaccatcataagttcagtatcatctatagttttgactattctgagccagtccctaagatgctatatgactgtttgaactggttttctatttctgtaaaaaataccattgggaatttggtagagactgcattgaatctgtagttctctttgggaagcattaatttaagtcttccagcctatgaacatgcaatgtcttatcaattatttagaccttcaatttctgtaaggagtgttttctggtgttcagtatgcaagtctttttcctgcttcattaaatttatttttaagttttaaatttctttttgatgctattgtaaatggaattgtttttaagtttccttttcagttgttcattccaagtgtgtagacatatatctgattttttccaacttaacttcagggtacatgtgtaggatgtgtgggtttgttgcataggtaaacatgtgctatggtggtttccttgcacagattatgccatcacctaggtattaagcccagcatccattagctattcttccagatgctctccctcatcctgcgccctgcccctccatcctctaacagaccccagtgtatgttgtttcccccatgtgtccatatgttctcatcattcagctcccacttataagtgaaaacatgtggtatttgattttctgttcctgtgttagtttgctgaggataatggtttccagctccaaccatgtccctgcaaaggatatgatcttgttcctttttgtggctgcatagtattccatcgtgtatatgtaccacatttcttttattcagtctatcatcgggggacattcaggttgattccatgtctttgctattgtgaatagtgctgcagtgaatatatgcatgcatgaatgtttgtaatagaatgatttatattttggggggtatacccagtaatgagattattgggtcaaacggtatttctgcctctaggtctttgaggaattgcctactgtcttccataatggttgaactaatttccactcctaccaacagtgtaaaagcattcctttttctccacaacctaaccagcacctgttgttttttgactttttagtaatagccattctggcttgtgtgagacggtatctcattgtggttttgacttgaatttctctaataatcagtgatgttgagctttttaaaatgtatttgttggccacatttatgtcttcttttgagaagtgtctgttcatgtcctttgcccacttcttaatgggattttttttttcttgtaagttattaagttcattgtagatgctggatattagacctttctttgtcagattaatagattccaaaaatttgctaccattctgttgtttatctgctcactccaatgatagtttctgttgctgtgcagaagctcttcagttcgattagatcccatttgtcaatttttgcttttgttgcaattgcttttgtcatccttgtcgtgaaatctctgcctgtgcctgtgtcccaaatggtattgtctagattttcttcctgggttttacatttaaatctttaatcaatcttgagttcattttcctttagggtgtaaggaaggggtccagtttcaattttctgcatacagctagccagtactcccagcaccatatattacatggggaatcctttccccattgcttgtgtttgtcaggtttgctaagatcagatggtgtaggtgggtgttcttgtttctgggttctctattctgttacgttggtctatgtgtttattcttgtgccagtaccatgctgttttggttactgtagccctgtgttacagttttaagtcaggtagcatgatgcctctggccttgttctttttgctttgattgccttggctattcggactctttgttggttccatatgaattttaaaatagcttttttctaattccgtgaagaatgtcagtggtagtttaatggggatagcattgaatctataaattactttgggtagtataaccattttcacaatattgactcttcctagccatgaacatggaatgtttttccatttgttcgtgtcatctgtcatttgtttgaaagttggtttgtagttccccttgaagaggttcttcacctcccttgttagctgtattgctaggtattttattcatttgtgaccaactgtgaatgggagttcattcatgatttggctgtctgcttgcctgttgatgtataagaatgctaatgatttttgcacattaattttctatccttagactttgctgaagttgcttatcagcttacaaagcttttgggctgaggcaatggggttttctaatataggatcatgtcatctgcaaacaaagatagtttaattttctctcttcctatttgaataccctttatttctttctcttgcctgattgccccagccagaactgccaatactatgttgaataggactggtgagagagggcatccttgtcttgtgccttttttcaaggggaatgcttccagcttttgtccattcattatgatattggctgtgggtttgtcatatatgactcttattattttgaagtatgttccttcaatatctggtttattgagagtttttaacctaaagcgatgttgaattttattaaagaccttttccgcatctattgagataatcatgtggtttttgtgttcagttctgtttatgtgatgaatcacatttattgaattgtgtatgttgaaccagtcttgcattccggggatgaagtctacttggacatgatggataaactttttgatgggctactggatatttgccagtattttgttgagaatttttgcattgatgttcatcaagcatattggcctgaggttttctttttttttgttttgtctctgccaggttttggtatcaagatgatgctggcctcatagaatgaattaaggaggaatccctaattttcaattgttttggaatagtttcagtagaaataataccagctcttctttgtacctctggtagaattcagctgtgaatctgtctgtcctgggctggtttttttttttgggttgctaggctctttattacttctcaatttcaggactcattattggtctattcagagattcagtttcttcctggttcagtcttagggagggtgtatgtgtccagaaaagtatccatttcttctagattttctatttaatgtgcattgatgcatttatagtattctctgatgattgtttgtatttctttggggtcaggatgatatcccctttatcatttctgattgtgtttatttaaatcttctcttttcttctttattaatctagctagcagtctatgtattctattaatttttttaaataaccagctcttggattcattgatcgtttgaatggtctttcatgtctctatctccttcagttctgctctgatcttggttatatcttgtcttctgctagcttttgggtttgttcttgtttctctagttctcttagttgtggtgttaggttgttaacttgagatctttgtagctttttgatgtgggcatgtagtgctataaatttccctcaacactgctttagctgcatcccagagattctggtacattgtctctttgttctcattagtttcaaaggacttcttgatttctgccttaatttcattatttactcaagtcactcaggagcaggctgttcaatttccatgtagttgtgtggttttgagtgaatttcttaattcttctgagtgaatttttttgagtgttgtggtctgagagactgttatcatttcagttcttttgcatttgctgaagagtgttttacttccgattatgtgatcaaatttagagtaagtgccttgtgatgatgagaacaattagtttctgttgttttaggatggagagttctgtagatatctgtcaggtccacttgatctagagctaagttcagatcatgaatatctgttaattttctgtcttggtgatctgcctaatattgtcaatggtgtgttaagtctgctactattattgtgtgggagtctaagtctttttgaaggtctctaagaacttgctttaggaatctgggtgttcctatactgtgtgtgcatatatggaggatatttggcgcttattaaattgaaccctttatgtaacgccctttgccttttttatcttttttcatttaaagtctgttttgtgagaaactaggatcgcagtccgtggttctttctgttttccatttgcttggtaaattttcctccatccctttattttgggatgtgtgtctttgcacatgatatgggtcttttgaagacagcataccgctgggtcttggttctttatttagcttgccattctgtgtcttttaattggagcatttagcccatttacatttaaggttagtattgttatgtgtggatttgatcctgtcatcaagatactagttggttattttgcagacttatgtggttccttcatagtgtcactgatctgtttacttcagtgtgtttttgtagtggctggtaatggtttttcctttccatatttagtgcttccttcaggagctcttgcaaagcaggtctgatggttacgaattccctcagcgtttgcttgtctgaacaggatcttgtttctcctttgcttataaagcttagtttcgccagatatgaaattctgggttggaaattctttactttaagaatgtttaatattggccaggtgtggtggctcacacctgtaatcccagcactttgggaggccaaggcgggcggataacgaggtcaagagatcgacaccatcctggccaacattgtgaaaaaccccatctctactaaaaatacaaaaataattagctgagtgtcgtggcgcatacctgtagtcccagctactcaggaggctgaggcaggagaattgcttgaacccagaaggcagaggttgcagtgagctgagattgcaccactgcactccagcctggcaacggagcgagactctgtcaaaaaaaaaaaagaatgtttaatattggccccaatctcttctggcttttagggttttcactgagaggtctattgttagtctcatgggcctccccttcgtaggtgacctggtctttctgtctgactgcccttaacatttttctttcattttgaccttgcagaatctgatgattatatgtcttggggttgatcttctcagggaatatcttactgaggttttctgcatttcctgaatttgaatgttggcctgtcttcctaggttggggaagttctcctggatgatatcctgaaatatgttttccaacttcgttccattctccccatctctttcaggtaccccagtcagtcttaggttcagtttatttacataatcccacatttctcagaggttttattcattttcattcttttttctctattcttgtccgcttatcttatttcagcaagatagtcttcaagctctgagattcttttctccacttggtctattctgctattaatagttgtgattgcattgtgaagttcttgtagtatgtttctgagctctaacaggtcggttatgttgctctctaaactggctcctcctagtattgtcagtggtgtgttccagtctcccactattattgtgtgggagtttaagtctctttcaaggtccctaagaacttgctttgtgaatctgggtgttcctacattgggagcgtatatattgaggacatttagctcttcttgttgaattgaaccctttattgttatgtaatgccctttgtcttttttgatcttgtagtgtgtttctcagctctaataggtcagttaacttcctctctaaactggctgcttatctctcacattgtcagtggtgtgttaaagtctcccactattattgtgtgggagtctaagtctctttgaaggtctctaagaacttggcacgtcctgtattgttttgtcatgtttcttactttgcattgggttaaaacttgctcctttagctcagtgaagttcgttgttacccaccttccaaagcctacttctgtcattcagctttctcagcctcagcccagttgtgagcccttgctggagaggtgttgtggtcatttggaggagaataggcactctggttttttgagtttttagcatttttgcattgattaatttcttatctttgtgggcttatctgcctttgatctttgaggttgctgacctttgaatggggttttttgtagggtcttttttgttgatattgttgttttctgtttgtttttcttttaacaggccactcttccatagaactgctgccatttgtgggggtctactccagaccctagttgcctcgatttttcctgtacctggaggtatcaccagggagggctgcaaaacagcaaagatggcagcctccttcttctttggaagctccttcacaggggggtactgacctgttgttagctcagatgtgcctggaggaggtggctggagacctctgttgggagatgtcacccagtcaggaggaacgggatcagggacccacttaaagaagcagtctggctgcagcaggtgtgctgtgttggggattccttcagccccccaattggtatgggctctccaggacccacaggctggactgattgagaagcctgaatgccagtgtggcagcctaccccaccactcaggtatactccgtcctggggggaaattagagctctgtctaattgggggtggctcaagaccccagctgggaagacccactaccccatgaggaggagtggattgaggtctcacgtaaagaagcagtctggccatgatctggcagtgtggctgtgctacactgcaggaaacctttctcttccatgctgtatggatatatgtgatttttgtgtattgattttatatcctacgactttgctaactttattagctctaataatttttgtgtgcattatttatacatctctgtggtctgatttggatgcctttatctcgttttcttgtttaattgctcttggtggaactttcaatactatgttgaattaagtggtaaaagtgggtatccttatcttgttcttgttctagcgggaaggctttcagtctgtcaccattgagtataatgttggctttaggtttttcatatatggtctttattatgttgaggttatttacttctgttcttagtttctggcatgcttttattgttaaaggtgttaaattttgtcaaatgctctctttgcgtcaattgagaaacgtggattttttcttcatcctgttaatgtagtgtatttcattgattgattttcctacattgaatcatccttgcattcagtgaatgaatcccactttgtcacgatgtatgaagtatttgctgaggacttttgcatctgtattcacacaatatattgatttatattgattaccaaaactcaagtcagttttggtagattgtatgtttttagaactttgtcagtttcatctggcttgtctgatttgttggaatacaactctttattgtattctcataatctctgttatttatgcaaaattactggtaatgttctttctgatttttgtgatttgaatcatctcccttttttcttaacttacctagaggtttatcagttttgttgatttttcaaagagtcaacttttggctggatgtgatggctcatgtctgtaatcccagcactttgggaagctgaggcgggaggattgcttgaggcagggagttacaggggagcctgggggacatagcataatgccatcgctacaaaaaataaacttagccaggtgagttggcacatgattgtagtcctagctgctcaggagggtgagtcaggaggatcacctgtgcccaggagttcaaggttaccatgagttttgatcttgtcacagcactccagcctgggcaatagagcaagactccgtatcaggaaaaaaacaatttttgttaaagtgtattttctttattgtttttccattctctttttattttgctctaacttttattatttcctttcttctgctagcttcgggattactttgctctttgttatttagttattttatgtgcacatttaggttatttatttgaaatgtccctccaccgccaccttttttttttttttttttgagacagcttcctgttttgttgcccaggctgaaatgcagtggcatgatcatagctcactgcagtcttgatttcctgggcttaagtaatcctctccctcagcctccctagtagctgggaccataggcacgcaccaccacgcctggctgattttgtttaatttttgtagagatgtgatctcactacgttggccaggctggtctcaaactcctaggctcaagcgatcatcctgccttggcctgtcaagtgctgggattacaggcatgagccaccgcactgggcctgagatgtgcctttttaagtgtggatgtctactgttccaacctctgccagttacccagctccaaagttgcttccacatttttgggtatctttatagcagcaccccactctctgcagtaccaatttactgtattagttctttctcatgctgctataaagaactgcccaagactgggtaatttataaaggaaagaggtttaattgacttacagttctacatggctggggaggcctcaggaaaattacaatcatggcagcaggggaaacaaacatgtccctcttcacgtggtggcaggagagaagtgctgagcagagggagaaaagccacctattaaagtaccatcagatctcgtaagaactcactcattatcacgagaacaccgtgagggtaccacctctgtgattcaattacctcccgccaggtccctcccatgacacaggggattatgggaactacaattcaagatgaaatttggttggggacacagccaaaccatatcactgaggaacccttatatttgataagctgcttctctgttaatgttttcaaaattctgtcttttggtttcagcagtttgattctagtgtgtctcagtgtgggtctctgagtttatcctttttggaatttcttggatttgtatattcacggatttcattaaggctcctgacattttcaaccatttctctttcctccatacttctattcctatattatgtatgttgttgtgattaatggtgccccacaggtcccccagactctgcttatttttctttattcttctttttgctccttagattgcataatttcaaatgtcttattttcaagtacatttatcttttccgtctgctcaaatttgctattgaatttctgtagtgaatttttcattttagttactgtactttttatcttcagaattttttcagttcctttaaaaaaaattttcccttttatcgatattctcattttgtttagacattgttttcttgattttctttagttttttgcccatggtctcctttagctcattgaacatatttaagagtgttgatttaatgtctcagattaataattcaaatgtctgggcttccttagggatggtttctgccatattctttattttctatgactgggccatacttttctgtttctttttatgtgttgtaatttttcattgagaactggactgagtattatgttgtggtgactttggaaatctaattctcctagccctcagagattgctggggttctgctccttgattactgaagagttccttttatgattttttgaaactctttttgcatagtatgtatttcttctgatgggtggtctctgaagtttctcttttgttttctctgttgccagccagtcatgtaagatttccttatcctactcccaagagaggggagattttggtgcacccatcacccaagcagtgtacactgtgtacccaatttgtagtcttttatccctcacccgcctcccacccttttccctgagtccccaaagtccattgtatcattattatgtctttgtgttctcacagcttagctcccaattatgagtgagaacgtaggatgtttggttttccattcctgaattacttcacttagaataatagtcttcaattccatccaggttgctgcaaatgccattattttgctcctttttgtgactgagtagtattcgatggtgtatatatataccacattttctttatccacttgttgattgatgggcatttgattgtcatcttgcccatatgacatcaaaattcagcagatgtcttgagggtaaaattggtgttaaagaaaaaattatcgaataatacttgttgaaacacagtaaggaaaacttttttggggactatcgcagtatatatagggaacactgcagtgggttcttgcagtggcaaagagagattgggctcacttcttcagcatgggcaagtgggaatttatagccaaggagcagtgtgggagtcaatggatagaaaattaataagaggaaacatcaggggtaatggggattctggctaaaacaacaggattcttgctgaagacagaccagggtgatcagacatcacttaggggagattggaggatgagccacctaatcagatatcaagtgtgggggtcttgctaaactggattttataaggaaatgcacagatggacctaagagaagaaggttcaggagcctgactaaagtttgactaagcacagaatctttgtcactggttatgtgtttgaggcacatcaggtctccagttagtatggatacctgtgcatctcacaaatacaggaaattttactttgcctgtatgaagtttgctttcgagcccttgagccccttctgcagcttctaagttcagcagatgtcttgtgggaaaaattggctgtggagttgaggcatttcaagtctgattatttcttcaaccctatgtaactgccaagagctttgctgatttttctttgctccagcaggcgtctgcctgaactaagtctgctgctttcttagcctgtgcccagaattggtgaatgctcttaggggaaaaaaaatcagcttacttctgaacagccctcctactatgaattttaatcagtctaggccttattgattccatagcttgcctgatgcctttaaaaatataattttttatgttttctgcctttttctagctgttgggagagttggtctgccatgacctacttattgtatattactgtgcagtagaattcttaaccatgtaatataaaattgccttaatactccttttatgattttttgagtcatttcatttttatatataaaatccaaagcattatataaagatggaatgagcccagatatatccattaaaactattgtaactgcccaacagtttcgttttgcctgctgcctgaatacaattgatttatcaagacagaggaattgcaatagagaaagtttaattcatgaagagctggctgaacagaagcgccatagttttattattcaaataagtcttccccaatatttggaggctagggtttttcaaggatagtttggtggggcagggaatgggtgctgctgattggttagggaggcagtcagaggtgtggaaaatggtcttcatgtcgagtccacttctgagtaggaccacaggaccaggaccagttggtgggtccacgtggagccctccgccgtcagaaatgcaaaaacctgagaaggtatctgaaaaggccaatcttaggttctacagtagtgatgttacctgcaggagtaattggggaagttgcaaatcttgtgacctctggaataatgactggtaattgtttacatttacactttagcagaattcaggctcctctcctcctcctaatgtcttgctaaacagatgatacaaaaatatcagtgacctttctaaactattaccaaataatacagagatggctctctgtattatttattttattattattattattatttttttttttttgagacggcatcttgctctgtcacccagactggagtggagtggcgcagcgcaatctctgctcactgcaacctccgcctcccaggttcaagcagttctccctgccttaccctcccaagtagttgggattacaggtgctcgccaccaggcccaactaatttttgtattcttagtagcgacagggttttgccatgttggccaggctggtctctaactcctgacctcaggtgacccgcctgccccggcctcccgaagtgttgggattatgggcatgagtcactgcacccagcctgtattattttatatcataatgaaagaaatgaaaataaaaaagaacctgttttgcaggcagaggctacaaaaactttgaacaactagtagaaatggtttaagttaatttctaaattctgagaagatagaaggactaagcccccattcctaactcctctcctcttc

SEQ ID NO: 337 - DNA, 29385 bp, Homo sapiens
ctaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaa

SEQ ID NO: 338 - DNA, 53549 bp, Homo sapiens
ccttgtcatgaagacataaggtaatgtgattcacttttgagcatcagttactaagaggacatcagagtggttgagcactctttgatactataggagtgtcctcaacttgcctatgtccacagcagtgtgagtcaaccagagataatgggtgggaaagagtttgtttctctcaattcctatcaagaatctaaatgggagggaaaagaaccaatttctatttttgtttaatagttttagaaagtacatacatgctactgcagtcaaaattgtgctctgggttttcttctgagggttaatttggataaaaactattattcagggatggttcaagtttgaataaatcaattcagttcatccagttttcacttcatggcccaaatcctttcaagtccttgacccccatgctctgtcgtttctctctggaatttctacttgtcttctcctactcaaatagttacaacgggttaggtgcaggtgcactcaagctcattacaggttcattgaaaagcttgtcaggaatctcagtgctttctattataatactcagagttgagttttctgcaatgtgaacttttaaactgtagaaagcacgttgtccttttgatgccaataaaattgtgcctttggagaaaacctaatttacatcccctacacacacactatatagcttgtgttgttgccttgagtaagaatggacacggctattttattaagagttcattgagtatgtattctcacatgataacatgggaaagctcatggcacactttaaaggcaatacaaacgtaagctcttttcaaaaattgatgaagagcataaaatatatatttaatgacttgatcagatacttcaaaactaattactgagtttattatctagaaaaatctcttcttggattaaatttggagctatacatttattggatctatttaagtagaatcaaaagaaagaaaaaataacgtatagaaattaaacagccccaccaatatttaggtattcagtagtatggaaataaagaatgaaagccaagattcctataacaaaaaagttatcttttccacctctaatcaaatagcttgggtgtttattaggtgcccatcaaagataaatatttcagcaatggagcctattaatgtgacacatcactgtgtttaagatgcttaaagtcttacaattcaattaatcctcagaaatccagagaaataactggctactactagcaatcagtttataaatacaatatcaagtgttttttaaacaggaagtattttaaagagaaaatagggcaggtgcggtggctcactcctgtaatcccagtactttgggaggctgaggcaggcagatcacctgaggtcaggagttcaagaccagcctggccaacacagtgaaaccccgtctccactaaaaatacaaaaattagctgggcatggtggcacgtgcctgtaatcccaactactcaggaggctgaggcaggagagtcacttgaacccgggaggcagagtttgcagtgagccgagatcctgccaccgcactcccacctgggcaaaagagtgagactctgtctcaaaaaaaaaaaaagaaaaaagagagaaaataataaacagcaataaaatggctaaattatggcctactttataataaataagtagttagcatgcttccccaccaccatcttacccaacaatatagcctaaccgacatatcagagttttgatatttccttaaataagagaaaaaacatataattcacatttgtagtttcaaaactattttgactggactctggggacaacatagttcagtcaaataaaagtgagctccccgcccacagttagaggcaccatcagaacagggagcttccactgaatgctttttaaagtctctcatttagaaaatgaaaccaacataacttaaaaatacagtttagtgacagtgggaaggttaaatacgttcaaaaaaagccattcactatcaaaagaatttgtccctttaaattgtgaaaacccttacattcttctccaagatactcaagtacacccctaatgaactcaactcgtgtccccctagaaatcttagcataataatggcatacaatatggtgcttattagcactgtcccaacagtaacatgatattttactaggtattcttaagtctgatattaggattaagatggagagtgcttagactatttgaaaattacttaatggttctaagattttttttctctaatgtgtcaatattaaataatgttagtgagtttttgtctgagcttttgcactcaagtatgggtatctgaccatctatattgatctaagtgttataactaagtctataaatggtagactatcgtctcaaactaggatgttttgtcctacggtaggcaaattaaatataccttaattgaacacacaagaacatgagtcagttttctaatgtgagtttataatgccacctatccaagaaaattgtgcatgcacatatgtacacacgtgtgtacttatatatgtagcagttggcatacctctacatatatcacgtcccaataacagatttaaaggtaacacgcattccaaaaccatattaataatgttatcgtaatgctttcctaaaacactgtacaaactttctaggtaattgatttaaccaaggatgcttattttattagccagttttacctcctgtgttcagtctggtggattttggctctttcttgctcttgctgctgccgtttcagttccagtaattcactctaggaacaataaaagttttaaaatatggttttcaattaacacagttgtacagaagatacccaaatcaattacatatttaaacctcaactggtacaatatttcatttttgaaacttttacttaagtactatttggatgtgaaattattttcttatatacgtaggtagcaaataactgtggcttagtcaaacagaatagctctgtgagtgtaaaattgctagattaaaagccagtgtgcatggtcaagatactagatcaataggtacaacacaaacagaaaaaaatacaatgtaagtcaaactcatctatgtcttacagagaacaacaaatcaaattagttccttcaggaatatcacacaatactatttcttggtatttctctagcatttctttcctgataaattcagagcaacttacaaataaatattggactcaatcttatagtgtaattctgttaataaaacattctccatcctggagagtaagcactcacctattattgattagttacttctaataccagcagaactttgagatctctggaggagatactttgcttcatataaatcacattattataactaaatctttagcttccaacagtctgcttatcttcttggaagaggcaacttaacttccagacctagttactatgtttacagtattataccgaagaaccaatcccaggatttctctaatttccaactgtctaccctaaggcagaataaattttaatcccatttcaaagacaaaaaaaatgcaaagagaagaaaattattaggcccaagtcatataccagtgcctgagtcagagagattttctggtagagaaaatactgtcacgtcttaacacataccaataaaaggttgctattgttgttttaaccccaaacttccttgatgaaaagtatacaaaaaaactcaaagttcaggctgacattttattaactttgttcaaagaccctctaatattccacagtcccccaaaataaaaagacttatttcttatactgtgatattccaaatacattgctcatcaatccctaaagcacattacttaaccctaattcctatataacactaataaggggaaatcattgaataatatttgagtttttgaaatcaatgaataatatttgtccactcaataagcatttgttatacaccttgctgccaagctttatgctcaagtctcactcttgcacaataggatcattttttagtctaccaaatattagtactctttattagtactaccaagtataccaatgtgaaagaagctcctgtcctctccctcgtctccacaatcattttcaattcctgcatgtggtttcataagtaattatcttcttcttaatagtatgcatgtttattcatttcttaatttttttttattattatactttaagttttagggtacatgtgcacaatgtgcaggttagttacatatgtatacatgtgccatgctggtgcgctgcacccactaactcgtcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatttcttaatttttaaaaaactgtattatcttttgactacctacaatggaaaaaagattgatgtctctattactaccttcaccccaatcccaacttcctctcatagtacagccccatcgtcattctcttacaacttttttttttttaacattcaatgtggtaggagagggatctagaaatcctgtagctcctcattcaagtttctaattcatcctcctgttttcaactctaggcttcaaaggtaccaggtgcctctgattcctcaacttaaccaacttctctgtcttactgcttctttcagatgagtactggctttccctgctccactaaatcagttaccactgaccatctagttccagatttaaaattttggcttatatctttgctgcagtctactagtctgttcttttgctcttgttggcttatggctttttaaaaaaattcctgtatttttagtggtatatggggagagagtgataaaacataagcaaatgaaatgcttttgatatgcaatgtttaaccagaaaaccttaatattttcaaatacaagttttaccagaattgtattatttgatcctaacaacaattgcaaaggtaggcaggcaaacaaagtattatgtgataaatgaatgagcaatatcatcctcaccttacagataaggaaatgggatcagagacacagttttagtaacttgtcaagagctaaatagcttattagtagcaaaataaagaccagggcttacattttctcgtatctaataatcttctgcaggatgcattcaaaataaatggttggaattaaggatatcctcacggtggctcatcataaagtatacacagtcatgtccagaactacaggacccattcacattcaaaagttttagcagaatatatataacctaagcacaaatctaaatccttcttgccaaaggatgctgattattttcactttcattaatcctatttctccaaggagcaacttctggtatctggcccattgtgagtttaatacaatgcattctgaacaaactaactctcattagttctggagtatgacacaaagacaaaaaaagtataaaatacatacatatatatatatgcatactatgacatgttactttaaaatttttaagataattttttcagacttggcaaaatgatcatgcaacttgtctgagaaaaaaaatacaatcacagccatacaaaaatactggaaaagaaaacaaaaaatgagaaagaaccagcttcatcaaacattgaaagatatcatatgagaacacatggatggggacaacacacactggggcctgttggagtggaggatgcagggggagggagagctaatggatgctgggcttattacctaggtactgggttgatctgtgcagcaaaccaccatggcacatgtttacctatgtaacaaacctgcacatcctgtacatgaatccctgagcttaaaagttgaagaaaataaaactatagtaattaaaacaatttgagtctaggaagagacatgatacatatggaaatgtagtttaccataaggttgtgctaaaccaatgcaggtgacagagtttcatgaatgatgatggactagccgactactgtaagaaagatcaaaactagacccttaatttcgattaaataaattttatagaagtctaagatttgagcctagaagatgggaatagaagttttcaaaggtggcacaggtgaatttatttataaacttggagtgaggaagttccagaagttagaaaaagaaaaagattaataaatttagctgcatgaaaattcaaacttttcatttggaaaaaataccataaaattaaaaaattaactgttaatgaatgtttaggatatgcataggctaattcaattttcatttattcattcattaaatatctgagtgtctattatgagccaggcttgcatctacatgataggctatagtagtgaacaagatagatgagatctttgctcctttagagtttatattctagagaaaggaaacccataaacaagtgagaaaaatatccaacaataatcccaggcagaggattaaaacacactgatgtgagattcagtggttcagtgactattttaggctgagactcaggaaatgtcccagaaagtgggtaaggacttcacataaaccaataaggaaaaaacaaccaaaaagaaaaagggccaagggataggaacaggcagttcacagataaactacaggttgcctgtcagttcaaaatggtcattatcttcactcaaaatcaaagaaatattaaaacgatgagataaagtgtttctattgtattgacgaaaatcagaaaagtttgacagaaaacactctggtatagcatctaaattagtgaaacctaatttagtttttggaagtcaatttagcaataagcatcaaaacgtaagacgtatacatctcttgcagaagtgttcaaagatgtatgtatatgaatattcacagttatattattgaaactgtaaaagttcagggaaacatgttaatgcccaccaacaaaacacttgtaccataagtgagaccatcagcgcaatggaatacaatggaacagttacaaagactaagatggatgttttgtaaggtagagcaggggcctatggagagatctctaagatacattaagtgataaaagataggttcagagccgttttcttaggacgcttctatataaatagaaaatatatacatacattcattttgacttttatatgctgatgtgtatccaaaacatttaatgaaaaactacacaagaaaatgttaactgtaattaacactgggtagcggcgcttgaagtgtgaatgggcaagaaaaggatgctttactatcttacatagtttttgttttttaacttctgaaccatgtgtatatattatttcctcataccatcagtaggaatttattatcagtgtgagaggccatttctgttttcttatgctttcctttatttaaaaatcccaataaatatgtaatttttaacacagagagatataaaagagcgaaacaccacacatgaagctaagaactgttagggaggaagaaaagacgggaagagagcaacatacatcatcctattacggaggcaaggaaaggggagaagagataaagaccaggagggaaacgcggacgggagctgatgaggcatcaccatgcaagaacattgctccagatggccgaagggaaggtgctggcatcgctgcactcaggattattatcctataactagcaaagcatatttactaaggagaggctggtttttcttccgtactaagaaggataatttcagctaattaatttgttctgctgaactgacagccaccgaggatgtgtctgcatgccttataagcatattcttggttcatttactgagatcccacagagaagttcaatatctagagttaagcaaataaaaaataagttgttcttgtttcaaggaccaagctcgggacatgaaaagcatcaaagtgctctaagcaggaggacaatgacatgcaacatctgaggcattgttaaggcctggcctactcaatgcatattgtcacacgccaaccattttccagatacctaggttcatgctaaaggtacagatatcagcacagctccaccctgaaataaatcacagtataatgaggcagacacacccagaaacaactctgacacagggcaaaaagaaatgagttgctaaacacaaaattaagctacatgacatgggaatacaaggaaggaatgcaaacaggagaagggtgttcaacactttgtgtttgtgcacatcttatcactgtgctatgcaaatctctacattcatacagagctgcatacaaacgagggtaggttggtgatatgataaacaaaataccatcctagagattgaaagtatggaacttcctacaaacattggccaagtggtatgtggtaaatgaggacaacactgcaaatagcgccactgcctgtggccacccgatgcagtgctcacccaggagggctgctctgctggggagctgcaggatggcaccaatagctctgcttcgagcccaggtcaataataagaagaggggttgccatttccagcaagaggttgcaaacatcatttctctgggctccaattgtctgatggtgccctgttctacagaagggtcaactatacaacagacaggtgtgtgtaaagctggatgcttaagaaatgtgacaaggttagagggaaaacatgctccaaagcaaagtttcagtgtggtaattgaagatgaacatggggtcattttaaaaccatgtctgaatcccaacagagcatgttccgacatggttcagcttgactgctttatgtaaacatgaaaatgccatcgcctggcaaaacaaacttctcccaggagagcctgttctctcaacacaacaagaggaaagggatagtggaagcaggagagttgagaccatgaagtcatgaagttcaagaatgccttcctttgaaggtttaatacagaaaagctttcgggggaaggaggagagtttaaagaagtcctggttctccggcatccacagtaatacctttgccttgaaggagaaagatggccttggctatcaagaatggggagaaaaggcagaagctaccacccaaaattttcagagcaccaaccaaatcaaaggaaataaatactaatgggtgaagtagagtttaaaaataacacaagtaatgtacactctccccttactattgtttttaatttttaattttttaattgacagtttgtacatatttataggatacaatttgatattttgatacatatgtatgttgtaaaatgatcaaatcagggcacttagtgtgtccatgatctcatgcatttatcatttatttgtagtgagaatattccaaagcctcttatctagctattttgtaaggtacactatcatcttactgtcaaccacagtcactccactgtataacagaacatcaaaacatattcctcttatctaattgtaactttgtatttgctgttgctagttctatcattttaacagagagagaaataaacttccagctacaacaatcatggaatcacagctctatgtctcccacctaaaaatatttcctacacaaaatgcaaggtagacgtaggtttcaaaacttatctgcactctattttatgatctttgttttcattttcatatatgtgagcatatttctattatgttattaaaatgtggtagtaattgctgcatggtatttattccaaactccaaaaccttcaaatcctgtatcactgaacaaactgtttcaaatttcccattaatcttatgttaaaaataaacaaccttgtacaaatatcttgtctgtatctctcattatttcctcagaataaatgtatacctttagatctaatatttttacttttaggaaactcttcagaatttgatgttgccaaagtgcctctcagtttatcctctcaccagtaatagtacttcagtgtttgtggtatatattgacgtctactagtggaagttctccttaccccaacaaatacacaaattattattcatatttttctaaagtttaaatttcattatttttctctcagttgaaatttagaaacagtattttcaaattacctcaaattccattgaaatttattactagaatttcattaaacttacaagtaaacttggatagaactatagttactgaaatattgagttttagcattcgggaacattagccatctctgctttattcgaattgacttttatgtataataaccaaaacagcgtggtactggcatacaaaccaatggaacagaatagagagtccaaaaatacatccacacatgcagagccaactgatttttggcaaaagggccaagaacataggggaaaggacagtctcctcaataaacagtagtgggaaaactgaatatccacatgcagaaggatgaaattaaacccttttctctcatcacatacaaaaaacaactcaatttgacagttttcacaaaaggcgttaaaaaataatcaactcaaaatggattaaagactttaaatgtaaaacctgaaactaggaaagtactagaagagaatatgggggaagctgggcacagtggttcatgcctgtaatccccaccctttgggaggccgaggcaggcagatcactgcaggctaggagtttgagaccagcctggccaatatggcaaagccccgtctctactgaaaatacaaaaattagccaggcacggtggcacacacctgtaatcccagatacttgggaggctgagtcatgagaattgtttgaatcccaaaggcagaggccgcagtgagccgagatggtgccactgcactccagcctgggtgacagagagactctgttatgaaaaaaaaaaaaaaaaaaaggaaaagaaaatgtagtggaaaagctccatgacattggtctgggcaaggattttttggataagactttaaaaggacaagcaacaaaagcaaaaacagacaaatgagattacatcaaactaaaaagcttctccacatcaaaggaaacaatcagcagactaaagagacaatctacagaatgggagaaaatatctgtaaactatacatctaatagggggtcagtatccaaaacacataaggtactcaaacaactcaatagcaagagaacaaataacctaatttttaaaattagcaaaaagggccaggcgcagtggctcatgcctataatcccagcactttgggaggcctaggcaggtggatcacctgaggtcaggagttcaagatcagcctgatcaacatggtgaaaccctgtctcgactaaaaatacaaaaaaaaaaaaaaaatagctgggtgtggtggtgggcgcctgtaatcccagctactcaggaggctgaggcaggagaatctcttgaaaacaagaggcagagtttgcagtgtgccaagatcatgccattgcactccagcctgggcaacaagagcgaaactccatctcaaaaataataacaatttaaaaaataggcaaaaggcctgtgtagctatttcttgaaagaaaacatgcaaatggccaacaggtatatgaaaaaatgctcaacatgactaaccatcaggaaaatgcaaactaaaaccacgatgagctattatctcacccccattacaaggctatcatcaaaaaggacaaaagataacaagcgatggcaagaatatggagaaaagggaacccttacacgctgcttgtggggggtgtaaattagtacagccattatgaaaagaggtgtaagttctctcaaaaaattaaaaatagaagtaccatatgatccagcaatcccactactgggtgtctatccaaaggaaataaaacaagtatgtcaaagagatatctgcacccccatgtttattgcagtactgttcacaatagccaagatatggaatcaacctaagtgtccatcaatggataaagaaaatgtgggatatacacacaatggaatattattccaccataaaaagaaggaaatcttgtcatttgcaacaacatggatgaacccagaggacattatgttaaatgaaataagccaggcacagaaagacaaataccacatgatatcatttatatatggactttaaaaagctgatctcatagaaatagagtagaatcatggttaccagaggctgggggggttaggaggaaatggtgaagtacagggagatattggtcaaaggatatgtaattacagttagatatagggaataaattcaagagatctattgtacagcaaggttaatgacagttgtaattaatgacaataaataatgatcatttattatattcttgaaaatgcaaagaatgttaagtgctctcaccacaaaaatagtaactgtgaggtaatgcatttgttaattagctagacttagccatttcacaatgtttatatacttcaaaatatcatattgaacattataaacacaaataatgttttctgtcaattaaaattggattttgtggattccaggaaagtttttaattttttttagttgttgaacaattatttatatagctgctttttgattagatctttttgtcccataacgtattttctaattaagttttgcttgtatttgagaaagttgttgattcttgtatatattttttaaccaaatctttttttttttttttttttttggaacagagtttcgctcttgttgcccagggtagggtgcaatggtgcagtcttggcttactgcaacctccggctcctgggttcaagtgatttgcatgcctcagcctcccgagtaactagaattacaggcacctgccaccacacctggctaagttttagtagagatggggtttcaccatgttggccaggctggtctcgaactcctgacctcaggtgatcctcctgcctcggcctcccaaagttctgggattacagaagtgagccaccgcgcctggtccaactctcttattaaactccatttgttctcattatttttcagttgattctcttagtttgcacaggcaaattgctcccatgcataaataacaacctacttccaataattagaaaagctcttttatttttagttttatcaagttggttaaaaaatatccaaaccttgttccattcagtaaaaacagggaatttttttttagttaaaaaaataagttttctatcaaataactttgagtagcatgaggttggaattcccagaataatactgggtaacaaccaagtttggtaggggttgcaaacatccttatgttgttcatagttttagtatttcaccactgaatataatgttggttattggtttagaagactacaagtatgttaagaaaatattatttttagttcactgaagtgttttttaattgatagtaaagattaaaatttatcaatgtctttttgtgtaactaaagagccaaatattcttgtcacatgacctatcctattgcagtgataagatataaaaagttttaatatatagctacttatctttgcattcctggaataaactctactttcctttggtaaattgctattaagagaaaaatttcatcagctagaattttccttcagatgttaatctctgtctttataagattggtctatctgtgagagagagagggagggagagagagagagtgtgtgtgtgtgtgtgtgtgcgcgcgcacgcgcgcacacgtgtgtgagtgtgcacatgcttcctttatcagattgtgacatcatggggatagtgaaataaacttctaaaatgtttcatcttttttcttactctgaaataatttgtaaagcatagggaaaaaaaatctgttccttgaaaatttgaaggaacttgcttctaaaattatccaagttcagcctcctgggggaagtaattctcagaaaacttcagaaatcacttgcattttcattggtctttatgagttttaattatgtgagtcattagagttatatattttcctagaaaatcattcacttaatccaaatttttaattcattagcatagcattgtttatagtaacataattttaaacttttccaaatctatggttctagtccctcatttctaatgccgtgtatttgcatttttactaatctcttcttgattagacttaccaaagatgtgtgcatttgttgaccttatcaaagaacaagctgttagatttttataacagctgtttcttagagttttattattaatttctgttcttatcttaattactttcttcaggatcatttattgtttttgttctaaattcgtagatcagatgcttaattcatttctttttttagtattgaatggattaaaatgttgtaattttgagtacagctttacatgacttccctataaaagtctctcactataattttgtatgtgttctataataataattttctctgtcacccaatagtttattttctgactttcagtattttactgattcttgtatatattttgactgtaaaatcaatgactttctaaatgactataaaaccaataaccatgcacaatcaataaatgcaatcagcttatcacatattttaagaagtttctgaaagagagaaaggagacaggttacattaccagggaaaaccaatgtgcaggataaattggagctaagtccacctgcttctgaaggagctccaggagggaatactgggacagtcatttagatgatcagttagaaaactgcactaagagcagcttggtggtgggttcttttccctcccacacttgcactacatagtaggcagcactatcatggcccataaggtaagaagtgaatgagagaggcatggctgggctcagggaaacagggcaacgtcccaagtacctactgactataagagaacacgagtctactccacacagaagacaagctcctacatacctcattcagcagcatatccaaatacatataagaataatcaaacatttgagaaagaattccatgggagataaagattaaaatggaaagaaaaaaacagttaatatggtaaatagaaaacttatgtttgtatagttacaaatatacaaacattaaataagatgagatgagaaagaatattgcacttacaaagcagaacactgctacttaccaaatcagcaatcttggtaaataaacatattcaatatgtgccaaataagcagaatgaaaagtcaagaaaaaatttagtgagcaggatgatctagctaaagctttcatccagaatccaattaaaaaaaaaaggccaaagggataagaagtacaagaaaacaatgaagttatatacagaacagatctgaaatgtccaaagtccatttgatagatgtcccagaaatggagagcaaagacaataagggtaaagagacataaaagaaaattaggaagaaaaaaggaaaagtgaagagagacatgtattttcagattaaaagagacaaccaaaggctatgcaagattagaaacaaaaatagaaacactgtgaaatttcttatagtacaggaagggggagtggagagaagaaaaaaaacagtaaataaataaaacagagaattcagtgtcagtaaaaaaaaagaaaactaataaaaagtaaatcatgcagtaagaatacaaatacatgcaaatatgctactaatcataataaatgagaacacatcaaatctacccattaagagattctgaaactaggtaaaaggaaaaccagacatttctttccactcaaaatctactttaaacaatgacacagagatgttaaaattaaatgattaaagaaatgtcatgtaaatactaaccaaaaaaaactggtagaggaattactagaatcagacaagatagtcaaaaaagaaatcaagctaaaaaatcattaaatacaaaaagtagtatacttcatattgataaaatctatcctaaaatgtaggcttcccttagtctcattggtcaaaactgtatcacatgtccacagagaaaccaatcacagtcaaggagaatggaattctcatgaagagttagaccactttgggaataaatccctggagctggggtagcacctgccttttctgaaacacagttcatgcaaagtaggatggatacttgaagaaaaatcagagctgtagagaagcaggcaatcaaaaatatttgacacatcactctgaaattatcacaacgcctaatttatttccttgcagcattagtattatggtttggctctgtgtccccagccaaacctcatgttgaattgtaatccccaatcttggggaagggacatgatgcaaggtgattagattgtggaggcggattgcctccctgctgttctcatgacagtgagttctcaggaaatatggttgtttaaaagtatatagcacatccccctttgctctctctcctgttggccatgtgaagatgtgcttgcttcccctttggcttctaccacgattctaagtttcctgaggcctccccagccatgttttctgtatagcctgtagaactgtgagccaattaaacctcttttctttataaattacccagtctcagatagttatttatagtaatgagataactgactaatacaattagttactacagattactacaaggtgatgaatcactataaaatttaaaagtataatgttgtatttctaagtctccttttaattgtttactcctcccttaaaatgtaaacttctggagagctggaaccttgtctatcctgatcttaattatagcttcatcaacttgcacaaggctcagtatataataggaactcaatacatgtttgccaatagaatgaatgaatgagtgctgggagagattactctgagacagatcaaccagaataatacagttaaaaaaaaaaataaaagccagagaaggaaagctttaaagtggtgttagtgttacagagttcagggagaagataggaattacaaaaagaccaccaaactgtatgttcagaagggattttacatttaggaagcaatttcagtgacagcatttgtgaatataaaccagatcataaggaattaaggatgaggtgggtaataaagaagtggttacagtaaaattacctttgtctttttttaaatttgctagaagcagaaaaggtaatatctctgaggatagcaaaatcaaggaaggggttagctggtttattttagaatggtaagatgagatgagaagttcacgtgtgctctatcatcttcttcatgacctactgtcaccaactgtggcatatttctgacaaaaaaaggaagcatccaatggagaagaatgtattgaagatatagaaaaaagaggaattacaaataagtttctagaagaaggaagtgaatcacaggtaaaatatttagagtttaaacttgaggaggctccttttgtccccagagccaagagtaattaaaaatgtgaaagtcagagagacacatagaacaaaacttatgtgctgtcacctaaacttaacctagattatttacctaagaattattccatagtaggtatccaataaatatttgcggaatgaatggaataaacaaacacataaatggatgcaatgattaaaatgtgttgtgttttgtatctttttacagtaaacatgatcctcctgttttcttaaggtaaatcattcaagtgataaggaatgaaaggttctacaaataaagaaatgcctttggccaggtgcggtggctcatgcctgtaatcccagcactttgggaggccaaggcaggtggatcatttgaggtcaggagttcgagaccagcctggccaacatggtgaaaccccatctctactaaaaatacaaaaattagctgggtgatagtggcatgcacctgtaatcccagctacttgggggctgaggcaggagaatcacttgagcctgggaggcggaggttgcagtgagccaagatcatgccactgcactccaatatgggtgacagagtgagacctggtctcaaaaaaagagaaatgccttcaatgaacgtttcccaacaacaacacgtcaggcaaaaaaagagagaagcaaaagtaaggtagaatagatggataagtatccttgtgtagtctactgttactgaaatccctaaggatggaattatttgtatattaaagctattaattttactgaaagctacagtaagttaaacgaaataatttatgtaaaaggatatataataaaaatatgttcaatcagtaaccagaaaatatgtgtatatcaatatttatctaagtctagaataaaaacaagattaagaaataaaaagtttaattttcactgtttaaaataactgctcaacctgaaaattaaatcccagatctagtatcctaatttgttaagcattctgtttgtcaaatgttctacttttaacagtttttatgttccaaatatatatgtcaaacttttaaaaacactatttaaaatccactagaagttatttaaaaataaatcatatctacaactgactttgcaacattcaccttagtatgctaagtacctcacaattttatgttaagttaaaagctcatagaagcaaatgaacacttttacgtcatttagcagacatcattaaaagtacaacatgactatgtaccagatttagcttctacttgttaactactagaatcttaccataacattgcctatttgattgtagatttcaagattaggatcttgccaagacaaaaagatatttatttaaaaaaaaaaaaaacactaagggataaaaatgtttcatgattcgtctttcttacacaggagctaaataagtaaatttacaactcgcatgatttctttcaatgatttaatgacaacctatggtgcccaaaacagcctagggacacatttataccatatgctgggcgaaactatgaatgagaaaggggttccacactgttgggaagaagatagcactcaaaagggtcaaattatagcaacactaatgaatacaaatagttcatttttcaatggaatttttacacacaattgttgtaataaattaccttgttggggaaagacaaagaaaacataaattaaaccaaatcaaggaaatcaaaatgggagttagaattctagttaattatagaactgaatatacagatttgagaaatgttctataagaaatagtgacaggatttgtcaaccactagtatgacaagaggaaaagttggaaaataataatgatgggaaagataaatcatttagttagctggagccccaccccactcccttttcttctcgtttaaaggatctgaaataaagtggcactttggagctaaccatgggtctttctcatcattctcatttcatgctgagcagcttctggcctattaaaagcaggtatgaacatcaagtatgccactgactattttcagttaccataccagaaatttcacattgtaatgaagattattctttaagcacttttcttagaaggctctgcattcacttcactgatttccattgctcaaaacatatggaatgcctcacatatttttatacccatgtagtgtaacttggttttactgtatgtgtataactatttttagtgaacatttatgccagtttcataactttgcatgcctactttcttatgcattatcacattctctggataccatctctaatttcatatatcttcggtttaaaaatagcagtgatggtggtggtgttttgttttgcagatgagaagttcaccagtgctctatcatcttcttggtgacctactggcaccaactacagcagatccactgtgcatccatgaggctaggtaccatgaaagttttgaccagaaggagccaccaccatactcttaaaacacatccagaaactcaccttttattttcaatgcttgtattcttgttttcaggattttcatgtgtctaaatatttctgttcagaaattcttcaaaattatctagtacctcaaataaacagttagcaataactagtaggggcttgtaagtaccttttgatgttgttcatccttcatcttttgcaattttctgttttcttctgcctttagagaatctctgtaagcccagcttctggcctgtaaaggtacaaagagaaaaaaaaaaaaaaaaacaacttgataggataaagggttgtcacagtacaccaagctgcctactataggcccggtgctaataactcaacctccgtactgagcatatagtaagctctccatacacacttggttattaagtgatttatgcatatgtctgaaaacgtcccttggaacatataaaaagaaaactagtgtaagcacaatcatcctgcacatttgaaaggatgatctaaatgtttaattaagctttaaaaatatcccctcagagataatcaacatagtttattccttctagtggaaagtttaggacattttcaagaatattccgactagctgatcagtcaatattaaagacaagcaatagtggcactgtctttagaagaacgggcatgtctactgctcattaatgatatctgattaagcagcttgtcaactagtggttgataccatataatttcaaggatgcatattttctaagcacttgcatccctaatctggatgaagttttatttctacctctgaaaaggaaaacaaagcctattcaggaacacatgacaacaaagcctttggcaagccagcacatgagggagaatgcccttcggtgtctctgacccaccacaccagagttccacaccctggcatagtgaccatgtgttctgacatttatggcatttcaagtgttctgtttatttgtcatatgctttctctccttcacattgatttgcagccccagcttctgtaaggcaaagagctaatgcttaggaaattacatggatctcataaaaaactatcagcagcttcatggcagcaggttacatatttcagacctagttctcaggactaataatccataaagttcaggtaggctggttccccctttttccagcctacgtgaacttttatgtaacttttctcaagcacttcttagttcattctggcatttctgtcactataaaaacccatatcccatcaaataataagaaccacttcccagaaaaagagagaagctttcaaaatggtatcatctatggcagtgccagttagaaaactggagcttcctgtgttcagaaatccctggtttatccaaaccctgctgcattgggcaggtaaacatacatcatatgactttctcttatttgcatcctaaactcaaggggactgtgctaagacatagaaggggaaaagtgattctctgacaagcctttctttttatctctgacaaccccttctttttatattagagaaggctagcctttatcacaaatattccatataagacctagtgaggaagggaagaagggagggagggaaggagggtgagaagagaggacaggaaggaaggaaaggagagaagaagaaaggaaagaagacagcttctactcaagatattaaaaggtagaataaaatatttagttaaagcaaaattacaacttgaatgagagtatctaaattctatttgaatagcctccctttaaacttgtcattttgttgttcttttattagaatacatgtcttagtttttgactcagaaaaaagtggttattaaataccttattattaaataaggtgccttataaaggtccacagaaactgggaagtcacatggcatccaaacttatgaaaagttcagttacttgcaatcctaatgtttgcttacccagctgtgatccctaggcaggataggaagtttctgttcaaaaataatagaagggaataaattgatcactatttttcttagctctaaacaccagaaatttctaagtcactgtattcacataatttgtctaacattgaaatattcatttaatacaataccaatgctatattttatcattcaaccaaaatacacctttatttatcctccccaaaagctatgcttataatgtactcattctattaacagtgtttaaggctcctctgtgcaagcactgtgtcaggacacgatcccaggcctcaagcatttacagcttagtgtgaaagtcaaacgagaagactaatggttacagtacagcatgataggtgatatgatagaggaagccaaaaagaaggatatttaattaaactagattgaggagactttccaaatcaagtaaggctaagttatatttcaaagagtgagtaggaatcagactataccgggagaagagcatcacatgagcaaatggaaaatagcagtgcatgagtttgctagggcttccataacaaagtattgtgatactggtggcttaaagaacagaaatttactatcttatagttctggaggctagaagtccaaaatcaaggtgtcttcagggttggttccttctgagggctatgtgagaaatatcttttccaggcttctctttttggcctgcagactccatcttcatcatgcatctcttcacatcatctcccttgtatgcatgcttctgtgtcccgatttcccctttttataaagacacttttcataatgaatttgaacccactctaggagcctcattttaacttatttcctctgtaaagatgctatctctgaataaggtcacattctgaggtgctaggggtcagggcttccacataaattttgagaagtgtgggtctcaacccatgacaagcattaagttctcctttcaagatggtggagtaaagatgttcctgttccattctccccaaaattaccctaaacaaagcagaaaatgaaatacacacaagctctatcttccaaaaccaagagatccatattcacagagggaaatctatgaagaccaagtagataaagaaacagtaagtgacttacagaggaaaagagcaaacctgaagacttgctggaaggggctagaggacacctatggggagccagttctctccacagagcaacatgagggcccaagaaatggatgcaccagctattgaggaagacagatggataataggcaggtaaaaaggaaggaattactagatagtctcagtagaagcccttcacccccatatacctgctcctgctttgaaaatgcaggtgctaattcaccaaacaccaacaggaaatgaaaagtgtattttctggataaactaaaccaggcatatgtgtaaagacagcagcagtggacaaatgccaggctgagaatgaaatgactctataaagtcctgcatactgaccagtgagcctctgagtccctctctttgaagtttttttctgcttcctgtactgtttcttctgagaagtaagaagtgatatatatatttttaaagtaacaaagaaaaaaggaggagtttggagacatttttttaaatctccccttcttccccccaaaaaaaccaaatcagtaaaatatttagaagataaagtcaagaaaatatgccaaaatatagaaaaaaggtagtcacagataacttacaggagaaaatctctaaagttagaagataaatccgggaggtctacaatttgaataatagaaattccataaagagaaaatgaaaggatataagtcagagataacacaagaaaatcatctagaactagagatgaatttccagaccgaaaatgaattaaaaaaagactttcacactaaatcacatcattacagaatgccagaaaaagaaaagatgatattaaaatattttcaggggaaacagagaaaatccttcatataaagcctgaaattcaaatggccttggatttctcaggaaccagtattcaaagttagaagagcaatgcctcaaaattctggaggaaaattatttccagtttggaatagtcatcaataaaaatgcaagcaaagtatgagagctgaataaagatagtttcagacatggaaggacctgaacatgtttaccttccatgtgtcttctcttgggaagccactaagtaatatgctccaccaaaacaaagaaataaagcaagaaaatagaagaaatgaggcccagaaatcagagaacccaacatgggaaggcaataaaagcaattcccaagatgactttaaaacagggattctcaaccttggctgcacattagaatggcccggggagcttttttaaaccctgaagcccaggtcacaatacagcaggctctctggaggtgcaacccaggtatctgtgatttttaaagctccctaggtgaatccagtgtgcagaggaggctgagaactactgtgttaaaggaaagtcccagaacaacagctgtgcgccaggcttacaaacacccaggacaggttaaagcaggaggaaagagggatccaggagggagagaaaaaaaaaaatccacaagttatctgacaggcataagttggaaaattgtttagaaatttgcgtcaagaggcattttgtagaacagtcacaaaagctgtcagaagacagtcaaatgttcaaaggaaactaagaaaacgctaaaataaaatgtttaaagagttgtacagaagatataaccagagtataccgactggcttggcagtgagaaaacgtgtatatagtcataatagggaaagctcaaattactgaataattataagaatgagaggaagaaatgagttaataaggtctaaaattgattagtcaagagataccaacacatattaacagatattcggagctaactaagaaaagaaacaggtggtgggttgcataatggccccccaaagacgtcccaatccctggaatctgtgaatgtttctttatgtgacaaaagggactttgcagaaattaaggatctggaagtggagagattagcctggatagtccaggtgggcccattgtaatcaaaagggtcattataagaggaaggcagaaaggtcagggagggtgcagaaggttgggtgagatggaagctaaactggagccatgcagccgtgtgccaagggtttgcggggacaggggacagatgccccccggaagcttcaaaaggaaccattcctgttgataccctcattttagcattttaaaacccatttttattgctgacctccagaagtgttaagagaataaatttttgttctattaggtcactacattcgtggtaatttgttacagcagcaaagggaagtgttcaaatgttgcggtggaagtgggattcaagcggcgcaaagggacacatgttaagtactttatttgacttcttaatgaatgagcatgtgacacgtagataaaaattacaataatcaacctgcactgagtgctcacagtagtgtgagagaggagagctggagaggcatgagctatagagcttggcccctcagacattaacgtgcacacacatcttccatggactgtattaaatacaagctctgattcaggaggtctgcagtggggcctgagattgatctgcatctaaatctttgctcctgatttcaaaagctttgcttccccttaccttgcttgcaaaagctttgcttcccctcacccctttgcagaagcaaagatttagactcgaggccagtcctccagaccccagaggactagaaaggggccattctaaagaaagagacagaatctagaattaaaggagagacggagggacagagagaggaaaggactttgtgcctaagctaagacattttgattttatccttgaagatatgggggaccactgaatgatttggggaagtgaaacaccaggataagattttttcacatcgttattcttcgttgaggaagtaggggcataaggccgggtgcggtggctcacacctgtaatcccagcactttgggaggccaaggtgggtggatcatttcagcccaggagtttgagatcaccctgcgcaatgtggcaaaaccctgtctctacaaaaactacaaaagttagctgggcgtgggggtgcgtgcctgtggtcccagccacttaggaggctgaggtggcaggatggcttgaacctgggaggtggaggttgcagtgagccaagatcatgctgctgcactccagcctgggtgacagagtgagaccctgtctaaaaataaataaataaataaaaaatgggggcagcaaaccagagactagaaaccatttcatatttgactagaaatatgcagcgatggtcgctgaggaaggtctgatgatgctggtacttctgcctacacacacaatacagagaactatattaatccacatgtaaaagtgaaccctgtaaatatctcttgtctgaagtcctaagccaaaaggaattttcttgtaaccactaaaggatttttcttgtaatcttttacattgacataattttctagtatttattaaatccccatctgccaatggcagatccacttttaaaggagaaaagtacaagaggaaaaatcttttcaggaaagttacattaggtagtaaaattaaagtattaaaaattatatataaattcttccagctcatcacatcccatatagatggcaatcacatagtgttcacattctataagttgaccatagctaaagtaaactgcaggtgtcctctttttacaaagaaatgttcttcacagaagtgcaatgtacatatttgattttcctacaccattagaaatgattctgcaaagcattctcagaagaattctatgcatatggatgagacagaatgagaagagtataatatgggtaaaaagtcaattaaatatattgaacactgaaaccgtattaatagtttggggtcaaaatcggagcagctattgcgtggagtttataaggaaccgtcctgggtccaatctccctccatattttctattaatagctctgaggatcctatgacaaatgcactaatcaatccacagaaaatgcagctctgggaaacattgctaatgctttggatgacaatattaaaattcaggacgatcttgttaaattgaagaaatgagccaaaatcaatagagcagcacacgcagttctgccaggtgttccacattgcaggatacagggagccctcgaacggaaaggaagaccagcctggtaggcgaaactccagctggtaaagctatccaactcctgttctccctctccctccctgacagccacaaggatatccagacaggtgtttagggctgtcatctacacatgatttaactccactgcctacagcttctcaactctttcccccagagcccagcagtgagggaagagagatgatgaatttcctttaatataagttgtagggcccacactgatgaatttagactttagaacatcacattagaagcagaaagaaaaaaattaggaaacaactaaagatttctaagtaggagtataatgacctcttcctaaggagtgtcataatatcttcctgacatttaaaaacatggtctctattgagaaaggggtaaggggagatgaagatgagggttctttaacaactcatttagctacccaaactctgagaaacctgagactttaagaaacttaaattcatcttttctttcagctacaacccttatccagagtcatccttaattacacttactttcttgtccccagttagcaagtcaataaacaagccctgccgctttcaccttctaagcagttttctgacctgcactctcttctccatcctctcccccgctgtcctagctgaagtcttcatcattctttacccagactgatacagaagccttggggggcctctctgcttctctattcctttagagccctccttcacaatgttgccaatgtgatccagaatgaaaacacaaatctaaccttgagttttccctgtttaaacatttccaataccctcagtgctcacagaatggggtttaggttttccaaggtggcatgcaaatttctgtggtggttttctaccaggagcaccatgagcacgcagtatgcggggcatttctacatgtctcattggtaagcactgtgtgggggcatttctagatgtctcagtgtctgggtggcgctactggcccttcatgcccagggcctagggatactaagcatcctgcagtaatcaagacaactcacacaatgaactgtcccacctgaatttccagaggtaacaccattgggaaagggtcctcaccgttcctgctcatttctatatccttctagctcacttttctgcactgcagctacataactcttcttccgcaacacaagccatgcttatttcttgcatttataccttaattcttgctctatgtgtctttattaattctgatacctggaaagactcatcactttactgattcatagtttaagcttctgctctggtgtcatttcccaagaagcatctaacgcacatggtctgacttagatgcttcttcctgataaggcagtagtgctttcttattgtgatatgctctgtgctcagcagtttgctttaaaaccattagtgttctcctttactaaggttcattgggcagaaactgtaggcacttagtaggccttatatagacctatgaatttaaagaatggaaggaaggatggatggatgcatggatggaaggaaggaaggaaggaaggtaggaaggatggaaggatggaagaatggatgggtggatgggtgggtgaatgaatggttgggtgagaggaaaaacttctctgaggctgttttagtccaggtgcccataaaataatacaagcattattttatagctcaggcaacagttgaggtcaaagtttcggatcaggtcatctgtctttagttccagcattctatgatgtacaagtcactctatatccctcatcttcagtcactaaatacctctataaaatgtgccaggcagcaccctgcaaagtaattcacttacccatgttgaggattgtgggccacaaacagcactttgacaggcacttctgtctggcgattctgtgttcagtttgctcaagaactcagcggttttgctaccagaaacacaaacaggtgttagtgccttcacaaaaatatgaacataattctttatttttcctttggatactaacctagacttatttgggtgatgattaaaattatcttcagcagaacagaaagttacgttgagaacaaggtgtagcagaaatcaaaacaaaatgctattgcaagattgcattcttcaagaacaatattacaaaattataaaactagctttatgaaatgtgagcttatgacctcattttttccactttatattactgacataaatacaagtcctctcccagagcacattccacagcatgcagccctaatttcctatctgaacatttaatgcttaacactcagacttcagggtggagctgtggaacattcacgccctacaacatcctgcttcacaccagttttacattaagccctttaccctctcatctgcctcatggctttgaccactgttaggacacagagaccctctaatccagtagctcttttccatttatggatcatggagcccttttggactctgaaagcaaaagtgaaccctctgttaacagacacacacacacacacacacacacacacacacacacacagtcctttgcattttgtttcagagagaggataaaccctccatagggtttatctatagaggttaaaaagtgctgctgattctagactgcatttctaatatctctttttagctctgaaaaattgacctagaaatgtcctcagtttaaataagaagttctctgtttttaccttaaaaatccaaaccaccaccccaatttcccctctcacttatgccaagcatagaacactggaattgtttcctagtccttacctcagtgcctggcccattctgcctacccttgattaatttctacgcctttgtccttttctcatgtaatttgtgtgatttttatctcttcattgcacattcacagccacatacctcattgagcactgacttactttgcaccagacttgcgcagcctgttcccatctccctccctcctcctgctagccctctgcttccccctaatattttaagcccaatgctaagatctgattcatcaagtacttaggacatgggcatcaaaggaaacacaaagtatctggtagaacaaatggcatccagtgtaggagcaaaacaaggaattagaaactaaacaggtgccagcatcacttcaaatattacttaggtagaacatggcatttgaaaaaggtcagaagcttgatctggggaaggaagaaataaaagtgaagcaacatacagaaccctgagaaacattcagcagttgagacgagcagcctttccatttgtcttagattacttatcttgcccagaatagacaaggagactaatgaagtcacagagtgtggaagctgccccattgtctggggctttatgaagtcatcagtcaaaagtataaaaagaagagtgatgccagaagtttggatgagatctctgaatatcctaagccaagtgcaggccataggagaaagcagtgaaaaagaaacactgtgacaagcaaggaagaaacttcagaccaagttgacaggcagcccttcagtttactgactgccgcttcttacctgccaacgccaagcacaaagctgcctgcagagccagcctctatctgtggtccttgtgccaattatcactgccccactcatgccgcaggatataaagcagagtgacagggtcacaggactgccagaggaatacaggtaggggcctgcagagtatgcggattactgccaagtgatcaactatacaaaggaagtcccatgttacgacactaactcatatttttctactattagcattagtccctggtatataaaatttccatatattggctgaactgaagtgggatccctgtaggtaactctggttatatttaacaaaaataagatgtagaacctgtttgaggggcaaacgaaggaaaacatcctcgtgggaagtccaactggactaagaaccctggactctagcactgttttcaccttgcccttgggggttcttggtattatcactaccgtgactctactgcctgttggagaggggtggtcctcttccactttgtcactctgatccaagcatgaaagatttcttcctctattctccatagaacaaaataaaatttacttatgtccaacttaggatctttaagggtccttcctgctcattcttaggttgatttctatggcatatcctgaaaggtcccttcaggaaaatctcgcctcaacagaatacagttgtagcagactgctaaatggtcatgaaaatttacattctcctcttctggccacacaacttggctacatttcctagcctcccttgcagctaaggttggctatatgattgagtcttgaccaatggaatgtgagaagtgttgaatgccacatccagtactaacttattagaaaattcccatgcatgtgcctccatacattgttctcctggctggaacagagacagccctcaaggaaatgctggaagttgtgcattgaaggtggtggagtctctatcagttttggttcctaaatacctgagtggaggaggctgcctttcaaattatgacacaatggtattttaaaaagcagtctatgctttttgtgaattcacttatatgtagtaaaattagaaacacttgccaagtgagaagagcagctcctggcatccaggaactgatctgatgctcacgtctaaatctcagtgttattataaactgatttgatctgacactgaagttaagccttgttccactgttggatgtaaatagtcacacagaatatctacttcacacaaggtcatcatgcaatctacaaagtaccaaacatcatctcctctaagtgaatgaccactacttcttcactaattacagcttcgtagtcactctaggtccttcctataggtaagatttattgagatacccaatcataaaactgtccccacattctgatggcactcaatccagagcaactccctgcctccgtagaccctccccaaaattacccaaccaaagcacaaatcctgtagtagggtctttctaacactttctccctgagataactcaccattccctatggtatgcattttcctttgctgcaatgagtaataaacccaacttgttcaactacaggtatattcctggtagtttttggttaacgcacattgacaaatattacataccaggacagtggttactgctagagaaagacagagaaggaagggatgagggtggagggacagctagctgtctctgtaatatttatcttttttaattaaccaaatataagtaatatcttaacaatatgagcttagtggttgatgcatattttctgtgtgtttgaaatgtttcttaaataaaaaggggataaaaaaccccacacagactatggtggtgtttactagggaaagacttggcagataccattccagatttcatagaacaatagtttccagaatgccagtgggaagaccagtgtggggctggctatatgagaatcatctgtggtgcttcctagaaattactggactcaggcctctgactctaattgagcatgtctggagtgggatctgggaatctgcgtttcttaaaagcacccctggtgatgttaagaactactacagtagtacagatggatattcaatatgcataattatcttaagtctacatgactctgacttatgaataattcatgttatacaacacatttggaaataaaacctcagcgtgtcttaggaactgtctgtataagtacaatctaataatgcattctacatgtattttgcaatagcttcacaaacctgaactttgccaccatgaggtttaggtaagtaatcattcgtacatgcatgcatgcattcatgcaggcaacaaatatttcctgagtctctgccatgtgtttagcaatatgggttataggacaatctaaagaagtattattttgcttaagtcagtttcacataactgggtatgagcaaatgacattcacacacctataagcactcacagagcctatgtaagtaagagagtgagagataatctattgggatacacaaaacccatttaagaaatcacaagaacaagatttacaaaacaaaacatgaaagtgagtagtaatgctgggagaactttgtgcttaatcaaagtaatcaaactattgcatacactttacagaattctttcccttcatttatctggtctttaatgatttaatttttaattgcaaaagcaatacataaatacgagtcagaaaatagaatagaaattagataaaaatataaagaaaaaaagtgaaggtcctacttaatacctctctcaacctgactcctttccccaaaggacaacatcatgaattgtcaggtatgtatcctgattttctattaattgataaatatctatttaaaattacatacaaatgaatagtggtttactttgggggaggataattaggataaggcagagaaggccagctgttctctaaaatgtgtttctctgcttcctgcatatatagctagactacgtttcccagctcccacgcaattagatgtgacataggagcatacatctgcattctggccaatgaaatgtgagtaaatgtatgggccaggctgaagtgatccacatcaataacctctcacagcattcttaatactctttcctccttctatctgatgatggtatcttaagtgagcctgcaaggcatttgcaaaggagagtagagctaccttttgcctacagctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcttcccaaagtgctgggattacaggcgtgagccaccgcgcccggccttgcctgcagcttttaatgccagggggcgaaagctaacctgactcaaacatcagccctggatcattccacaagaaagatataaacttcttgttctttaagtcactgaaattttggtgtttatgttttttaactacagcttttcctaccctaaactaacagacttttttctttaagtgggatactatattttgttctgaaaatagatttttgtcatctaaccacatctttgagatttttccatatttataaatatatatcttattccttttggcagctgaatagcattttatgatatggatataatacatttaacattcttatggatggatatttatagttttttccagtgagcatcctggtatatacatcttgtgcaaatacataaatattttttctaagatatacacctagaagtagaattttattctaatataggttcccataaatagatatgcaattttttgtttttgtttcttgagacagggtctcacattgttgcccaggctggacagcagccttgacctcctgggttcaagtgatcctcctacatcaacctcccaagtagttgggactacaggagcacaccacaatgctcagctaatatttttttagaggtggggtcttgctgtgttgcccgggctgatctcaaacttctggcctcaagtgatcctcccacctcagcctcccaaagcattgggattacaggcacgagccactgtgctcagtctattcacgattaaaccatgcttaatagtgccaagctgatctacacaaatttatattttcaccaaaagttaactttatgaaagtggcaattcagaaccatggctaacctcctgtaagtactaattctatcctgtcttacacattcctatttatctcggtcaccaccgagtgttccagtctcacctatcactcaatatgactcagtctctcaatcccacactgccccatatatctaccacttaagcccccacacctccctctagccttccaaacctttccaagggggcaaaagtctctcgatctttatccaagagttaacaactcaggattcttaacctcatatcagaaagtctccctcaaatacaaaatcaccattaggcaaacatccaggtaaaaaaaaaaaaaaatgttggcaagattaatttacataggctaaaatcactgggcaaaagtttgcagataacaggatattagtatagtcttaaaatatctcccccaaaacattcatcaattataaagagaaaaacaataacttaacagtggagaccaccttaccaaatgatccaagtaaatatcaccagtgataaggatactgatcatcatgtaccctctgatgcgatgcactgagaaggacatggcatcacttctgtaattttcttgttggaaattataacttcaagctattcatgagaaaacatcaaacaaacccaaactgggggaagtctacaaagtaactatccattacccactgaatgtgttaaggtcatgaaagagaagggaaaaaatgaggtactgtcacatattggaggaaattaaggaatcataatgactggatgttttatgtgatcctgaattggatcctgaaatagaaaaggagcactggagggaaactgatggaatatgaataaggtctgtagtttatattaatagtattgtaccaatgttaattttctgattttgatcattgtactatggttgtataagatattaatgttagctagatgaagattttattggaaactatttttctactatttttgtatcttctctctaagttggaaattatttcaacataaaaagtaaaaaaaaaaaaaaaaaaaagagtctgcctcattttcccacattgtctgaaacctgaccacctcttgagaacagtacttcccacaaccccccgaaatggaactattttacttccatatacatattccttggtgcctgaaaatgaagcagacatcctgtttgctcccaatctacttccagaccattacttcccccatcatttgcaaaacatgtttgcttctgtagtacccacaacacagaatacaccatcctctttgccattgtcatccttcaaccttctggtcaaccatctctcatttgtttaagatttcagcctttggtgcacccaggaggtgtgggtatcatgtaattggcagttggtcaaagctggtgccagacccagcctcctgaaggaaccatgtcctgcagctttgggtgccactcgtcatgtcaggcacacactgctgcccaagcggagctgctctttgaattctctgtgaatgctgggaggaggaacaccagagctgctggctgaaaattgtccaaacaagaggaatacccccctgcatggacttcctggttctcttcctgctctactggctttggtgctagttggttatgttatgacctgtttttgctagaaaactcatgatttgaaatgcctggtcagggcaggggcacagatattttcctgtataattccagaatgtcttcagaaagccatgtaaagattgcttcactacctcttccatacatgaaaccataccttcattatccttcacctggtcttgcaaggaatggtaaatactgaatatacctgggaaatactgggctaccgtcaaaagctagttctcctgtattaccttcttctgccctgtctgcttctgattgtaaacccgtttatttccaccctaacttgtgtaactgattctggcattataagaaaagcaaatgaattatttcttcaagtttatgaattcagtgatgtttctaaagaggtgaggtgctctacttatgagttacgaacaccagctcgatcaaagcactgactgcagtgtgtgcaccgttttgaccatcgttaggtttgggtgaacaactgcatctgggcttggaacgccagttattaatactttctcatctacctcttgatgttgacggctttggctgctgccatggccattgtgagcactgcgtttctggtcgatttggtggtattgttggatttgtactagacttacactgatgaccttggacacttccagtttatagacttgatttttcttatttagtacctgttcctgacctttctaacaattgtcttcatgctggggttgtggttggggggacgttgtaatggtcctgagctttctcctgggtagctacctgtgctttgctctgtacctggttgccatcaaccagactactaatgagtggtacagaggtgactgggccccatgccagcattgccccctcatggcctggcccccatcaggaaagctccaaatctaccagaacattcactcccatgggctctggagcaaactttgagagatctttctacctgccattccaaataatgagagaaagaagaaacaagaatggaagaagtgtcactgccttttaaatatagtatgcatttattatttaagaaaaaaccttcagccttcctccctatcttgactactgtcaacatggatatcctatgtgctgcccccccacaggctgtgtttcttgatttcttggtctccagtagctcttcttcactccacctcagccacactgccagggccataccctggacattgttgtcatgaataaatgtcctctctccaaattatctgacaaattccattcctgaatacagctttctgtcattccatgttcttctttcaagtactatcaatataacaacattccagtctctctgggatttctaaaccactgattccccacctctttctaaccatcagctcccatctattttaattcttgcgcagcttagagcccatagtccattttttaaatctttcccttacaaatgcctttcttcctcttctccctgcttccatcatatatgtctgtaaaaatctcaaacctagatcaagtcaaccatctgctttctctgagtctgcaccagaacaagtaaatcaaacttgggaaaaataatacatctggtgtttggggatgggaggtatgaaggaggagggagtggtaaagtagactggcttcaaatgaagtccattaactctagcttcatcctaccgaattcttctactccatttcactcataaattcttttttttattttttatttttttgaggcagagttttgctcttgttgcccaggctggagtgtaacggcgtgatctcggctcactgcaaactccatctcccaggttcaagtgattctcttgccttagcctcctgagtagctgggattacaggcacctgccatcatatctggctaattttttgtatttttagtagagacagggtttcaccatgttgcccaggttggtctcagactcctgacctcagtgatccacctgcctcagcctcccaaagtgctgggattagaggtgtgagccaccatgcccggcccactcatgaattcttctcctgtaccttttgtttgttctcagttctcagctgacaatctcctcatacttcattgagaatagagaaataagtctttcatcttctcaacacgaaatcttttaagtcttcctatatctgtacctatcttcctttaacaaaaatgtaaagactgcttcctcaattataaaaggagaagtactctccttttaatcattgactaatcattaagcattggttatgtatactcaggaacttattcatatattctttctcaagtttatttcttctgtcatccccttgtgtctagtcttcccctcctctcctggatcatttctatcagcatacaaacatgatcaatttaagaaaacttttgattccgcagcctcatccagttactgcctcatttcattgttctcattttcaaattattcaagagttactgataaatgccaaatctattcccatatctccatttactcgtaagtccaattcaatcaagctccagccccatcatcatacccaaatcatttatgtcaagatcacagccactgtcactggtccttctctcatttgaactttcaacactagtaaggaattgactaatttctcctttcggaaatatgtctgtcctgttttccatgataccacactcttaatttgcccgacttctcggatgtcctttcgtatctacccgaactctacatgatagagctcctctgtatttggtcctgggccctcttctcaaacctgcaatttcatcttaagtgactttgtccacttttatggctttatatttacatgctaatataattcctaaatttatatttcccacatatctgctcagtgagaccaaattcgtgtgtacaactgcccatttgatatatccaaaccatctcaaacttaaactcttgatatttttctaaatatgtaaacttaaacttaacttaaactcttgatatttttcttcccaaaccttggttttcacctagtagcccccatctcagtacatggcatcactacacctccagtacttcaagtcagaaacttgggagtcatccttgattcttcctccttcttcatccccaatatcaatatgtcctattgaacttacatacaatatgtagttatagtcatacgtcagagatattgtgagtttggttccagaccactgcaaaaaaagcaaatgaaatattgcaataaagtgagtcacataaatttttttgttttccattcatataaaagttgggtttacactagattgtagtctcttaggtgtgcaatagcattatgtcttgaaaaatgtacactttaatttaaaaatacacgttgttgctaaaaaaaatgctaacatctgagcctttggtgagttgtaatctttttgctgctggaggctcttgttgataacctgctgactaatcagggtggtagttgctaaaggccagagttgctgtggcaatttcttaaaataagacagtgaagtttgccacatcaattgactctttctttcatgaaagatttgtgtgtagcatgcaatgccgtttgacagccttttacccatagtagaacttcattcagaatggaagtcaatctcttaaaccctgccaccactttatcagctaggtttatacaatattctaaatttcaagtcatttaatcaatgttcacagcaacttcagcaggagtagttcccatcttaagaaatccctttctttgctcatccataaaaagcaactcctcatccgttgaagtttgatcataagattgcaacaattcagtcacatcttcaggctccacttctaattctagttctcttgctatttccacatctgcaagacttcctccactgaagtcttgagtccatcaatgtcatccatgagggctgggatcatcctcttccatattcctgttaatgttgatattttgacctcctcccatgaatcacaagtgttcttgatggcatctagaatggtaaatcccttctagaaggtttttaatttagtttgcccagatcaatcagaagaatcaccatctatagcctttaaaaatctatttcttaaataataagatgtgaacatcagatttattccttgatccataggctgcagaatggagactgcgttagcaagcatgaaaacattaatttccttgtatatcttccaggcatctcaaagttagcatgtttgaccttgaacttttgatatttttcttcccaaaccttggttcttggttttgatatttggtttagaaatactgccaaatatcctaataggtattagaaccaaggtttgggaagaaaaatatcaaaagtttaagttgaaatatgctaactttgagatgcctgggaaatatacaaggagattagtgttgttttcatgggtgattaggtgcattgtcaatgagcagcaatattttgaaaggaatcttttcttctaagcaggtcttattagtgggcttaaaatattcagtaaaccatgatgtaaacagaggtgctgtcatctaggctttgttgttccattcatagagcatacacacaatttagcatatttttttaagggccctaggattttcagaatggcaaatgaacattggcttcaacttaaagtcaccatctgcattagcccctaacaaaagttagcctgtccttagaagtaggtattgacttctcctgtctagctatgaaagtcctagatggcattttcttccaatagaaggccgtttcatctacattaaaaatctgttgttaggctgggtgcagcggctcacccctgtaatctcagcactttgggaggctgaggtgggcggatcacctgaggtcaggagttcaagacaagcctggccaacatggtgaaacaccatctctactaaaaatacaagaaattggccaggcatggtggtgggtgcctgtaatcccagctactcaggaggctgaggcaggagaatcactcgaacctgggaggaggaggttgcagtgagctgagattgcgccactgcactccagcctgggagacagagcaagactctgtctcaaaaaaaaaaaaaaaaaatctgttgtttagtatacacaccttcatcaatgatcttaactagatcttctggatatcttgcagtttctacatcagcactttctacttcacattgcatgtttatattatggagctggcttcttcccttaaacctcatgaaccaacctctgctagtttctaacttttcttctacagcttcctcatctctctcagctttcatagaattaaacagtgttagggccttgctctagcttaggctttggcttaagggaatgttttggctggtctgatcttctatccagaccacttgaactttcttcatattagcaatacagctattttgccttcgtatcattcacatgttcactggagtagcatttttaatttcctttgagaacttttcttttgcttcacaacttggctaactaatgcaagaggtctagcttttgtcctatcttggttttcaacatgcctccgcacagagcttagtcatttttagcttttgatttaaaatgagagacatgtgatatttccttttacttgaatgcttatgggccattgtagggttattaattggcctaatttcagtattgttgtgtctcaggtaataggaaaatccaaagaggagagagagatagacaggggaatagccagtcaggggaacagttagaacacacacaacatttattgattaaattcactgtcatttgtgggcagggtttgtgggtccccaaaacaattacaatagtaacaacaaagatcactgatcatggatcaccaaatcagatgtaattataacgaaaagtctgaaatattgtacagattaccaaaatgtgacactatgacacaaagtgggaaaatggcaccaataggcttgctcaacacaggattgccacaaactgataatttataaaattttaaaaaatgaaatatctgtgaggtgcaataaagcaaagtgcaataaaacaaggcacgcctgtacttttctctgcactgacatcacttaagctgagccaccaccaactcttatctggactactgcagtaacatctttagtagtttctccatttattctcttgccttctcaaatctattcacaacacagcaactagagtagtcatttctttttgaaaaataaaaattttctacaggttatccctgtggcttgaaaaacatgcagactctgtgccatggcctgtgtggtccacttgacctgcctagctcctgcctgtcttgtcaacttcgtcatctctttttttcacttcagcccgaacataccagcttcctttcaggttgctgagtaccctatatgccattgcctcagcctagaactttctttctggttctcagtatggctggttccttctcatccttttatcttcagttcaaatgtcattttcttggaaagtcgggtcctacctatcatgctaaggaggtgttgccttcctagtaccattatgttctcttaccctacctctaacactatgttccttcataggaattgttcgaatcctacacagttatcctacacagttctttgtcagcttgtctattttccacatttgctcatggagccatatttgctttattcataatagatgcctagaacctagtatagtgcttgacacacatttatcggtgcttatcagtctagaggatttttctgtttggggtttttaagagacagggtctcccctgtgtcacccagcctggagtgcagtggtgtgatcataactcactgcagcctctaactcctggctcaagtgatccacctgcctcagcctcccaagtagccaggactacaggcacgtgctaccacacctgaatcatgctcattgttgaataaatgaaagctcctttcctaatgtgaagtattatcaatccattgatatttttgccactgaaataataaaatctatatttgtgtttatctaatcattagtgaaactgaatattttgattcctatttcctcttttaactgcttgttcaagtaatttgccaatttttgagttgttattttcttattatcctataaacattctttgtgaaattaagcctttatccattatgtttgaggcaaatattttttcctagattattatttacttaaaacattcttcattatatcttctatcatagattttaaaatttttacgtacttaaagctatggtctctctttatggcttctgagatttgtatattgcttaaaaaggagtttctaccctcaaagtataaaatcatccttcactacatttttattgtgttgattcaatacaaattgtcaaattgtctattcttttgacattggtttgaaagaaatactttcattcatagttgaagtcctaaatactgaatttttatataaacatgggtctactttagattctctatagcattcaataattcaattcatagattgattacaatgccaataacagtttgttattccaaccagctttaaagtttttagtcttttatctcaaagtaatttcagttttggttttaatttttccccaatagtcatttttaaagatagtttaaattttttaattaaaaaattagctgggcctagtggtgcacacgtgtagtccccctacgtgggaggctgaggtgggatgattgctcaagcccaggaggtcaaggctacagcaaaccatggtcatgccactgtactctagcctgggtgacagagcaagacactggaaaaaaaaaaaaacagaaaaaaaattttttaagtaaacagactataatttcatattgcttaatttctaattttactccatttttctcaaggactgtggctttctaggatttggggtgttttttttttggaggttaccaagagtctttgaggccttgaacatggccaattttgtagtagattttagtcagtcttcttaaagtcagtatttataaagaatatgtgttttcatatattgggtacattttatgtctatacaattatgcttagcattgttattcaaatcctcctttctttacagagttttttggttcacttggtctgttaatttctatggagaattagttaaataaaaggaaaatttggcaaatccatagtctatattagagacaaatagtttttgtcatatgtatttcaaacctattttgataaagatttgtgacttgcattttcctttggattatatattttatctgcataaatatcttttattgtgttgaatgtttttcaccttgaattcaatttgtctcatactaatattgctgcttttgttaacatttacgtgtataactttgttttcaactcgatttatagatattctttgtaatcaaatatagctagatttgtatttttctaggcaatccaagagcttttattctaataagataatttagcctgtatacattttttgtgaatgctgacttattggacttaatattttgcttgttactttttattgaaaaattcccccttcttttctgccttttattgtaaaggcagaaattgacgatcaaatttttatttgttgtattatacttatatgtttttgtgttatttatcctaatttgtacatataattagcatataattaaacatataataagcacatttatttttctatcaatctctggaattgatatcaatatccaacattcactcatacaacaaaggaaaaaaacttattgtagttcatatccctgtctcttccttgtgcctcttctagtgctaaaatcctccatgattttaattagatcctgttgattctttttttttttttttttttttttttttttttttttttttttgagacggagtcttgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccacctcggcctcccaaagtgctgggattacaggcgtgagccaccgcgcccagccctgattcttatttaaacagaaaaacaagcacatatttgaccaaaaatgtcactgtcttctttgttcacaattgttctggtatctatgccttcctctttcttggatttactacttgtttgactagcattcattttcatgtaatttttaaaatacggctcttagagctcacatagaagtgatgaagttggctatgcagatggcttgtctccagaatggggaccacatattcccccaggtatagcatgtttaccagaagcactttctgggccccagggccttcttagtgaatcttatgcatcaagaagagttctcaggctctattgttgggggtaaaggctggagttggctgctcactttccttcacttcttcctctgctgtccttgttggagttacactgtattcagcgtctctttccaaacactatcctggatctcttatgtggattgtatcagttaatcttcttctgagttagcagttattgttaccccctaccccaggctatatgtgaggaaacgaggccccaagaggttaaataatgtcctattaatgaggaaaaatgttataatttaaactcaggcagtctaacccccagatcccctgccctcccaaaaggagaacatggatggtactaggttccagtgataagaaaaccaagtgaaactattttgtaaaaaaggaactagtcaacttttatttttttaccaattattaattgcatacagagaaagacaaaaactggcctggccaacctacagaatgggagaaaaatgttgcaatctatccacctgacaaagggctaataaccagaatctacaaagaatttaaacaaatttaccagaaaaaaacaacctcatcaaaaagtgggcaaagcatatgaacagacacttctcaaaagaagacatttatgcagccaacaaacatatgaaaaaaagctcactatcactggtcattagagaaatgcaaatcaaaatcacaatgagataccatctcatgccagttagaatggcgatcattaaaaagtcaggaaaaaacagttgctggagaggatgtggagaaataggaacacttttacactgttggtgggagtgtaaattggttcaaccattgtggaagacagtgtggcaattcctcaaggatctagaaacagcaatatcatttgacccagcagtcccattatcgggtatatacccaaaggattataaatcattctactataaaggcacatgcacacgtatatttattgcagcattgttcacaatagcaaagacttggaaccaacccaaatgcccatcaatgttgggctggataaagaaaatgtggcacatatacaccatggaatactatgcagacataaaaaaggatgagttcatgtcctttgcagagacatggatgaagctggaaaccatcgttctcagaaaactaacacaggaacagaaaaccaaacactgcatgttctcattcataagtgggagttgaacaacgagaacacatggacacagggaggggaacatcacacaccagggcctgtaatggggtggggggctaggggagggatagcattaggagaaatacctaatgtagatgatgaattgatgggtgcagcaaaccaccgtggcacgtgtatacctatgtaacaaagctgcgcgttcttcacatgtatcccagaaattaaagtatgataaaaaataaaaataaaaaactggcctggcactcacagctaggccttggtgttctcctgttgaaagtaaccaatgttacataatgtcaatatcagaagaggtcactgtgactataatagctcataacaaaaacaagatcactctataacatgtctgaacacagaaaaatacatggaccttgtagaaactataatagtgaccaaagatcccaaaattatggctaatatgagtgacttctgcttctttatcaattacagcatgagtctcactctggtcttccttccttctagatagaattgattaagacacctcatcatagacctacccctgcttcctgataagatccaattcagagcaaagctctgcttccttaaatcttcccctaaatcacctacgtattagtctgttctcacactgctaataaagacatgcccaagactgggtaacttacaaagaaaaagaggtttaattgactcacagttccacatggctggggaggcctcacaatcgtggcgaaaagtgaaggaggagcaaagacacatcttacacggcggcaggcaagaaacagtgggtgcaggggaaccgccctttataaaatcaccagatctcatgagatgtattcagtatcacaagaacagcaatgggaaagacccacccccatgattcaattacctccggccaggtccctcccacaacacatgggaattatgggagctacaattcaagatgagatttggatggggacacagccaaaccacatcaacctgacacagacccaaatgctataagtcctttctgacatctaagatggcccatggttccccacggtgtggctaaggagtctggaattcattttataggcagtaggaataggagataatcaaatctgtttgaccagtagagtgacatgactaaagctatgttttagaaaactaaacttgacaaaacatgtaagacaatgaagagactggttgcaaagatagtaacaaactcactgcagtagtccagggggtgacaagaaatcacaaaagacacaggccatgattcaagtggcatgtgataatactgacatcagggcagtggcagtgggaatgaaaatgaggtagcatacaccaggatatctgcagggagaattgatagtgggtagagattgtgatatggttctaaccatcaacataattttacattcaataggtaggaattcctctgaccagatttttcataagctgttcagtcttattctgaacaaaatagatatgagatttttgtatctataagttcactttattagcataagatagaaagttatgaataggatgactttctattcaccttacctggattataaaattcaaggctggatttaagcctaccatatgggtaagggatcaactgagcccttaagtgtctttcagaagctcccatgaagggcattagaagttttgtgagcatattggaaggcaaacttggtgcctatgtgtgcatattcagctgacttgcctggattctcagctctaggagactaaaatagatgaagatgtgccccataggaactaatcacactattattcaaatgcaagtaaagaagatgcatggtttcaatggcaaaaatgaagaaaactttccaatattacaatcggcaggctgagctcaaggtggtgcaaggcaatttagaaataggaagaccctattttggaatgcgcttggttccaagagcttttccaactgaggtttttagaactgagccccttgtcccctagaaacaatgttggaaattgtacgtaggaatagagtgcagccaggagaggtcacaaaagcccacctaccctacagtaagtttaattacggtactaatccatgttgggtctgggaagaggaggtcattcatatatgctgatcccagagaaagcagacacatttcctctctttacttttgcctattctagcaaaatccagatattggtaggaagaaatagaagtcaactgcccaagtctttctctctgagctgtctgtcccaccctctccaatagtcctctccacaggtagcctgtgtttctacagtgctcaccacccctatgtattttgaaggtcaggaatatctgagcaccgtctcctgtcagaacagcagcggtattagaatctcataggagaacaaaccctattgtgaactgcacatgtgaaggatctgggttacatgctccttatgagaatccaactaatgcctgatgatctgaggtggaacagtttcatcccaaaaccatcccccttgccccattcatggaaaaattgccttccacaaagccagttccctgtgccaaaaaggttggggaccactgctttatatacactataaacacagataagtaaaacactactcacagatgtaagggacaatagttactcttgcctcactacaggcacacgggcatagactctttccacttccccctcctccctcctcccctgaaacacaatgttgtattactcaagaggtggtttggccagtccccactaaaaacaacatttcatatgaatttcaacaaaaagatattcacaaaatgtgttattttactacctgtacttttaacacatatcaggcacttcagaacatctagaagaaagcccagacatttcaaaaaaaaagtacttagtattgccaaccatgtatacagtagtgaggaataaaatacacacacaaagcgatggttaaaatatgaaaatgtctcctaaatatgatcagtctagcatggagccttcttctcctccttctcaggtcttccaccccaagtcctcttatccactgaacaattgtggacatgtcatccctgatgtcacttccagaggtggtctcacaaatccatttcaaaaagtcatcccagaagacattttatatgattttttttaagaggtgagcatttgcaagatgtgtgattttatgactcttttatcataatttggcaaaacctatctacatctagaagggctagatgtagcaagtgctcttttaaaaccttggggaggtcagttgagagcagtttttcctatgacgtacacagatcttctacacagggcctgtacatttttccaaagaccagtgggcctttctgttgcccaaatgtggcttatctcctactgtttctcttctgatatgaaggtatgatagatgggagatcaaccccgcctggtggcttctagcagtttcatccgtcagggctctgctcaccttctggaccgttaaggccttggtccattgtcatcaataacgaggcaggcctcacccaactgggacagagtggtcaccccaggccccggtcctgctgggtttcaggccaacagaggtggcggagttgggtccgtctgcagacccaccttccaggcctcaccccacagcgctctccacggtgttcccgcagctgccaggcttcccaccctgcacaccggcgccacccaaagcggctgcatcctgaaggcttcatctaggccaggcagggttaggccgggaggcccagcagccagctgggtctgggctcagagaggcagctgcctgatggtcaaagaggtggagtggagagaggggccctcctctgcatcaaggcctgggccctgccagtgcacagccatggcaagggctccaggtgcctgcagagcagaggcttgcttgtccttggaccccagctttcctgggagggccataggggaagtggccatgcttcacttctcaccaagctctctgcaggaactccagagtggcttgttgttttttttttttttttgctgtttgtttgttttttgtgtttttttttttgtttttgtttttttcggtgagacaaggtctcgttctgttgctcaggctagagtgcagtggcggcatgaccatagctcactgtaacctcaaattcctgggcttaagagatcctcccacctcagcttcccaaggagctgggactacaggcatgcaccaccactcccagcaaatttttgtattttttgtagagatgaggtctccctatgttgcccaagctggtcttgaactgctgacctcaggtaatccacctaccttggcctcccaaagtgctgggattacaggtgtgagccacagcacccagtctcatagcagcttcttattactttatttgattaaaagaacaaagcactttgtattttaaaaccatatgaatatataatctgttacatttaatgtgtaaacaggagataaaatcccaagccccccaacagacttaatggattcccttgtagccaagtggattccagaaagaaaaactaaattccaaattctaaatgccccctcccttttggagtttaggcacaactaaccagcacattaaaatagacgtcatagactgccctaacactaacagactctttgtggcaataagataacaaattccaacctgactccagtacagcatcacacgacagatagcagaccctgaaggaaataaaaattttttaccccaaaatatatttctttggcatattttgaaatggccctgtaaagctgtcttttgtggggaaaatttgcatatgtagagacactcttaccccttccaggtcttccccagatcaaggagagataagtgagaatctgttatctttaagggttgaaaagagaggctttggcccaggcacgtggctcacgcctgtaatcccagcactttgggaggccgaggcaggtggatcacatgaggtcaggagttcaagaccagcctggccaatatggtgaaaccccacctctactaaaagtacaaaacattagctgggcatggtgttgcatgcctatagccccagctactggggaggctgaggcgggagaaatcgcctgaacccaggaggcagcagttgcagtgagctgagattgagccactgcactccagcctgggcaacagaacaagactccatgtcaaaaaaaaaaaaaaaaagaaaagaaaagagagacttttcttttttggtcatcaagtggctgttagacatgaattttaaattgttaatgtttaaaatgtagccaattcttatatctcgagaaaattcttaaaagaacactttttcctaatacccgcacacaaaatgaatctgtcctgcttcactcacattcctaccctagctgaaattcaaacctctcttaacactcatccaaaaaaacacaattggaaagatgactacaccccgcccccaccaccaacaaattaccaattaaaattttaaatgctgagatttattttacccaatgttttaaacaacctaaatcataaaatcctatcattgttttttaaaaaaggcttatcaactgttacttcacgtcttccatctaatagaaaagtccacccaaaggtatcacacatgaatttttataagtagtaaataattacagagactaaaaataaccttgaaagttagaccaaggctaactgccgatttctaccctctgttttcaggctcaagaatcctaaaacgaattctaaattatgaaattggagtctgtccctagccagagtagcagacttaatgcaccattaatctgttctgctctcagccgctcattgaaacagtcacagtcattcaatttttagggaaaagacagtactgcaaaagtacattccagaggtcttttcataaaaaccatcctgtgtgctccatctgcatgtgcaatctgcttgtgtattttcagccagcttgcacgggcagattaatgcgtacaattagaaagcaacctcacaggcattcaataaactgccttcattattacactcaggagagtccctttggatgtcaataaaagcctagttttctgcctgttagctaaataattgacaacactaaaaataatcagaagcaaatgaacgaagtcaagaacaaggtgttaagaaagagcacattaagattctcatggtggtgccccaggttgctatcatgagctttttctccagcaacttggatttatagtccgctcaagtccatggttgtcctctctacagaaaaaaaataccattcctggtttgctgtatgaatcacacattgcagcatggtgaaactagcaaagtattgactggtttgaaagaatttcttatgtacgtttctattttatgttccttcatttaacagtttcaggagaatctaatttgggaggtgggggtaggcagtctggttggtctggcaaaacctttgtgctgttaaaaatccaaagaggtggctgggtgcagtggctcacacttgtaatcccagagctttgggaggtcaaggcgggtggatcactggaggtcaggagtttgagactaccctggccaacatggtgaaaccctatctctactaaaaatataaaaattcattgggtgtggtggcattcacctgtaatcccagctacttgggaggctgaggctggagaatcgcttgaacccaggaggcggaggttacagtgagccaagaccaagccattgcactccagcctgagcaacagagcaagactccatttccaaaaaaaagaaaaaaaatccaaag

SEQ ID NO: 339 - DNA, 54391 bp, Homo sapiens
aacatgttcatcagccagatgccttttctcacttagaaggcattattagattcgttcattcctccagctctccaacaggtacttatggaggatttagtgtgttccaggccctgagctagaggatggaaatgatgcccttagaggtctcaaaaatagggcgagtcccatgaatgaacagccaccccgcaagctggacggtgctagggaggagagagcagcttcctggggtgacccattgagcacacgcccacgtgcagagttctttccctgccattcctcctgtaatcttcaccacagccccagtgcagaggtaccattgttctacaagacaggcggggaaactgagtccccataaggctcagagactagcccaggatctgtagtaagagggtggcagggccaggatttagaccccatctgtccgatgccagaccctgcttccctaaccaaaagcagacccaagataaggaagccatatgcaatttaacttgaaccgcccatccctgctcaccgtgggggtgagctcactacaaagctggtggccagagagaggggatgagactctgggacttggacagggcagggaagtatcctaccagatttctggtgctaaaaaatgatatacctaatgctaaatgacgagttaatgggtgcagcacagcaacatggcacatgtatacatatgtaacaaacctgcacgttgtgcacatgtaccctaaaacttaaagtataataataatagaattaaaaaaaaatgcatccccagactacagtcacattgcgggggatcagtatagctggctttgggccgagattgccccctgattcctgagtggccttggctaagaccttccttcctctcagtttcccatctttaagtgtggacagtagtcccagcggcatagttactgtgcagatcggatgaaacaaacctcacagagtgcctggcacatggaacacgctaggtagacacaggcaggccccttccccaaagccgtcaagtccagctgcctctatccacagtgggacttgagcactggatccaagaaccatagagagtgggcagggtcaagaaggaatccccgctccttgggccacccctctagacctcaggccaagtccctgccagccttcagcctccacccaccagaaccacagaggcccaggctggtggctgatcaccaccagcctttagaactgcctcccaccagggatgtgtcccagccccagggacgctttgcctctgtccagcctcttccggccccctttcaatccctatgaacaaaggggctcaggggtgcctggcttgagccctgtgcccaggggagtgacaccagtttctggggctggagtcttctgagccctgagattctgccatttgccgttccgcttacaccttccttgtagttgaaaggtggcgtctacacctgtcctgtgggtggaccagggcctggggtggccatggcataaggacctcacctctaaactctgttccgccccccccaccccagtctctggccatgtctatatgacacagtctcactgctgctattgttaccggctacggcaattttaacgccatctgctgagcccctgccacgtgtgcagcagcctgctgagtgcttcctgtgcctttcctcaccgagtcccctgaacagcaccgggaggcgctccagtcccgctctgcacataggaacctgtcttatggacacagcccccatgctgactggctgccaagtgccacctggggctaccatggagggtaggaggttcatcctaaagctggttcctcccagcaaggatcggagacagggactctcgggttgagggtgaaaactctgagcaggtcccatcatctctccgagcctcatctgtgaattgggataataatcgcatctgcttcacagcactgcactgcggatgtcatgagtctgcctgtgactggcccagagcagtgcccatgcgtgccagctgctggagttggtgttactccctgccgggcgtcgcgcatcattccacggagtcctcaccactccttgatgggcatcacatgctgtccccttcaccccaccccactccgctctgttctcctattccccagcagaggagagagctccgagacaggaagggaagtgttgcaggccacacggctggtcctttgcaagccgggatgtgaatccagctgtctgagctccctgacttcctgcaggatcctacagctcaagggcgtctggagggcacaaagcactgttctgtgttccacagtcctggttccacaccagcctgagtctggctcagacacacctacccttccctctctagtttgtgtccccatctgtaaccctaagcaggctagaattcatctctgacgaagcgctttccgtctggaattccccacattccccaggagcaggcggtttgccctaaagctggttctgtgtccacagggggagcagggcgaggacggcaaggctgaggggccccctgggccacctggagatcgggtaagccccctccctcccctggaccatgtggcgtcctaggtggaatctgagcctcccgctgcatggagaggggtgggccgatcaggggccaggtccctgagagctccgcagaggtcgcggccaacagggcccagggctggcatccttggcacctggtggcccaaattttgctgttgtctttgtcattcagggccctgtgggtgatcgaggagaccgcggggaaccgggagaccctgggtaccctgtaagtatcagagctcctacctgctggcaggatcgggcatgtcagggagaggggggatgacacatgtctagaaagaacaagaacttcccaggcttctgtgctgcctcccagccctctgcaggatgggcccccctcacctgtctctctttggcttccagggacaggagggtgtgcaaggcctccgtggaaagccaggccagcagggccaacccgtgagtggtgcttcgtgtcccatccctgcctcccaccctgagtggggcggagcagtgggaattaaagaactaggccctttaaagcttaaagggaccctccctgcaggagggtctggggcagccatttctgtttctcctgccctgaccctggggatgcccccagaacctgcacccccaaacccctccccacccctccccctccaggcggagactggccaccctccccgggagagaatcctggggctgccttgcgtcatctcaccttggtttgcaggggcatccgggaccccgggggtggccgggacccaaaggatcgaaaggcgcagaggtaagagggccgggggttcagcagggagactgagtcccaggaagggggaagcctgacccacagtcacacagcaaaccaaacgcaggctgcagaggctgcgaggcagggtagggaggggcggcccaccaggagcccggcaggctgcttctggccatgaccccatctcccttcaaatagcctgagtgaggagggacaatcagccccatttcactggggctccaggaggggagccaactgcctgaggccaaccagagtgacttgaacccagggctcaccacactgtagagagaaaactgggagaagtcaattgagggggtctggaggaagaggaggcagagacagggtgcttgagcaggagccacttcctgcctctgccccagggcccctgccttcccccagcccccagactgggccagtgctctcttaatgctctttccctcccccgggtgcgcccccctcacctgcctgcctcggtgatacctagtctctaaaagatccagtggaactgtggcctctggctcctcccagaaaattgtcaatgccagtgaggggacaccaaggcccagagcaggctcagtgacagccccaggaggttccaaggccagctctggccccaggcttccaggccagagtgcttgggtacatctgtggcatcagatgttcacccaggggcccacaatcctctcagtccctccttccagagcccctagggtcccacacctctaccaggcagcctccatcatgtggcccttgatttttcagggaccaaagggaaagcaaggcaaggcaggggccccaggccggaggggggtccaggtgagtgactacagctgctgtttccagccaacctccctgcccgccccccacacccgccctcctcccactccctgcaccaaatgccctcaccagctttttatgtaccccccagggcctgcaggggctgccagggccccggggcgtggtggggagacagggcctcgagggcatcgctggaccagatgggcttcctggcagggacgggcaagcaggacagcaggtgagcgggaattggcattaacagatggtggctccatttgggaccaggtgtaggggaacttccccaggccatgggccagaggagcccgtttggaaacttggatgggcagaaccaacacatccagaagttctctggggtgggcaaccatctcctcccctggcacctgggagtgtggaccttctgactgtctctcctggatgccagcacccagaaagaccttcctttcctcccctgcctggtggatagggttcctctcccgccccttcctcactcagaatcccgcccttccccactcacaatcctcagctcctcctgtcctcctggtccagccacatcacacacaggccgtctgacctccatcctggagtgtgaccccttcctccagcttcacccagggtttgcccaggcgttgagccatctgcttccttggctgtatcgtgaaacacaagagaccctcctctgcctgctttcttaacagggggagcagggagacgatggggaccctggccccatgggccctgctgggaagagaggaaatccaggtgtggccggcttacctggagcacagggacccccaggattcaaggtcagatacctcttaatacacttacccaccctctgccctttctgccttgatgcagactctagtggttccgaccctttgggcacccatgtcccagggcctgtgtgaaaatggagtccacattgttgacctttctccgtcagcagtgcttgggggtcctgccccaagcttgaaccagaatgatagttcatctggggagctgtaaatatcgcccctaccaggcccttgaaaccttcaactggtttttgagttgtccacgggcgccctctcgtggacatttgtggaacaacacgttgcttgcagccgggatccccaaggcatccttagaaagcttcccagtgccgcgtgggaggagggggcccccatgaatccgtcagagccaagggctggacactgaaggggagatgtagatgaatgactcagatgtggttcttgccctctctgagctcgaggtttaattgggggaaagattggaaccctctgagacacaggaggcggagggagcgatggccttgacccagggaagatgtgaatgagaatagaaggggaaaaggtggccacacagtggctcacacctgtaatcccagcattttggaggctgaggctggcgaatcacttgaggtcaggagttcgagaccagcccggccaacatggggaaaccccgtctctactaaaaatacaaaaattagctgggcatggtggcaggcacctgtagtcccagccactcgggaggccgaggcaggagaatcgcttgaattggggaggcagaggttgcagtgagttgagatcgcaccactgcactccagcctgggcggcagagcgagactctgtctaaaaaaataaaaataaataaataaatggggaggaggcattctacgagtgtgagctgaggtttgaaggagggaactgcatgctgttggggaaaagcaataaggaggagaggaattgtgggagaggagaggggaaggcagggcccggaatgcgagaggagagacagagaccttcctctttgggaggtgaaagtcttgtcacccctaccccaccaggcctccatttgttgccccagcattctgcaatctcgggtaccctgtggaatcactgttctggctctcccaggccccctccgcctcctcctgccttagaaccccttcccactttgactggtaattttttgtgtgtttctttaagggtgagagtgggttacccggacagctgggtccccctggcaagcgaggaacagagggcagaacggggctccctggaaaccagggggagcctgggtccaaaggccagccggtgagtgagcgccaaagaatacacatgcccacgcactcacacatgcacacactcacatacacctacatgtacaaacacatgcacactcatacacacacacaaacacactgacccagaagccacctccttgctctgtgacaaggtataaaatctgggtaccagataccattctgccacccctcaaccaggtggtgggggaggctgaggaaagagacctgagtggttccttcagaatgaggagagggtgatcacaaccagaaggtgggcgctcctgactcccagtccagtgctcattctgtgcctcactgccttcatccccctgtcccagaggctgcattcaactcacccttgcctggaaaaagaaggaagaatgaacagagaataaacagggcaaatagaaaacacacaacaaacagtttcaataccccaattaaagctgagattgtcagagtggatgaaaaagcaagacccaactacatctgctgctacaagaaatccacttcaaatataaagatataagtaggttaaagatagatatagaaaaagacatactgtgctaacattcatcccaaacagctggagtagctattttaatatcagatgaaatgaatttcagagcaaagactactaacagtcataaagaaggtattttcataatgacaaagaagccaacttttcaaaatagcataagaatcataaatgtttatgcacctaaaaatagatcttcaaaataatcaggcaaagactgataaagctacaaggagaaatagacaaattcacaattatactcaaggatttcaatatatttctctcctaatgggtagaacagaagcaaacagaagatcagtaaggatgtcttgaactgcattatcaaccaacatgacctaattgacatttatagaacaccacatccaatatcagcaagatacacattcgttataagttcattcagaacatttaccaagacagacactattttgagccttaaaatcaatcaataaattaaattataaatcaataacagagagatctgaaagatctccaaacatctggaaactaagtaacaaatgtctaaatgacccatgggtcaaagaagagaccaaaagagatgttagtattttgaattgaatgaaagtaaaaaacagcatataaaaattggtgaaatgctgttgatatatagggagatctttatagtaataacttctgtgttagaaaagaagacaggtctcaaataaatggtctcggattccgtcttaagaaactgggggttggggctggagaaggcaaatttaaaacaaagtgagcagagggaaggaaataatgaaaatcaaaaataaaccaaaaaaaaaaaaaggaaaatcaaaagttagctttttgagatctgtaaaactgataaacctcttgccagactaatcaggaaacaacaaaaacaacaaaaaggatacagaagttactagtatcagggataggggagcaatgtcactacagatatgacagaaattaaaaggctaataagggaatattataaatgattttatgacaataaatttaaagacttagatgaaatggacaaattccttgaaagacaaaactaccaaaggtcatcaagaagagactgataacctaaatagccttatatctattaaagaaattgaatctgtagttagagcttcccacaaaggaaactctgggcccagatggcttcactggtaaatgctactaaacatttacaaaagaaataataacggctgggcgcggtggcttacgcctgtaatcccaacactttgggaggccgaggtgggtggatcacgaggtcaagagtttgagaccagcctggccaaaatggtgaaaccccatctctactaacaatacaaaaaaaaaaaaaaaattagccaggcgtggtggcgcacacctgtaatcccagctactcaggaggctgaggcaggagaatcgcttgaacctgggaggcggaggttgcagtgagccaagatcgtgccattgcactccagcctgggcgacagggagagactctgtctcaaaaaaaaaaaaaaaaaaaaaagaaggaataccaattctacataacttttccagaacattgaagaggagaagaataattcccaactctttccttgaggctgattctaccctgatgtcaaagccacaccaagatattacaagaaaaggaaacaatacaccaatatgcttcataaatatagctaccacagttctcaataaaattttagttagaggaacctaagaatatataataaggataatacatcaagaccaagtggagtttatcttaggaacacaaggatggtataacatttgaaaataaatcagtataattcactatattaacagactcaaaaaagaaaacccatttgatcatctcagtagttgcaggaaaagcatttgagaaaaatctaactccacttctgataaactctcaacaaactaggtatagaagttcctcaacttgataaaggacatccatgaaaaacctagtcaacatcatacttagtagtgattgactgaatgcttttttccaaggagcagagcagaaacaagtcaaggatatctgttctcaccacttctattcaacattgtactggcaattctagccagtgcaataaggcaagaaaaacaaataggaggtattcatatcaaaaaggaagaattaaaacttttcatttgtagaggaaataatgtctatgtagaagatccattggcatccacaagaaagctactagaataagtgagtttaacaaggtcacaagacaccatatcaatatgcacaaatgaattgtgattgtatatactaggcaatatgcataaatgaattgcatttctatacactaatcaatgagcacaaatgaattgcatttctatacactaatcaatgtgcacaaatgaattgcatttctatacactagcaacaaacaattagaaatggaaatctaaaaagcaatactacttataatagcataaaaacatgaaatacttagagatacatctgacattaagtgtgcaacatatgtacactgagaactatagaacactggtaagagaaattgaggaagacttaaataaatggagatatatactgtgtgcatatttcaaaagactcaatattaagatgtcaaatttcttcaaattggtgtattgattcaacacaattccaatgtaaagcttatcgggttttcatgtagaaaatgacaagttggtcctaatatacatatgaaatataaaggacttagaataactaaaacaacattgaaagagaagagcaaagttggcagactaatggcacttgatttcaagacttattacaaatctgcagtcatcacgaaactgtggtattgccgtaaataactaacagatcaaaggaacagaatgaaaggtccagacatataccatacatatacggacaactggtttttttttgtttttttgttttttttgagatggagtttcactcttgttgcccaggctggagtgcaatggtgcaatctcagctcaccgcaacctccgcctccaggattcaagtgattctcctgcttcagcctccccagtagctgggatgcaccacgatgcccggctaattttgtatttttagtagagatggggtttctctatgttggtcaggctggtcttgaattcccaacctcaggtgatccaccacctcggcctcccaaagtgctgggattacaggcatcagccaccacacccggcctggacaactgatttttaacaaaagtgcaaagacgattcagcaaatacaaaatagtctttcctaacaaatggtgccagacaagtgatgcctcataacatgtacaaaaattagctcaacctggatcatacacctaaatgtaaaactgaaaattaaaacacttctagaacatagaaggacatcttcaagaacttggataagacaaagatttcttagatatggtaccaaaagcatgacccagaaaagaaaatgtgataaatcagacttcatcaacatttaaaacttttgctcttcaaaggacactattaagagaatgaaaagacaagccacatactggaagaaaatatttctaaatcatgtatctgattaaggatttgtatccggaacctaaaaagaactcgcaaaactcaataataaaaataagcagcccaatttttttaaatgggcagaagatttgaatagacacttcaaagaaagtatactgatagcaaataagcacatgagaaaaagattaatatcattagtcattagacaaatgctcattcaaaccacaataagatgctatggcatacctattaaaatagtgaagagttttaaaagactaaccataccaagtgttggcaaagacatggggaaactgaaactttcaaatgctgataatgggaatttaaagtggtacaatcactatggaatcagttgggcagcttctttgaaagttaagcatatccctattgtataatcaaatcattccactcatagatatttaccctacataaataaggacattcagccacatgaagactatacttgaaggtgcttagcagctttatttataatagccccaaattgaaaaaaacctcaaatgtgtatcagccggtgaatagataaagtgtggtatattttgcaatgaaatacaattcatcagtaaatggattgaactattaatatatgcaacaacataagatgattctcaaaataattaggctgagtgaaagaactcagataaaaaatagtatagactgtgtgatttcatttatataaaattatagaaaatgcaaactaatctgcattgaaagaagatagatcaatggctcctggagatgggagggtaggcaggaaagaaagattacaaaagggtgtgaggaaagtttctggggctatgggatgttattgtcttggttgttgtgacaattacaagggtgaatacagacagatatgtcaaaacaaatcagattatacaatttaaatagtatagttattatcttcagttttactttagtaagactgtttttaaaattaccccttctttgcacctgatgggtgtataggagacagccatcagagtgcaaaaatgaacagttaggacatcacgcaactggttctgtgaagccagtattatcctgataccccaaccagaaaaagatgtcacaagaaagaaatcaacagacaaatatgccttatgaatacagatacaaaaatctttaataaaatattagaaaaccaaattcagcaatatgcctaaaggagtctacaccatgacaaagtgagatttatcctagaaatgcaaagctggttcaactgttggaaatcaatcaatgtaatacaccatattaataaaataaaggacaaacattatagagtcatctcaatagatgcagaaaaagcatttgacgaaatccaacaccctttcgtgatgaaaacacaacaaactaggaacagaagggaacatcctcaacctgatagagaatatctgtgaaaatcccacaggtatcatcatatttaatggtagaggactgaacacttcccccaagatcaggagcaagccaaggatgtccactgttaccacttctattcaatattatactgaacaaaattagtagaactaataaaccaaagttgcaggatataagatcaatatacaaaaaatgtcatttctatatataacatacaaacatcaattatatgtctatacactagcaatgaacaattcaaaaatgaaattaataagacatttccatttataatagcatcaaagagaataaaataggaagaaatctaacaaaagaagtgcaagaagctgggcatggtggcatgtgcctatagtcctagctactcaggaggctgaaatgggagaatctcttgagcccaggagttcaagtccagcctgggcaacatctcaagaccccatcttaaaaaaaaaaaaaaaagtacaagatatgttcagtgaaaatttcaaaatgttgatgaaataaaagaaaacctaaataaatggaaagacatctcatattcataggtcagaagactttgtgtggttaagatggctatacttaccacaaacagagctacagattaaatataatccctatcaaaatccaagctgactttttaacgaaatctgacaaattgatcctaaaattcatatggaaatgcaagtggcccagaatagccaaaattttgatctttaaagaagatcaaagttggacaactcacacttcccaatttcaaaacttattacaaaagtatagtaatcaagacagaaataaaaccttacatttatgtctgttgtttttagcaagagtgctagggcaattgaatgggaaaagaattttttttcaataaacagtgctgagacaatcacacaatcacatatcacgtaccagagaagtaatttggacctctgcttcacaccacatgcaaaaattagctaaaaatgaagtatagaccaatgtaaaggctaaaactgtacaactgttagaaaacataaaaacacatttttataaccttgtgttaggtaatagtttcttagatatgacaccaacaaaagcgaagtacatagattggacttcatcaaaatcaaacacttttgtgcttccaaaggcaccatcaagaaagtgaaaaaactcacagtaggggagaaagtatttacgaatcatatctctgataaggaacatgtatctctaatatataaagaacccttacaactcaagaataaaaagacaatccaaatttaaaacggacaaagtattcaagtagacattttttccaaaggagatacacaaatatccaataagcattgataagacaaatgaaaaccaccaagagaaccaccaatagctcaataaagctattatcttttaaaaatgaacaggtagaatttagattaaatgggaccctcccgaagcctgacccctcagcctacctccatcagcactgggtcttgacctgcctggtctcattgcatccttccagccccttgggagggagatgacgtattatcctattttacagatgaggaaactgaggctcagtaaagggaggtgacttgctcctggtcttataatataaggctaggagattctaatacatggctttctgcttatgagcttgaaggccaagccccaagaatgtgtaataatggcaggctcttctgcctccaggggcccccagccctcccttcttggctcagaccccagcatgcccccttgccaattgctctcctaaccctttacaagattgggagcagaggtcaggaaaggaggccaaaggttcctggaatcgttcacactgggtttgaatctagcacagtccacaacatggtgtctgcgtgacttttagcaagttcctgccctctctgagcctgtttcctcatctgtaaacaggggatatggtgtgtccctgggttgatgtgggagcatggaagtgtggcggtccaggcaaaacatccggcacctaacaggccctcagtgaactgggttatttttagtttttaggggaatccttccttaacagagcttttcagagctgtgggaggaggctgcaggcccttttattctgtcccttgaagacctgggacaggagctcctgagtgtggcagagcctcctctgtggaatccctgagccgggctcctctttctcatctgacggagagcacaggctcccctcagagcccaggcggactggcatctagtttgtgagctgttcacactcacttggtcgcttcacagaggagtcactgatatccctggaaaggctgggagggaaaaggcaggccctgaggtcccaggtggctggcgggacacgctgaccatgagctcactcgctccatcacttcctgttcttcctgcagggcgactctggcgagatgggcttcccaggaatggcaggtctcttcggacccaaggtatggactcccacggctcactgttcctgtggggtcccatccattcaccccattcattcatttattcattcaacaaatatttatggagcactgaaaacattggctggaaaacagccagaatcaggcatgaacaccctcatcccccagtactccagaagatctaggttccaagcccagctacacaattacctgctctgtgccttgcaaagtcacttagtctctctaagccttggtttcctcatctgtaaaatgggagcaatgacagtagaagactgttgcaaaaataaagaccaggggcatatgccacacagcactgagccaacacactgctggtacctgctgaataattgtaggtgtttcttactccttctggggcctctcaggtaaggcctctcttgacaagaagggcaaaggttgacagaccccaggggtgagggagctgtgggggccctttacccagtggctgccaagtacagacagccctttctctgcctcccacagggcccgcctggagacattggcttcaaaggcatccagggccctcgggggccacctggcttgatggtgagttccctccctgctgtcggagcagagatgattgtcctaggcccaaggttggccagccatcagctggcctgtcttcatcctcctcttgctccttgactcatgagccctttctgcccacaggcctggttcccaccttcactcctgccgttcccaccagctcagcccccatccttccccgctttcactcttgcccccatcgccccactcttgaagtccacccctaggcacaaatgaggggctcaggagatgcatggcctgggcccgcttcagatggtctcccttctactcccttgcgacgctcgggctgccctccaccccgctccccgtgtctgttccccaggccctggaacaaggacacatgagcctttctgtctcctttagggaaaggaaggcatcgtcgggcccctcggaatcctgggaccttcgggactcccggtatgtgtggggattggacaggaagactccggggtccccttgccttcctggctccagattgtctctgtgactcagtgccagtctgagcctcagtttcctcatctggaaatggggcttcacctctgggccctgtctcactgggccgtggtttgttgcagggtccgaagggtgacaaaggcagccgtggggactgggtaagtggatgggctggggctgagggatgcagcactgcaggggcgggggaggggtgggctcccagagttgggccatggctcagccaggttccctaactctctcccctgcttctgtctccctccagggattgcaaggtccgagggtgagtgggctgggcatgagggctgtggggcggggcgtggggcgggcaccctgcattctcctcccggtggtacattctctccctccggacctccgtcatcccgtctgtgccagaggaaccattgtccctgggtcccaggtctgcttgaggagggactgggttggggagagatgaagaccctgtggaccagggctcactcttcttctcttgttcccccagggtcctcccggccccagagggcggcccggccccccggtaggtaactgagtgctgggtgcatcttggactcctggggggttcctttgaaggagattcaaggcttcaccggcagactaagccttgaccctgaaccccacaggggttcttgtagcccacagactcctaggagagtatagggcatcccccgaacattcacttttgcctacgtggggtaacacctaggggccaggcctccagaaaagcatagaccagcccactggggcccaccaagcctccgggaaagcagaggccagcttggcaggtcctgcatgctttgatggtctccctggtctcctgacaccctctcagattccagcacactgtccctgtcatttgactgacccgcagtcttcttttgcagggtcctccagggggtcctatccaattggtaagttggaaaccttctcttttgcctacttggggtaaggcctgaggggtttgggggaagaggctgctggccctctctggccctggtggctagagccctaagctgggtctagggacgcccatgtccttttgtcacttcatactggagacttggacccggaagcaacagaacgagccctgggccaggaggcaggaaacctaagtttttgagttgcctctgactgaatccgggaagatgctccagccaccgggttcatggccctatctgtgtactccatacacgtgggctgattgcaagggtctgtacatctcagattctgaatccaaagagagttggggccgggcgcagtggctcatgcctgtaatcccagcactttgggagttcgaggcgagcagatcacctgaggtcaggagttcgagaccaacctgaccaacatggtgaaaccctgtctctactaaaaatacttaagtagttgggtgtggtgggtggcacctgtaatcccagctacaggagaggttgaacccgggaggaggaggctgcagtgagccaagatcgagccactgcactccagcctgggaaacagaccaagactctgtctcaaaaagaaacaaaaaaaacaaaaaaaaaaaaaaacaaagagagtcgggccaggggggcagattggggcccctgcattcttccctattggccactgtggccctatctgagagcatgactcctcccaagccctatgacgagtccatccacattgtactattgcacggtggctacacgactattaccatcaggccccaacagcatcccagggcacagcctcgaggaaagactgaatgggccaggagcccttgagccatgcgtcattcagaacctctgctctcctcatgcctgctctcactgccactccctctgcaccatcctcaaagacagagtgacagccctggcctctcctctgcagccttcccttgtccttctcatcagtaagaaaggcagggaaaggaaagtgaaaagatccaggaaaaacagaaaattagaggattttgcatttttttgaataatcactactaatgctaattgagtgcttgctcaatgccagacaccattacaggtgctttgcttttctttttttttcttttcttttttttttttttgagacacagtcttgctctgtctcccaggctggagtgcagtggcacgatctcatctcactgcaacctcctcctcccaggttcaagcaattctcctgcctcagcctcctgaatagctgggattataggcgcgaaccaccacgcacagctaatttttgtatttttagtagagatgggttttcaccatgttggccaggctggttttgaactcctgacctcaagccatacacccgcctcggcctcccaaagtgctgggattacaggggtgagccaccgtggccgggctacaggtgcttttcatgtattcactcatgtgttcctttcagcagttcttgtgaggaagttttattatcaggtccattttcaagatgaaagaactgagaaagagttaagcagctttccccagattatgcagttagtaagtggcaggtctggaatttgaccctgaggagtagccccagagtcccccgttctggaccccaggcctcagcttttgctgttttcatggcaagaccacggctatgtctctgccaagcccagtggtagggttgggagtgcaaagttatattagactattaaagtgcgagccaaaggagaaacacggggactgggggcatagagaaagggggcctccctcatcttagcctggagtcagaagcttcgggagaggcttcccatcacaactgacatctataggatgagtctagggcaggttttctgagacacagtgcaactgacatttgcataattctttgctgtgagtgactgtcctggaggatgtttagcagaattcctggcctctaaccaccagatacaagtagtaccccctcccccggcttgaacaactaaactgtctccagatattgccaaatatcccctggggggcattgtcgcctctccttgagaaccactggtataggagatagccagatggtgcattgaagggagggagaggtcctccaggcaatgagaacagcatgtgcaaaggccccatggccagatggatcatggcgtttaggaacttagaagtactatagtgcggctggtgccagagcacatatgagggagaggaaggagacatggctcaagaccacagtgttcaaactgggtcttataaccatgttgaggagtctgaacttaatcctgagggccatggggagctattagtacctggggaaagggaatggcagggtcagctttgactgtctgcaaagagaggaaggaccgagagttctgcagagggcatatgacttggccaagatcctgccagggaatgtggccctggggctcccacttgatgggtgtggagaaccctggggggccacgatacataccctgtcttttccttgcccagcaacaagatgatcttggggcagctttccagacgtggatggacaccagtggagcactcaggccagaggtatctccaggggctctccccatgtgggatcccttcctgggagaaacgcaaatagataatggcccacatgtggtcagtgccttccatgtggcctgcatggagcatttcagagtcctggtcttggtggcatctcgcatccacaaatgggggtttgtactgaaactcagaatgggcagtgagtccaaggtcccatggccagtgcaggcagagcaaggccagaaacaggccctgaacccttgagctttctccggaggcctctcagagtctccaagctcttgctggctggagtcagggggagaagcttgcctgggcccagagcccgcagcagcttcccagtgctcatccccacgtttcttcaggagtaagaagctcatggttagctcgtggggctctgctaagaacctgccctgtggttaactcagctgtaagactccaggctgagaagggagtcccatgtcctctagtccagcctcggtcaggagccccctttgcagccttgcctccttcacatgacagggaacttactgcccccagctcaaacctcctatgaacatttcggtttgttccctgtgctggatgctgagacagatggatggccagtcacagccttgactttcagagggctcacagtctagggtggaggacagcatggatgagccccttaccatctgtccggggaggtcagtggaaagagaggggaacactcaggatccagtgcggctggagaagggaagcgtttccttccatccctagaagccagtgatgccgcacaggagagcgctgacctgcaacatccttaacatgatgaaggaaagtggctccgtttatcaagcacctcctacccactctgcattggcggtagaatagaggcttatttctcgtgcacgtaaaagttaattggcttgttgatgagagaccttggctacctgccaggggctctgccctcttcctctcccacacgtggctcccaaggtcactccacaccagggggaggcaccaccggggaaagagagtgtagagaattgtgcaggagggtctctgggccaggcctctatggggctagcatcgctccacttccatcccgttggctagagcacaaataaggctgaagatgtagtctgtccaggcagaagaaatggattgggtgagcggctgctggtctctgacacacgttcacacatgcgtgcacacacacacgtgacctccgccacccccagtggaaggagggtttatttagctctgatttgtagctctggaagctgaggcttaagggagaattctggccagggtaaccctgaatggccggctgtttagcatctgtggtcccctcctgccccctagtggagatctgctccttctctgagctgaagtcctcctcccagcacttgtgcctgctggccccagtcccgtctcctggtgcctcacagagaccctggctcccaccctaggggagcccagtgggggctgtgtgacccccaagtcagctccccccagcacctccccttcctccacaggctctttgcagatagagattgggccgctgccgagtgtcccacgcaccctcgcctacctcattcacggggctctgcctgtcccatatcagagaacatggtctgaccctgagctcttttcaagcctctgagccattgtgatagcctctcctcctgcactttgtccctggcccgttttcttgtctgcaaaataaagagaaacccaacccgtgctctagccatgaccgtggaaccgagatacctcccaggttgtgagaactgggggctgtggaggcttgaaccccaggctggaccaggaccctaaggtcccaatgaccaccctctcctcgtgacagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtgagaaggcttcctgccgggggtgggtgcgcctggcggtggggagctggggcaggtggagtatttgatttccgccgcattttggctgagtttttgtcctcagcaagacagatacactggcagtcatttattcactcagcagtcacagagcctcacaatataccaagatccgcatgctggggatgaccatttcagtgcaaagagacaagagctctggcagaaaaagctcctgaggctgtaagagtccccacccctggggcccatcctgtcacaggctcccgggtgagccaggattttccccctttctgagcatgaggactctgctctctcatctgtgagctgatgtggtgctgtgaaggacaagctgcggagccagacagacctgagttccaatgtcagttctgcctcagacttggtctgtgagctggggcaagccacggccccatcccgagctgcccttgcctcctctgcacaagcggctgggactagatggctggttgttccactcttgagctgcaaaggttttggcttcctgagaagcccagtggggaagctagatgtaagcagcagcgctggctgatggggtgggagacctgactcctaccctcccccggcaggccctaggaggagccctaggcctcgaagaatccattcaactaggtgatcccccaaacccttgtgcaagtgacccagcctctctcaatgtcagttgtcttctctgtaaaatggatacatcccagtagcaacataggcaagtacttagccatgtgacccctcctctgggggctctgccagttgtgagctctgcccagaaggtttccttccatctcggttggaggaatcccttttctgctcacccaccctgacttcatgctcacctggggctcggcaggtcacaagatgcagggtccatctacagaaccaaggaatgggctcatcccccagatacatacatcacctccatcccacgctgcctgcaggtacctactgggtggatccaaaccttggctgctcctctgacaccatcgaggtctcctgcaacttcactcatggtggacagacgtgtctcaagcccatcacggcctccaaggtacccatcagctcccacactgcccaccaggctgtctgcctctatccccagcctgccctgggccacaaccaacccaggttctgttctgagctgtgcctgtcttactgcatgcccttgggaaagttatcgcctccttccgagactcagtttccttatctataaattgggagtgagtaggactaatttgtaaccacaaaccctttcgagtcatatgatgctgatgattctttcttcaaatagaatcttctgcctaatatctaaagcagagcagttggccaagctggcctggcttgtggaactatgaatcatcagcatgaaataaaagagaaaactagcatgatgctcatctgaagcatgttgtgtgaattatgtatgcgaatacttaactcatgttcaatgcctgcgtaccacgtgcctgtttctgggttgagcattttaggtggtacagggccactcaacaacaaaccaaggcaggtggcagcatgagacctgacagctccctcgcccagggatcctcagtggattgtgggtctgtagttccactaagccttccgaatttgggggcaatttatgccacagtgagaagctgctccgactgcgggggaaaggaaccctcccatttcatcagccacatcccctaggagatgccttgtgctgactgggtcagactggcagtttgagaatctctaggagaggcagccagccagtagccaggtctttgttgggtccctatcatgtgccaggccctgagccaggacggggaggtcagactcgaaactcccctgcggccagagctcacagtccagcagggacttggtgacctccacaggctctcttccctggtgactcgaaggttttgggatcacgcagcaaacctgcctagcagaggggtgaggctggagttggcgcctgggttggtggcatgaatgcccaactgggtcaccttctccatcagaaacaatggcagggagaggccctggctctgtgtgggaaagtgctgaagccacaaatcctgccgtgttgtttgctctcaggtctgccatttccggcagcaccccatcgcacctcacagggatcttgggacttaggaagggtctcgaaaacacctctcatttcctctgcattccatgagcctcttagtcttgggcaaaaccctctccctcgctgagctcctggatcctagctcagcccaaagaccccccatacagtaagggagtggatcagatggcaccaagatctttgaagctctggctctggagtcaggcaggcccttcccacttacgcagccaagaacctgtaagaccagctcacgcagacctcagtttccccgtctatcaagtgggcacatgtctgggagcatatcaggaaatgcttgccaggaaggggcctatccctgttccctccatagagaggcagggaaccctcggtgtggggggtgtggggggcagcctgagccgctcactgccgttgcttctctataggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtaactctcagagcccctcctaggcccttcatgtggggacaactggaaaaacacttgtttggaaaaatgtgtttctattataagattatatctaacattttaatagtatactatattaatgtgatagatatgatttcatctttgtgtaatataacagttttctaaaatcgtttttactcactttcctctctgggaagctatgaggggaggtctgggctggtaaaaattctttgggctagtagatgttgtacttacttgcaaggctctttcaaagaagatacatttcttcttcctgctcccaccctagtcaggctaatttcttctcattatattttttggtcattttcaaatgtcctgaacagggtgggttgtcaggggaggggaagacagaaagttgagaaaaggcaaaaatcagttttataagactaaacaaaactaataatactacacagtgttcatgaggatgtggggaaaccaacaatctcgcatgaagctgttggaagaaaataaattggtagaggctttctggatagcagctctaatatatatccaaaaccttagaaatgtacttattttcaggggagctaagctatgaagacacaaaggcataagaatggtacaacggaatttgaggacttagggaaaagggtgggagaggggtgagaggtaaaagactacacattgggtaccgtgtacactaaagaacttattcatgtacccaaaccccacctgttccccaaaaacttattgaaaaaataaattaaaaaatatatatatatgtatatgagatgtacttgttttttggtctagcaatctagaacaatccttctagaatttgttctagggaaataagaatgcacacaaaggtttagttacagtgatgttcatgacagcattccttacaagaataaaaagagtggaagcaatctaaatgtgccatataggtcattgctacaatgaaatacagtatagccattaaaaattgtgaggaaagatggaagggaaaatgctcatgatgtatgataagaatcacgatggatgtacgtgtgcacttttccttctgccttcaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaagcatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgacacgcctgtggtcccgtgctgcttctcaaagctcaggggggcagtttctggctgggctgggatagggagtgggaggagatgctcagaggatgtcctccttacgctgtaacaaataccacaaacttggtggctgcaaacaacacagaaccgtctctctcgcagttctggaggccagaagttcacacaggcagtgttggcagggccacactccctccaaagcctcaaggggaggatctttccttgcctcttcccgctcctggtagccccagtcattccttggcttgcagctgcagcacttcggtctgtgtccctgtggtgacacgtgttctgatgtgtctctctgctccatcttctctttatgaggaccccagtcatattggattagagcccacactcatgaccccaccttaacttactttcatctgcaaaggccttatctccaaatgaggtcacattcactggtgcagggggttaggacatatcttttggggggacacgattcaactcctaacacacagggaggaggtacactgaggttaacatgagcaatttgtttttattattattgtggttaattacacataacataaaatttgccactggtgatagtacattcagaatggtgtgcaacgttaccatgatctaatttcgtattattttcatcacccctaaaggaaacctgtacccattttagcagtcccaccctcccccaacccctggaaaatcaccagcctgctttctgtgtccacggctctgcctactccagacattttatattacattggtgccaaagtaattgcggtttttgtcattacttctaaatggcaaaaaccgcaattactttggcaccgacctaatacaagtggaatcatacagtatgtggccttttgtgaccccggcctctttcactcagcgtgatgttttcaagattcatctgtgtcgtaacgtgtatcagtacttcattctttttatggttgaatgtactccattgcatggataaaccacattttgtttacctactcataagctgatggatatttgagccaaactggtggacatttgggctgtttctacctttggctattgtgaataatgcttcaaaaggagtgatccctgcctgtcacattcttgagagaagtcacaatagtacctgccacggaagaagtgagtgggtgtgagtctgggagatggcgttgccagacttaaaaaataaaactataggatgcccagatcaatttgaatttcagataaacaatagctattttttagtacaagtatgctccatgcaattttgaggaaatgcttatgctagaaatctttttatttgttatttatctgaaatttatacgtatctgagtatcctggcctggagcccacatttcctgacccttgtttcagatctctttcttcctcagcttattcctccttccctgggacaatgaataatcagaacttttctgccattctcattgaggagaaagagcacatcactaacagttgagtttatacccaggattttatattttaaaaacttgcagccgggcgcggtggctcacgcctgtaatcccagcactttgggaggccgaggtgggcggatcacgaggtcaggagatcgagaccatcctggctaacacagtgaaaccccgcctctactaaaaatagaaaaaaaattagctgggtgtggtggcgggtgcctgtagtcccagctacccaggaggctgaggcaggagaatggtgtgaacctgggaggcggagcttgcagtgagctgagatggcgccactgcactccatattaagggatttattatatgaaattggctcatgcaatgatggaagctgacaaatcttaagattggctgctggcagctttgagacccaggaaaacccaacggttcagttcaagtccaaaggcagggaaaaaacctgtcccagcttgaaggcagtcaggcagaaggaattcgctcgtactcagcctgtttgttctattcaggccttcaactgattggatgaagcccagccacattggggagggccatctgctttactcagtctcccatgggattacccaaatgttaatcccatccaaaaacaccttcacagacacacccagaatagtgtttggccaaatatctgggcaccctgtggcccagtcaaggtgatacataaaattaaccatcacactcctcaagctgaggttgaaagagaaggaatagaagtgagccagatggggaagggcacttggggtagagggaacagtgcctgccaaggcccagaggtaaaggtagcactttgcatttgggaacggtaagtgttcccatgtggggctgcaggaaagggtgaggaagcctgcggtatggagctgggaacatgacaagtcacaggtttgcacagatgagcagaggtctgagttggcaagttgggtttgactgccatggggccctggagcagagccatccaggaggcagctgcctgcgctgcgaggaaaggagagaggtctgcactgcactcagagctctggaggcatcagcagtttctgctaggcctggaagacatgggtagagattgaaaaagccagccagaagggccagagggggaaagcaagaagagccatgttagaactgtgacactcacgactctcggcctggtctccaatcccaggtgggccagtgaggatgctggagctgggccagctcattcccagcaggggcagataggaggttgttggggacagaaggaaacttttcctaaactggcagtacccacagttcccaatctcctgttgcacaactgagtgtcaggaaacagtcaggtggacttcccaggctgggccaactccaggggaaagcccaggccagcctgtttgccctgttcacaatgaatcaaaccctagctatggtcacaacccataatggccggcagcccaggattggaaaaatgaggaaaagaagagcgagaaaaagagaggctggcaggcagattccagttcctgactgggacatggccctgggtaggtcattctttctctctaggcctcagtttctctctctgcaaaatggggccgatatgctctgcctttcttgccagccacagaaaggactattgttcaataatagtagagtgaacggtatgaaatagaataatatccaatgcttttggacctgcaaaacccagtttcatatggttcaacccaagaatagcaccattcagaagaataatggctacaatttcttgtgcatggacggcacaccaggtggcatgctcggtgcgatctcatgcgcatgtgcatgtgatcccacattttcatctcatacacaatctcgtgggacacatgttgtaaccctggcttttcagatgaggaaactgaagttcaaagaggtttcttaagttgcccaagatcacaaaacaggatttgaacttgagaaaatctttttgggtctttcctcagcccagtcacagagttccccatgaggacaatttgctcagcctatgtattctcatgtggaagcaggtcacaggttggtcttacacagaccttggctctggccttgatgaagaagggtggaatgtgactttttcaggaaatgaagtgtttcaaacaggtgcatttccctgatgacttccagctcacctgctgtgtgacgtttcccacactgcctcgcctctctgggccacttttttcctcatctatataatggggggaatgtcttattttcttgagcctaggatagacacgttttcatgttttgatatctttaaaagagagatgtagcttgcaatcactgaagtacatatgcaatgcagaaatttttcttccctcctcaccccagcttgtctgggggatggttaaactgacagcgatagttattataatcagaagacccttaggagcaaatttattttatttaacaagcattttatgggtgtggtagctcatgcctgtaaacccagcactttgggaggctgaagtgggaggatcacttgagcccgggagttcgagaccagcctgggcaacatagtgagacctcccatccctaccaaaaaattttaagaactttaaaaaaccaagcattacaactatgtaccaatttaatcttcataacaacccaatgaagtaggtaccactattattctcattttacaggtagagatactgaggcacagagaagttcaccaacttgcgcttcaccaccagcctgtactgcctgccctgaggccttttctctctcttttgttcctgcctaacttcttttgacatcctgccagggccagatggaggatagggccagacgagctagaaggactacttaaagcctcagtctttagaggcattcatgcatacctgaaatgttaggagacagagaaaattgtactgtggtagggtaggtgccagatgagcttggaggaattacttggatagtctaaggtggagagtgagacccccaagcggcagcctgagggacagtgaggacactgaagaccacttactcctgccaaggagaggcactcggaagcgcctctgtactgcattcacagtgcacagctccgctttgaatggtggtagctctccttattcacccttcccctacacaggctgcgcctgggatctctacactcgagcagacggagaccccagaccccattggcctaagtgcctgaacgttataaatcaaaagtattttaaatgaagctgacatgtttacatttaagttttagaaatttaattaattatcccagcactttgggaggctgaggcgggtggatcacaaggtcaggagatcgagaccatcctggctaacccggtgaaaccctgtctctactaaaaaaatacaaaaaaatattagccgggcatggtggcgggcgcctgtattcccagctactcaggaggctgaggcaggagaatggcgtgaacccaggaggtggagcttgcagtgagctgagattgtgccactgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattagccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcagtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaaggacagaggtgcttatctgttatttaataaactgttgtgtgtgggtgggtgtgtgggtgggtgtgatatgtggggctctctaaatccctgggccccaatagtccaggtctaatggtggtgctgtccccaacaatgctcagcttctcctcaaaatacatggtatctgggctgggcacggtggcttacacctgaaatcccagcactttggaaggccgaggcgggtggatcacttgaggtcaggagttcaagatcagcctggccaacatggcgaaaccctgtccgtaccaaaaatacaaaagaaattagccaggtgtggtagtgacacctgtaatcccagctactagggaggctggataggagaattgctggaactcgggaggcggaggctgcagtgaactgagatcgtgccactgcactccagcctgggcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtccccatcatctcacccctggaccactgcatcagctccagctggtttctcaggtttaatctccttccctagccctccccattcttcccattcagacagagcgatctttctgaagaaccaatctggttatgcctttccaacccctttgaaatctttccatttctctcctacacctcctaagtctagcgaacccctcagcctggcttccatgccctgcaggctccatctcctgccaacctcttcaacataaagtctggccactcccacttatcatgtgctccagctgcacagactttccagctccctgatacacccactctctcacctgcgctcttccctcttgataactccaatcattgtttcaagcctcaaattagagcaatgcaaattcaagaaacaaaccaagctggcaaaaacacaaaaaagaaaggaaaaaaaaagggtcatttctgttctgacaaggatggggataaggagactcacttgtacactgccaaactgacattcaaaatccttagtgcttttggatttgtcatgtttgggaggagggtttttaaatcatcggctttcttgaggttgaataaataaaagaaaatgcacacattttaggtttactgttcaattagtttttacaactatacgtgtgtgtgtataatggccaccacgatgacaacctggatcgttgtcatccacttcagtgttctctcatatgcttttgcagtcaaattgccctcttttgcccttggcaaccactgatctgatttctaaaattatagatttgtttgagctgttctagaacagaaccgtacagtatataagctcctttgtatctggcttcttttgttcagcatagtgtttttgagattcatccatggtgttatatgtatcaatagtttaactatttttattgttaagtaatattcctttgtaagaaaatgccacatttttatttaccattttcctgttgatgggcatttggattgtttctttctttttttttggtttttgtttttgcttttgtttttgttttttagacagtcttgctctgtcaccaggctggagtgcagtggcacgatctcggctaactgcaagctccacctcccaggtttgagcgattctcctgcctcagcctcctgagtagctggtactacaggcgcatgccaccacactcagctaatttttgtatttttagtagagacggagtttctccatgttggccaggcttgtctcgatctcttgaccttgtgatccgcccacctcggcctcccaaagtgctgggattacaggcgtgagccgtggtgccccacccttggattatttctaattttggctattttgagcaatgctgttatgaacattaatatgtaagactttgtgcatagcacgtggtttcctttcccttggatactaaggtaattttaaaagggaaattggctgctctctgacacttatcatcagaggaaaaatcacaatatgaaatgctgttagataggctgggagtggtggctcacgcctataatccagcactttgggaggctgaggcaggaggatcacttgaggccagaagttcaagaccagtctgggcaacatagtgagactctgtctctacaattttttgttttttaaatttaattagccaagtgtggtggtgcatgcctgtagtcctagctactccagaggctgaggtgggaggattgcttgagcccaggagtttgaggctgcagttgagctatgattcataccactgcactccaacttgaagagcctgaaaaaaaaaaaaaagtgctgtagacataaaggacatgactaagtaggttagaatatagtaagcgggccaggcgccgtggctcatgcctgtaatcccagtactctgggaggccgaggtgggcagattgcttaagctcaggagttcgagaccaacctgggcaacatgatgagacccccatctctacaaaagtacaaaaagttagccaggtgtggtggcacgcacctgtggtcctagctactcgggaggctgagctgggaggatctcttgagcctgggtggcagaggttgcagtgagccaagatcccaccactacactccagcctgggcgacagagtgagatgccatttcagaacaaaaacaaaaacaaaaaaagaatagagtaagtgaatgaaaagttgtgcatccattacacttttatttatttatttatttatttatttttgagacagggtctcttgctccatcatacaggctggagtgtagtggcaaaatcacagcttactgcagctttgaactcctgggctcaagcaatcttccagcctcagagtccagagtagctaggctttcaggtacatggcaccagacctggctaatttttttgtttgtttgtttgttttccttgagacggagtctcactctgtcacccaggctggagtgcagtggcgccatctcagctcactgcaagctctgcctcccaggttcacgccattctcccatctcagcctcccaagtagctgggactacaggcgcctgccaccacgcccagctaattttgtttttgtatttttagtagagatggggtttcaccatgttagccaggatggtctccatctcttgacctcatgatccgcccgcctcagcctcccaaagtgctgggattacaggcgtgagccaccgcgcctggccgacctggctaatttttaaatatttttgtgtaaagatagggtctcactatgttgcccaggctagtcttgaactccaggactcaggtgactctcccatcttgggtccattaagcttttaactacaaactacactgaaatatgaaagttattcagaatgaaatgaataagaatgcaaaattataatcataccgtaagaatactttctgagtaatcccagcactttgggaggccgagacgggtgagtcacctgaggtcgggagttccagaccagcctggccaacatggagaaaccccatctctactgaaaataacaacaacaaaaaaaattagctgggcgttgtggagggcaccagtaatcccagcgactcaggaggctgaggcaggagaatcgcttgaacccaggaggcacaggttgcagtgagccgagattgagccattgcactccagcctgggggacgggagtgaaactccgtatcaaaaaaaaaaaaaaatgaatactttctgaaagtatttattcatacaaataaagacttgacccgtgaggtaggaacacaaatgggccacggaatcactcattccacagaatataccgagtgcccttgaagtgctgggcactgctccaggattgggggcgtattggtgaaagagaagcaagctgcctgctcagatggcagggaatgggggaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacacagctgttgccacactcagtggaactgaatctatgtttgtcttccccggcatccttcaccccaactctccccgccacaacatacatcccatgccagcctggggaccctcaaaggtggcttcatcattaggtttgtggctgggtcccactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcggacccccactcccggctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccaggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaacggagaaaggccctgacagccacggtctgtgtgaggctcctgagatctcatgtacagaaagtgcttggcgtggagctgggcatgcagcaggggctgggcacacggtggcccaaaggagccctgggccttcactgatgggctgtgtggccactgacacacctaggcctcctcacctgtaagacagacaccattgtgccatcccatgttctcacccagaggctccttttctcttccagtgggaggccaagagcatttcgctcacttgctgatcctcagggacaccaagacctacatgcttgcttttgacgtgaacgatgagaagaactgggggctgtctgtctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccactcatttttaatacccgtgcagtggggaattgatactgtggttttcaatgtcacccacactgcagcacggccacagtcaccatcccgatttttgctacaaatgaaaattactttataatgagctccttaacacttttctttaaacctgtgtttggaagacttgcgttggtgtggccctgtgcccaatacctgtgaaatcacagcaccgatgagctggttccaatttttaaaatatatacatgcagtacttccatgactattcaaagaaaaacaattccttccatttgccatctgagatgaccaccagtggtgtgaactacctcctgcccccatctgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccctggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagttcaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggacgtgtcctcagggtgctcacctgggagacccagaagaaggagacaacacgtaagggtgaggctggtccctggaaatcagttgacatcttgcaaatgtggagccctgaggtggagccaagcccgaggcacagcccactcagtggcacaagccacgaagggccggcctcacccagacctgggggctcatgattgacagcctcttgttacgtgagggaagcagcactcctcccgtggcagaaaagttgggcctgagttgttccatctattccgtatgtgcagctgcgtacaccatacagggtgataagaccatgagcctgaggctctgacaccccagggtccagtcctgtgtcctcaggcaccactcccctttgtacctcctgtcccaacagccaagctccacagggccaagactacagcatcctttgctcagcacccaaaccactgctgtgcccacagcacggaggctggggacaccgagctgatgtcctcagaaggcaagtggacaggacagcctctggggtcccacagtggcctggaactgaaggctcagaacctaaaagaagtttccccatttcaatgttactttcagtaagacaccattttcaaccatactgaggaggatccgctgaaaaatgaaacagaaatgagtcgtgatgggcagggcagggagaagcaagggagacgagaagtggggaacatggaaggaaaagccacgtgaggaagaaaccagaggtcaagagaaaaagaatcatggaggtagaggaagcaaaaaacacacataacaaagaatgtggactttggagtcaaactaatgtgagtccaaacccaggctctctcccaaaccagtttgggcagatggcccagtggaacctcactctcctcatcagtaaaaagggggcagagtgagggtcctgagagctagtacagggactgtgtgaagtagacaatgcccagtgtttagcgtaagaatcagggtccagctggtgctccctaaacagcagctgctgttcactgttgaaaggcgctctggaaggccaggcgcggtggctcatgcttgtaatcccagcactgtgggaggccgaggtgggcggatcacctgaggtagggagttcgagaccagcctgaccaacgtggagaaaccccatctctcctaaaaatacaaaattagccaggcgtggtagcacatacctgtaatcccagcgactcgggaggctgaggcaagagaattgcttgaaaccagcaggggaggttgtggtgagccaagatcgagccattgcactccagcctgggcaacaagagcaaaatggcgaaactccatctccgagaaaaaaaaaaaaaagaatactttctgaaagtatttattcatacaaataaagacttgacccataaggtaggaacgcaaatgggccacggaatcactcattccacagtatacaccgagtgcccttgaagtgctgggcactgctccaggattgggggcatattggtgaaagagaagcaagctgcctgctcagatggcagggaatggggaaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggttggctttaatctccaccagactcttgccccgggactgtgatgggcgattggccacttctcctcgataacattactgtttttcttccgccttctggttgactttagccagaaccagtgcttctataactccagttacctgaatgtccagcgggagaatgggaccgtctccagatacggtgagggccagccctcaggcaggagggttcaccgtgggaacagggcaggccagcataaggtgggggctggatgtagagccctggaggctttgggcacagagaaataaccactaacatttttgagctcttaccacgtgctcagaaaaaatccctaagaagacactgagagaattagatgaggaaacataagaacagagacctcaaatagtttccccaaggtcacacagcttataattagaactagaattggaactccaggctggcttcagatctgcctctctctcacgccctctttaagatcctttgcaaaccaatggtagaagcctgtatgttggagaggtggtaccttcaactatgtcccccatcaccgcagaggtggcacatggcagggatctgatggagctgaactgacatcatttagcatcccgagcctcctctctgggcctcattttcctcctctgtaaaacggggagaaaggccctgacagccacagtctgtgtgaggctcctgagatctcatgtacagaaagtgcttggcgtggagctgggcacgcagcaggggctgggcacacggtggcccaaaggagacccgggccttcactgatgggctttgtggccccggacacacctaggactcctcacctgtaagacaggcaccattgtgccatcccatgttctcacccagaggctctttttctcttccagagggaggccgagaacatgttgctcacctgctgttccttagggacaccaagaccttgatgtttggttcctacctggacgatgagaagaactgggggctgtctttctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgtgcattcccaggtcagatgtcatgtacaccgactggaaaaaggtaaacgcaagggattggacagtgcccaccttgtccatggcccaacttgggcagccccagaggcccagagcaggaaagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccgctcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagtttaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggatgtgttcttagggtgctcacctgggagacccagaagaaggagataacacgtaagggtgaggctggtccctggaaatcagctgacatcctgcaaatgtggagccctgaggtggagccaagcccgaggcacagcccactcagtggcacaagccacaaagggccggcctcaccccaacctgggtgctcgtgattgacagcctcttgttacgtgagggaagcagcaccccttccgtggcagaaaagttgggcctgaattgtttgagcaattccacgtgtgcagctgcgtataccatccagggtgataggaccatgagcccgaggccctgatgtcctggggtctagtcctgtgtccacaggcaccactcccctttgtacctcctgtcccaacagccaagctccacagggccaagactacagcatcctttgctcagcacccaaaccacagctgtgcccacagcacggaggctggggacaccgagctgatgtcctcagaaggcaagtggacaggacagcctctggggtcccacaatgtcctggaactgaaggctcagaacctacaggaagtttgtccatttcagtgttactttcagtgagacaccattttcaaccatactcaggaggatccgctgaaaaatgaaacagaaatgagtcatgatgggcagagcagggagaagcaagggagacgagaagtggggaacatggaagaaaaagccacgtgaggaagaaaccagaggtcaagagaaaaagaatcatggaggtagaggaagcaaaaaacacacataacaaagaatgtggactttgggtcagaccaatgtgagtttaaatccaggttctctcccaaaccagtttgggcagatggcccattggaaccccactctcctcatcagtaaaaggggggcagagtgagggtcctgagggttagcacatggactgtgtgaagcagacaatgcccagtgcttagcaccggaatcagggtctagcaggtgctccctaaatggcaggtgctgtttgctactgaaagtactggaaggctgggcgccatggctcacgcctgtaatcccagcaatttgggaggctgaggtgggtggatcacctgaggctgggagtgcaagatcagcccgaccaacatggagaaaccctgtctctactaaaaatacaaaattagccagacgtggtggtgcatgcctgtaatcccagctactcgggaggctgaggcaagagaatcacttgaacccgggaggcggaggttgcagtgagccgagattccaccactgtaccccagcctgggcaaccagagcaaaactcagtctcaaaaaaaaaaaaaaaaagaaaaagaaaaaagaaaaaaaaaagaaagaaaggagcactggagagtccaggtgcatactcttgtagacagcaacttgctgtgtgcctcatttacatctctggcctcagtcaaaagggacttggctaggcagccccacctcaaggccctccgcagttgaaagatttatggttctgagataggcaaagggggaaaactggagaaacagaagccaccagagggaggcaggcagagcacccaacaggtcccctgggaaagggcttggctgggcatcaaacctaccaccccataaacttgacattgaaggcaaaagttaatgacatacagcagagacacggatggctttgggtattttttttgtcttcttttctttttttaagatcaatattcattcttcatttgccctcgtaacgaaaatagatttttaaatgcctcaaatatacaaacatcattgatgcacacacattccagaaatgcagaggtatgctgctgccacggggtaggggtgcgggaggcggcctggcctcatggccgcagaccgtgccccagcccgggcctggcaggtagctggccactgataaacgccactgggatcctaggagaagctggggaccatgcgtgaggtactgaaggggaccatggtggatggcatcctgggcactttgtagcttgtctgagggaaaggcctctgctgccatagaaaagctggacacatgtcaccctggggccctgacatcctaaaatgccccactgactaccagtcactaggagaaaggtctccggctatgcccttcccagtgatgcttgccccagagtgactggtcacaggtgggggacaggtttgctccagaaaccgtaggcctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggaggcctcgctcacagcacctctgtgaggggactggtgctcctgggaagtcacttctcttggtgaccgagctgacaccccctccacttggaaagcacagggactgagcaggcgggacctgtgctggagggagaccctcctggtgaggaactatgcgggccttctgggcctcagcagctccagcccactcctggcctggcaggccacctgcccacccacccacccatctgcctctgggcccccagtgaagtcagaagaggcaggagccccgcaggctgtgagcctggcgcaggtcggctgacagcgagcttctcatctgcctggtggtagagcggacgctctcggcagcctgcacggcccggctcagggccttgttgagctcctctaggtcgcccaggtcgagctggatggagtgccggtgtctccgggctggtgggggagaggctgtgggcggccacttggcagctggttgggctgaggtaggtcctgcaggcgcatagtacctgaggagagaagtgagtgggctcgttacacatggggagggctggggacaagccgaggagcaccgtgtgtggggtcaacccccttctaaatcccagctgggccagtggctcctactctctgggtctcagtttctttacctctaaaatgggaataatgggcacacatccagggatttcttagaaagatgaaggaagataacaacatgagtgcctgacccagaacaggtgttcaaggacaggaagttcaatctacctgttcatctgatttactgcccatctagtacatgccagccagcgtgccaggctctggggttacagtgggacaagaaaacatggactcctgcaatcttcttggagccggatcttggggaggccaggatcaccctaggcttgatagcaaaaccccctcatggaagaatatctgggggttccatttgccaagcaaggggtgctggagaaaggcaataattaataattaataatagtaataataataataatagggattctgcaggagtgggagggtctggccccatgtcctgggaagtgggtagaagagcatccttcctagcccagtcctataggaatgtgaggtgttgttttaaagtgctgtgggaatgggctgacaagcccattgagatgaagcacggatttccctaagaggtgacaatggcatccatcagggccactaagtttagggttcaaggaaaccagcagtgggcaagagggggtgtggcctcagcactgttaaataaagggtgtgtgtggtggaggagggagataaagaagcatggacctaaatcaggaataagtttaggaggacgcagcagagtcattcattggcatcttgcttggcacactgtaaactctggctttattcctgagcccctgctgtctaacttgcattgttatacagtgtgtagaaacagatgatccaaacagacatttctccaaaggagctattcaaatggacaatacgtacatgaaaagatgcatatccttagccatcaggaaatgcaaagtgaaaccactgcacaccctctaacatcaaaaaggacagatagcaacaagtgttgacaagaatgtggagaaactggaatcctcagcactgctggtgggaatgtaaatggtggagccactgtggaaaacagtctgacagttcctccaacagttaaacccagtgcctagcccagggctggcatcctcatctttggtacccatgtaccagttggtgcctttatctttattttacagatgagcaaagcggagctcagagaagctaagtgattcaggaggcagtagaatgcaccagccttagcagctcaggccctggagccctgccccaaatcccagtcattctgctgggctactcatgggactctggacaagctaagtcactttgcaaggcctctgttttcccacctaaaacgaccacagttagcaacctctcagcttagagctgatggaaaattcaggtaaaaagctggcactgcctggctccggtaagtgctccataaacgtgagctcctaagacccagagtcagacagctggaaggggcagccatgggttcacacctgggcccgactctccccacatatctaatgtgtgctaattggcaagcagcagatgctgataaaataatctgaactgtatgaacgggcttcttgcatccccaaaacagcagcctgcactccctcctctagggaccgtctggtgtaagtaactacagaggctcctcaaattacgatggggttatgcccctataaacccgctgtaaagtcgaaaaatcataaatcgaaccattgtaaaagtagggactgtctgggctgggttttcatacacccccaccttctgttaatttgatgaccaacttggcctgaaagttacccaaaactctccctagggccaacactgaaaaagtccctctgggctggaaagtctcggctgcaggggctatgggacggctgcccagcagggggcagcacaggcccactccgctttccaaactacactggtctcaaccactgggcccgttcagtcctgctgaccagcagctggagaaatttcagggtgtcaccagcgcaaattctagcagcattagaagcaccatcattattggcaacttctatgtactatgggctttccatgcattaattcattcaatcctcagcacaacccatttcgcagagaaggaaactgaggcataggtataacccgcccatcctgagttggaaacagcaacctggtgagttctgcccacaggcctgagcctggaagaatgtgaaatggggcctcaggagaagtaaagactccatggctaccgtggggtcaccaaattctgggcaaaacctttcccgatcaatgagttggaacactggcaggcgctttcccccgtgtctgctggaggtctgagcatgcagcattggttctcatctctgctggagtggaagattccttagcgacttgcttagactcagctgagagggcagcaagaaagcaaatttacataccgggcgcggtggctacaccttgtaatgccagtgctttgggaggccaatgcgggcagatcacctgaggccaggaggtcaagaccagcctggccaacatggcgaaacccatctctaccaaaaataccaaaaaaattagccgggtgtggtggcacactattgtattcccagctacttgagaggaggaggcatgagaatagcttgaatcttggagatgggggttgcagtgagccaagatggcgccactgcactccagcctgggcgacaaagccagaccctgtctcagaaaacacatatacataaaaaatttttaaaagcacatttataggcctggtccccgaatagaggaccagggctggatggcgccttgggtccctgctccaccaagcaccagccctcacagtgacgcaggccctcactgcctacacacccaggcttctggcaacacagccactgaagacatccagtcccaatcgactcatttcacagcaggggaagcaggcagagaagtagctgctgacagctgagacaagaagacaggtttcctacttctggggactgggcttttgtccctgcacaatcct

SEQ ID NO: 340 - DNA, 56117 bp, Homo sapiens
aacatgttcatcagccagatgccttttctcacttagaaggcattattagattcgttcattcctccagctctccaacaggtacttatggaggatttagtgtgttccaggccctgagctagaggatggaaatgatgcccttagaggtctcaaaaatagggcgagtcccatgaatgaacagccaccccgcaagctggacggtgctagggaggagagagcagcttcctggggtgacccattgagcacacgcccacgtgcagagttctttccctgccattcctcctgtaatcttcaccacagccccagtgcagaggtaccattgttctacaagacaggcggggaaactgagtccccataaggctcagagactagcccaggatctgtagtaagagggtggcagggccaggatttagaccccatctgtccgatgccagaccctgcttccctaaccaaaagcagacccaagataaggaagccatatgcaatttaacttgaaccgcccatccctgctcaccgtgggggtgagctcactacaaagctggtggccagagagaggggatgagactctgggacttggacagggcagggaagtatcctaccagatttctggtgctaaaaaatgatatacctaatgctaaatgacgagttaatgggtgcagcacagcaacatggcacatgtatacatatgtaacaaacctgcacgttgtgcacatgtaccctaaaacttaaagtataataataatagaattaaaaaaaaatgcatccccagactacagtcacattgcgggggatcagtatagctggctttgggccgagattgccccctgattcctgagtggccttggctaagaccttccttcctctcagtttcccatctttaagtgtggacagtagtcccagcggcatagttactgtgcagatcggatgaaacaaacctcacagagtgcctggcacatggaacacgctaggtagacacaggcaggccccttccccaaagccgtcaagtccagctgcctctatccacagtgggacttgagcactggatccaagaaccatagagagtgggcagggtcaagaaggaatccccgctccttgggccacccctctagacctcaggccaagtccctgccagccttcagcctccacccaccagaaccacagaggcccaggctggtggctgatcaccaccagcctttagaactgcctcccaccagggatgtgtcccagccccagggacgctttgcctctgtccagcctcttccggccccctttcaatccctatgaacaaaggggctcaggggtgcctggcttgagccctgtgcccaggggagtgacaccagtttctggggctggagtcttctgagccctgagattctgccatttgccgttccgcttacaccttccttgtagttgaaaggtggcgtctacacctgtcctgtgggtggaccagggcctggggtggccatggcataaggacctcacctctaaactctgttccgccccccccaccccagtctctggccatgtctatatgacacagtctcactgctgctattgttaccggctacggcaattttaacgccatctgctgagcccctgccacgtgtgcagcagcctgctgagtgcttcctgtgcctttcctcaccgagtcccctgaacagcaccgggaggcgctccagtcccgctctgcacataggaacctgtcttatggacacagcccccatgctgactggctgccaagtgccacctggggctaccatggagggtaggaggttcatcctaaagctggttcctcccagcaaggatcggagacagggactctcgggttgagggtgaaaactctgagcaggtcccatcatctctccgagcctcatctgtgaattgggataataatcgcatctgcttcacagcactgcactgcggatgtcatgagtctgcctgtgactggcccagagcagtgcccatgcgtgccagctgctggagttggtgttactccctgccgggcgtcgcgcatcattccacggagtcctcaccactccttgatgggcatcacatgctgtccccttcaccccaccccactccgctctgttctcctattccccagcagaggagagagctccgagacaggaagggaagtgttgcaggccacacggctggtcctttgcaagccgggatgtgaatccagctgtctgagctccctgacttcctgcaggatcctacagctcaagggcgtctggagggcacaaagcactgttctgtgttccacagtcctggttccacaccagcctgagtctggctcagacacacctacccttccctctctagtttgtgtccccatctgtaaccctaagcaggctagaattcatctctgacgaagcgctttccgtctggaattccccacattccccaggagcaggcggtttgccctaaagctggttctgtgtccacagggggagcagggcgaggacggcaaggctgaggggccccctgggccacctggagatcgggtaagccccctccctcccctggaccatgtggcgtcctaggtggaatctgagcctcccgctgcatggagaggggtgggccgatcaggggccaggtccctgagagctccgcagaggtcgcggccaacagggcccagggctggcatccttggcacctggtggcccaaattttgctgttgtctttgtcattcagggccctgtgggtgatcgaggagaccgcggggaaccgggagaccctgggtaccctgtaagtatcagagctcctacctgctggcaggatcgggcatgtcagggagaggggggatgacacatgtctagaaagaacaagaacttcccaggcttctgtgctgcctcccagccctctgcaggatgggcccccctcacctgtctctctttggcttccagggacaggagggtgtgcaaggcctccgtggaaagccaggccagcagggccaacccgtgagtggtgcttcgtgtcccatccctgcctcccaccctgagtggggcggagcagtgggaattaaagaactaggccctttaaagcttaaagggaccctccctgcaggagggtctggggcagccatttctgtttctcctgccctgaccctggggatgcccccagaacctgcacccccaaacccctccccacccctccccctccaggcggagactggccaccctccccgggagagaatcctggggctgccttgcgtcatctcaccttggtttgcaggggcatccgggaccccgggggtggccgggacccaaaggatcgaaaggcgcagaggtaagagggccgggggttcagcagggagactgagtcccaggaagggggaagcctgacccacagtcacacagcaaaccaaacgcaggctgcagaggctgcgaggcagggtagggaggggcggcccaccaggagcccggcaggctgcttctggccatgaccccatctcccttcaaatagcctgagtgaggagggacaatcagccccatttcactggggctccaggaggggagccaactgcctgaggccaaccagagtgacttgaacccagggctcaccacactgtagagagaaaactgggagaagtcaattgagggggtctggaggaagaggaggcagagacagggtgcttgagcaggagccacttcctgcctctgccccagggcccctgccttcccccagcccccagactgggccagtgctctcttaatgctctttccctcccccgggtgcgcccccctcacctgcctgcctcggtgatacctagtctctaaaagatccagtggaactgtggcctctggctcctcccagaaaattgtcaatgccagtgaggggacaccaaggcccagagcaggctcagtgacagccccaggaggttccaaggccagctctggccccaggcttccaggccagagtgcttgggtacatctgtggcatcagatgttcacccaggggcccacaatcctctcagtccctccttccagagcccctagggtcccacacctctaccaggcagcctccatcatgtggcccttgatttttcagggaccaaagggaaagcaaggcaaggcaggggccccaggccggaggggggtccaggtgagtgactacagctgctgtttccagccaacctccctgcccgccccccacacccgccctcctcccactccctgcaccaaatgccctcaccagctttttatgtaccccccagggcctgcaggggctgccagggccccggggcgtggtggggagacagggcctcgagggcatcgctggaccagatgggcttcctggcagggacgggcaagcaggacagcaggtgagcgggaattggcattaacagatggtggctccatttgggaccaggtgtaggggaacttccccaggccatgggccagaggagcccgtttggaaacttggatgggcagaaccaacacatccagaagttctctggggtgggcaaccatctcctcccctggcacctgggagtgtggaccttctgactgtctctcctggatgccagcacccagaaagaccttcctttcctcccctgcctggtggatagggttcctctcccgccccttcctcactcagaatcccgcccttccccactcacaatcctcagctcctcctgtcctcctggtccagccacatcacacacaggccgtctgacctccatcctggagtgtgaccccttcctccagcttcacccagggtttgcccaggcgttgagccatctgcttccttggctgtatcgtgaaacacaagagaccctcctctgcctgctttcttaacagggggagcagggagacgatggggaccctggccccatgggccctgctgggaagagaggaaatccaggtgtggccggcttacctggagcacagggacccccaggattcaaggtcagatacctcttaatacacttacccaccctctgccctttctgccttgatgcagactctagtggttccgaccctttgggcacccatgtcccagggcctgtgtgaaaatggagtccacattgttgacctttctccgtcagcagtgcttgggggtcctgccccaagcttgaaccagaatgatagttcatctggggagctgtaaatatcgcccctaccaggcccttgaaaccttcaactggtttttgagttgtccacgggcgccctctcgtggacatttgtggaacaacacgttgcttgcagccgggatccccaaggcatccttagaaagcttcccagtgccgcgtgggaggagggggcccccatgaatccgtcagagccaagggctggacactgaaggggagatgtagatgaatgactcagatgtggttcttgccctctctgagctcgaggtttaattgggggaaagattggaaccctctgagacacaggaggcggagggagcgatggccttgacccagggaagatgtgaatgagaatagaaggggaaaaggtggccacacagtggctcacacctgtaatcccagcattttggaggctgaggctggcgaatcacttgaggtcaggagttcgagaccagcccggccaacatggggaaaccccgtctctactaaaaatacaaaaattagctgggcatggtggcaggcacctgtagtcccagccactcgggaggccgaggcaggagaatcgcttgaattggggaggcagaggttgcagtgagttgagatcgcaccactgcactccagcctgggcggcagagcgagactctgtctaaaaaaataaaaataaataaataaatggggaggaggcattctacgagtgtgagctgaggtttgaaggagggaactgcatgctgttggggaaaagcaataaggaggagaggaattgtgggagaggagaggggaaggcagggcccggaatgcgagaggagagacagagaccttcctctttgggaggtgaaagtcttgtcacccctaccccaccaggcctccatttgttgccccagcattctgcaatctcgggtaccctgtggaatcactgttctggctctcccaggccccctccgcctcctcctgccttagaaccccttcccactttgactggtaattttttgtgtgtttctttaagggtgagagtgggttacccggacagctgggtccccctggcaagcgaggaacagagggcagaacggggctccctggaaaccagggggagcctgggtccaaaggccagccggtgagtgagcgccaaagaatacacatgcccacgcactcacacatgcacacactcacatacacctacatgtacaaacacatgcacactcatacacacacacaaacacactgacccagaagccacctccttgctctgtgacaaggtataaaatctgggtaccagataccattctgccacccctcaaccaggtggtgggggaggctgaggaaagagacctgagtggttccttcagaatgaggagagggtgatcacaaccagaaggtgggcgctcctgactcccagtccagtgctcattctgtgcctcactgccttcatccccctgtcccagaggctgcattcaactcacccttgcctggaaaaagaaggaagaatgaacagagaataaacagggcaaatagaaaacacacaacaaacagtttcaataccccaattaaagctgagattgtcagagtggatgaaaaagcaagacccaactacatctgctgctacaagaaatccacttcaaatataaagatataagtaggttaaagatagatatagaaaaagacatactgtgctaacattcatcccaaacagctggagtagctattttaatatcagatgaaatgaatttcagagcaaagactactaacagtcataaagaaggtattttcataatgacaaagaagccaacttttcaaaatagcataagaatcataaatgtttatgcacctaaaaatagatcttcaaaataatcaggcaaagactgataaagctacaaggagaaatagacaaattcacaattatactcaaggatttcaatatatttctctcctaatgggtagaacagaagcaaacagaagatcagtaaggatgtcttgaactgcattatcaaccaacatgacctaattgacatttatagaacaccacatccaatatcagcaagatacacattcgttataagttcattcagaacatttaccaagacagacactattttgagccttaaaatcaatcaataaattaaattataaatcaataacagagagatctgaaagatctccaaacatctggaaactaagtaacaaatgtctaaatgacccatgggtcaaagaagagaccaaaagagatgttagtattttgaattgaatgaaagtaaaaaacagcatataaaaattggtgaaatgctgttgatatatagggagatctttatagtaataacttctgtgttagaaaagaagacaggtctcaaataaatggtctcggattccgtcttaagaaactgggggttggggctggagaaggcaaatttaaaacaaagtgagcagagggaaggaaataatgaaaatcaaaaataaaccaaaaaaaaaaaaaggaaaatcaaaagttagctttttgagatctgtaaaactgataaacctcttgccagactaatcaggaaacaacaaaaacaacaaaaaggatacagaagttactagtatcagggataggggagcaatgtcactacagatatgacagaaattaaaaggctaataagggaatattataaatgattttatgacaataaatttaaagacttagatgaaatggacaaattccttgaaagacaaaactaccaaaggtcatcaagaagagactgataacctaaatagccttatatctattaaagaaattgaatctgtagttagagcttcccacaaaggaaactctgggcccagatggcttcactggtaaatgctactaaacatttacaaaagaaataataacggctgggcgcggtggcttacgcctgtaatcccaacactttgggaggccgaggtgggtggatcacgaggtcaagagtttgagaccagcctggccaaaatggtgaaaccccatctctactaacaatacaaaaaaaaaaaaaaaattagccaggcgtggtggcgcacacctgtaatcccagctactcaggaggctgaggcaggagaatcgcttgaacctgggaggcggaggttgcagtgagccaagatcgtgccattgcactccagcctgggcgacagggagagactctgtctcaaaaaaaaaaaaaaaaaaaaaagaaggaataccaattctacataacttttccagaacattgaagaggagaagaataattcccaactctttccttgaggctgattctaccctgatgtcaaagccacaccaagatattacaagaaaaggaaacaatacaccaatatgcttcataaatatagctaccacagttctcaataaaattttagttagaggaacctaagaatatataataaggataatacatcaagaccaagtggagtttatcttaggaacacaaggatggtataacatttgaaaataaatcagtataattcactatattaacagactcaaaaaagaaaacccatttgatcatctcagtagttgcaggaaaagcatttgagaaaaatctaactccacttctgataaactctcaacaaactaggtatagaagttcctcaacttgataaaggacatccatgaaaaacctagtcaacatcatacttagtagtgattgactgaatgcttttttccaaggagcagagcagaaacaagtcaaggatatctgttctcaccacttctattcaacattgtactggcaattctagccagtgcaataaggcaagaaaaacaaataggaggtattcatatcaaaaaggaagaattaaaacttttcatttgtagaggaaataatgtctatgtagaagatccattggcatccacaagaaagctactagaataagtgagtttaacaaggtcacaagacaccatatcaatatgcacaaatgaattgtgattgtatatactaggcaatatgcataaatgaattgcatttctatacactaatcaatgagcacaaatgaattgcatttctatacactaatcaatgtgcacaaatgaattgcatttctatacactagcaacaaacaattagaaatggaaatctaaaaagcaatactacttataatagcataaaaacatgaaatacttagagatacatctgacattaagtgtgcaacatatgtacactgagaactatagaacactggtaagagaaattgaggaagacttaaataaatggagatatatactgtgtgcatatttcaaaagactcaatattaagatgtcaaatttcttcaaattggtgtattgattcaacacaattccaatgtaaagcttatcgggttttcatgtagaaaatgacaagttggtcctaatatacatatgaaatataaaggacttagaataactaaaacaacattgaaagagaagagcaaagttggcagactaatggcacttgatttcaagacttattacaaatctgcagtcatcacgaaactgtggtattgccgtaaataactaacagatcaaaggaacagaatgaaaggtccagacatataccatacatatacggacaactggtttttttttgtttttttgttttttttgagatggagtttcactcttgttgcccaggctggagtgcaatggtgcaatctcagctcaccgcaacctccgcctccaggattcaagtgattctcctgcttcagcctccccagtagctgggatgcaccacgatgcccggctaattttgtatttttagtagagatggggtttctctatgttggtcaggctggtcttgaattcccaacctcaggtgatccaccacctcggcctcccaaagtgctgggattacaggcatcagccaccacacccggcctggacaactgatttttaacaaaagtgcaaagacgattcagcaaatacaaaatagtctttcctaacaaatggtgccagacaagtgatgcctcataacatgtacaaaaattagctcaacctggatcatacacctaaatgtaaaactgaaaattaaaacacttctagaacatagaaggacatcttcaagaacttggataagacaaagatttcttagatatggtaccaaaagcatgacccagaaaagaaaatgtgataaatcagacttcatcaacatttaaaacttttgctcttcaaaggacactattaagagaatgaaaagacaagccacatactggaagaaaatatttctaaatcatgtatctgattaaggatttgtatccggaacctaaaaagaactcgcaaaactcaataataaaaataagcagcccaatttttttaaatgggcagaagatttgaatagacacttcaaagaaagtatactgatagcaaataagcacatgagaaaaagattaatatcattagtcattagacaaatgctcattcaaaccacaataagatgctatggcatacctattaaaatagtgaagagttttaaaagactaaccataccaagtgttggcaaagacatggggaaactgaaactttcaaatgctgataatgggaatttaaagtggtacaatcactatggaatcagttgggcagcttctttgaaagttaagcatatccctattgtataatcaaatcattccactcatagatatttaccctacataaataaggacattcagccacatgaagactatacttgaaggtgcttagcagctttatttataatagccccaaattgaaaaaaacctcaaatgtgtatcagccggtgaatagataaagtgtggtatattttgcaatgaaatacaattcatcagtaaatggattgaactattaatatatgcaacaacataagatgattctcaaaataattaggctgagtgaaagaactcagataaaaaatagtatagactgtgtgatttcatttatataaaattatagaaaatgcaaactaatctgcattgaaagaagatagatcaatggctcctggagatgggagggtaggcaggaaagaaagattacaaaagggtgtgaggaaagtttctggggctatgggatgttattgtcttggttgttgtgacaattacaagggtgaatacagacagatatgtcaaaacaaatcagattatacaatttaaatagtatagttattatcttcagttttactttagtaagactgtttttaaaattaccccttctttgcacctgatgggtgtataggagacagccatcagagtgcaaaaatgaacagttaggacatcacgcaactggttctgtgaagccagtattatcctgataccccaaccagaaaaagatgtcacaagaaagaaatcaacagacaaatatgccttatgaatacagatacaaaaatctttaataaaatattagaaaaccaaattcagcaatatgcctaaaggagtctacaccatgacaaagtgagatttatcctagaaatgcaaagctggttcaactgttggaaatcaatcaatgtaatacaccatattaataaaataaaggacaaacattatagagtcatctcaatagatgcagaaaaagcatttgacgaaatccaacaccctttcgtgatgaaaacacaacaaactaggaacagaagggaacatcctcaacctgatagagaatatctgtgaaaatcccacaggtatcatcatatttaatggtagaggactgaacacttcccccaagatcaggagcaagccaaggatgtccactgttaccacttctattcaatattatactgaacaaaattagtagaactaataaaccaaagttgcaggatataagatcaatatacaaaaaatgtcatttctatatataacatacaaacatcaattatatgtctatacactagcaatgaacaattcaaaaatgaaattaataagacatttccatttataatagcatcaaagagaataaaataggaagaaatctaacaaaagaagtgcaagaagctgggcatggtggcatgtgcctatagtcctagctactcaggaggctgaaatgggagaatctcttgagcccaggagttcaagtccagcctgggcaacatctcaagaccccatcttaaaaaaaaaaaaaaaagtacaagatatgttcagtgaaaatttcaaaatgttgatgaaataaaagaaaacctaaataaatggaaagacatctcatattcataggtcagaagactttgtgtggttaagatggctatacttaccacaaacagagctacagattaaatataatccctatcaaaatccaagctgactttttaacgaaatctgacaaattgatcctaaaattcatatggaaatgcaagtggcccagaatagccaaaattttgatctttaaagaagatcaaagttggacaactcacacttcccaatttcaaaacttattacaaaagtatagtaatcaagacagaaataaaaccttacatttatgtctgttgtttttagcaagagtgctagggcaattgaatgggaaaagaattttttttcaataaacagtgctgagacaatcacacaatcacatatcacgtaccagagaagtaatttggacctctgcttcacaccacatgcaaaaattagctaaaaatgaagtatagaccaatgtaaaggctaaaactgtacaactgttagaaaacataaaaacacatttttataaccttgtgttaggtaatagtttcttagatatgacaccaacaaaagcgaagtacatagattggacttcatcaaaatcaaacacttttgtgcttccaaaggcaccatcaagaaagtgaaaaaactcacagtaggggagaaagtatttacgaatcatatctctgataaggaacatgtatctctaatatataaagaacccttacaactcaagaataaaaagacaatccaaatttaaaacggacaaagtattcaagtagacattttttccaaaggagatacacaaatatccaataagcattgataagacaaatgaaaaccaccaagagaaccaccaatagctcaataaagctattatcttttaaaaatgaacaggtagaatttagattaaatgggaccctcccgaagcctgacccctcagcctacctccatcagcactgggtcttgacctgcctggtctcattgcatccttccagccccttgggagggagatgacgtattatcctattttacagatgaggaaactgaggctcagtaaagggaggtgacttgctcctggtcttataatataaggctaggagattctaatacatggctttctgcttatgagcttgaaggccaagccccaagaatgtgtaataatggcaggctcttctgcctccaggggcccccagccctcccttcttggctcagaccccagcatgcccccttgccaattgctctcctaaccctttacaagattgggagcagaggtcaggaaaggaggccaaaggttcctggaatcgttcacactgggtttgaatctagcacagtccacaacatggtgtctgcgtgacttttagcaagttcctgccctctctgagcctgtttcctcatctgtaaacaggggatatggtgtgtccctgggttgatgtgggagcatggaagtgtggcggtccaggcaaaacatccggcacctaacaggccctcagtgaactgggttatttttagtttttaggggaatccttccttaacagagcttttcagagctgtgggaggaggctgcaggcccttttattctgtcccttgaagacctgggacaggagctcctgagtgtggcagagcctcctctgtggaatccctgagccgggctcctctttctcatctgacggagagcacaggctcccctcagagcccaggcggactggcatctagtttgtgagctgttcacactcacttggtcgcttcacagaggagtcactgatatccctggaaaggctgggagggaaaaggcaggccctgaggtcccaggtggctggcgggacacgctgaccatgagctcactcgctccatcacttcctgttcttcctgcagggcgactctggcgagatgggcttcccaggaatggcaggtctcttcggacccaaggtatggactcccacggctcactgttcctgtggggtcccatccattcaccccattcattcatttattcattcaacaaatatttatggagcactgaaaacattggctggaaaacagccagaatcaggcatgaacaccctcatcccccagtactccagaagatctaggttccaagcccagctacacaattacctgctctgtgccttgcaaagtcacttagtctctctaagccttggtttcctcatctgtaaaatgggagcaatgacagtagaagactgttgcaaaaataaagaccaggggcatatgccacacagcactgagccaacacactgctggtacctgctgaataattgtaggtgtttcttactccttctggggcctctcaggtaaggcctctcttgacaagaagggcaaaggttgacagaccccaggggtgagggagctgtgggggccctttacccagtggctgccaagtacagacagccctttctctgcctcccacagggcccgcctggagacattggcttcaaaggcatccagggccctcgggggccacctggcttgatggtgagttccctccctgctgtcggagcagagatgattgtcctaggcccaaggttggccagccatcagctggcctgtcttcatcctcctcttgctccttgactcatgagccctttctgcccacaggcctggttcccaccttcactcctgccgttcccaccagctcagcccccatccttccccgctttcactcttgcccccatcgccccactcttgaagtccacccctaggcacaaatgaggggctcaggagatgcatggcctgggcccgcttcagatggtctcccttctactcccttgcgacgctcgggctgccctccaccccgctccccgtgtctgttccccaggccctggaacaaggacacatgagcctttctgtctcctttagggaaaggaaggcatcgtcgggcccctcggaatcctgggaccttcgggactcccggtatgtgtggggattggacaggaagactccggggtccccttgccttcctggctccagattgtctctgtgactcagtgccagtctgagcctcagtttcctcatctggaaatggggcttcacctctgggccctgtctcactgggccgtggtttgttgcagggtccgaagggtgacaaaggcagccgtggggactgggtaagtggatgggctggggctgagggatgcagcactgcaggggcgggggaggggtgggctcccagagttgggccatggctcagccaggttccctaactctctcccctgcttctgtctccctccagggattgcaaggtccgagggtgagtgggctgggcatgagggctgtggggcggggcgtggggcgggcaccctgcattctcctcccggtggtacattctctccctccggacctccgtcatcccgtctgtgccagaggaaccattgtccctgggtcccaggtctgcttgaggagggactgggttggggagagatgaagaccctgtggaccagggctcactcttcttctcttgttcccccagggtcctcccggccccagagggcggcccggccccccggtaggtaactgagtgctgggtgcatcttggactcctggggggttcctttgaaggagattcaaggcttcaccggcagactaagccttgaccctgaaccccacaggggttcttgtagcccacagactcctaggagagtatagggcatcccccgaacattcacttttgcctacgtggggtaacacctaggggccaggcctccagaaaagcatagaccagcccactggggcccaccaagcctccgggaaagcagaggccagcttggcaggtcctgcatgctttgatggtctccctggtctcctgacaccctctcagattccagcacactgtccctgtcatttgactgacccgcagtcttcttttgcagggtcctccagggggtcctatccaattggtaagttggaaaccttctcttttgcctacttggggtaaggcctgaggggtttgggggaagaggctgctggccctctctggccctggtggctagagccctaagctgggtctagggacgcccatgtccttttgtcacttcatactggagacttggacccggaagcaacagaacgagccctgggccaggaggcaggaaacctaagtttttgagttgcctctgactgaatccgggaagatgctccagccaccgggttcatggccctatctgtgtactccatacacgtgggctgattgcaagggtctgtacatctcagattctgaatccaaagagagttggggccgggcgcagtggctcatgcctgtaatcccagcactttgggagttcgaggcgagcagatcacctgaggtcaggagttcgagaccaacctgaccaacatggtgaaaccctgtctctactaaaaatacttaagtagttgggtgtggtgggtggcacctgtaatcccagctacaggagaggttgaacccgggaggaggaggctgcagtgagccaagatcgagccactgcactccagcctgggaaacagaccaagactctgtctcaaaaagaaacaaaaaaaacaaaaaaaaaaaaaaacaaagagagtcgggccaggggggcagattggggcccctgcattcttccctattggccactgtggccctatctgagagcatgactcctcccaagccctatgacgagtccatccacattgtactattgcacggtggctacacgactattaccatcaggccccaacagcatcccagggcacagcctcgaggaaagactgaatgggccaggagcccttgagccatgcgtcattcagaacctctgctctcctcatgcctgctctcactgccactccctctgcaccatcctcaaagacagagtgacagccctggcctctcctctgcagccttcccttgtccttctcatcagtaagaaaggcagggaaaggaaagtgaaaagatccaggaaaaacagaaaattagaggattttgcatttttttgaataatcactactaatgctaattgagtgcttgctcaatgccagacaccattacaggtgctttgcttttctttttttttcttttcttttttttttttttgagacacagtcttgctctgtctcccaggctggagtgcagtggcacgatctcatctcactgcaacctcctcctcccaggttcaagcaattctcctgcctcagcctcctgaatagctgggattataggcgcgaaccaccacgcacagctaatttttgtatttttagtagagatgggttttcaccatgttggccaggctggttttgaactcctgacctcaagccatacacccgcctcggcctcccaaagtgctgggattacaggggtgagccaccgtggccgggctacaggtgcttttcatgtattcactcatgtgttcctttcagcagttcttgtgaggaagttttattatcaggtccattttcaagatgaaagaactgagaaagagttaagcagctttccccagattatgcagttagtaagtggcaggtctggaatttgaccctgaggagtagccccagagtcccccgttctggaccccaggcctcagcttttgctgttttcatggcaagaccacggctatgtctctgccaagcccagtggtagggttgggagtgcaaagttatattagactattaaagtgcgagccaaaggagaaacacggggactgggggcatagagaaagggggcctccctcatcttagcctggagtcagaagcttcgggagaggcttcccatcacaactgacatctataggatgagtctagggcaggttttctgagacacagtgcaactgacatttgcataattctttgctgtgagtgactgtcctggaggatgtttagcagaattcctggcctctaaccaccagatacaagtagtaccccctcccccggcttgaacaactaaactgtctccagatattgccaaatatcccctggggggcattgtcgcctctccttgagaaccactggtataggagatagccagatggtgcattgaagggagggagaggtcctccaggcaatgagaacagcatgtgcaaaggccccatggccagatggatcatggcgtttaggaacttagaagtactatagtgcggctggtgccagagcacatatgagggagaggaaggagacatggctcaagaccacagtgttcaaactgggtcttataaccatgttgaggagtctgaacttaatcctgagggccatggggagctattagtacctggggaaagggaatggcagggtcagctttgactgtctgcaaagagaggaaggaccgagagttctgcagagggcatatgacttggccaagatcctgccagggaatgtggccctggggctcccacttgatgggtgtggagaaccctggggggccacgatacataccctgtcttttccttgcccagcaacaagatgatcttggggcagctttccagacgtggatggacaccagtggagcactcaggccagaggtatctccaggggctctccccatgtgggatcccttcctgggagaaacgcaaatagataatggcccacatgtggtcagtgccttccatgtggcctgcatggagcatttcagagtcctggtcttggtggcatctcgcatccacaaatgggggtttgtactgaaactcagaatgggcagtgagtccaaggtcccatggccagtgcaggcagagcaaggccagaaacaggccctgaacccttgagctttctccggaggcctctcagagtctccaagctcttgctggctggagtcagggggagaagcttgcctgggcccagagcccgcagcagcttcccagtgctcatccccacgtttcttcaggagtaagaagctcatggttagctcgtggggctctgctaagaacctgccctgtggttaactcagctgtaagactccaggctgagaagggagtcccatgtcctctagtccagcctcggtcaggagccccctttgcagccttgcctccttcacatgacagggaacttactgcccccagctcaaacctcctatgaacatttcggtttgttccctgtgctggatgctgagacagatggatggccagtcacagccttgactttcagagggctcacagtctagggtggaggacagcatggatgagccccttaccatctgtccggggaggtcagtggaaagagaggggaacactcaggatccagtgcggctggagaagggaagcgtttccttccatccctagaagccagtgatgccgcacaggagagcgctgacctgcaacatccttaacatgatgaaggaaagtggctccgtttatcaagcacctcctacccactctgcattggcggtagaatagaggcttatttctcgtgcacgtaaaagttaattggcttgttgatgagagaccttggctacctgccaggggctctgccctcttcctctcccacacgtggctcccaaggtcactccacaccagggggaggcaccaccggggaaagagagtgtagagaattgtgcaggagggtctctgggccaggcctctatggggctagcatcgctccacttccatcccgttggctagagcacaaataaggctgaagatgtagtctgtccaggcagaagaaatggattgggtgagcggctgctggtctctgacacacgttcacacatgcgtgcacacacacacgtgacctccgccacccccagtggaaggagggtttatttagctctgatttgtagctctggaagctgaggcttaagggagaattctggccagggtaaccctgaatggccggctgtttagcatctgtggtcccctcctgccccctagtggagatctgctccttctctgagctgaagtcctcctcccagcacttgtgcctgctggccccagtcccgtctcctggtgcctcacagagaccctggctcccaccctaggggagcccagtgggggctgtgtgacccccaagtcagctccccccagcacctccccttcctccacaggctctttgcagatagagattgggccgctgccgagtgtcccacgcaccctcgcctacctcattcacggggctctgcctgtcccatatcagagaacatggtctgaccctgagctcttttcaagcctctgagccattgtgatagcctctcctcctgcactttgtccctggcccgttttcttgtctgcaaaataaagagaaacccaacccgtgctctagccatgaccgtggaaccgagatacctcccaggttgtgagaactgggggctgtggaggcttgaaccccaggctggaccaggaccctaaggtcccaatgaccaccctctcctcgtgacagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtgagaaggcttcctgccgggggtgggtgcgcctggcggtggggagctggggcaggtggagtatttgatttccgccgcattttggctgagtttttgtcctcagcaagacagatacactggcagtcatttattcactcagcagtcacagagcctcacaatataccaagatccgcatgctggggatgaccatttcagtgcaaagagacaagagctctggcagaaaaagctcctgaggctgtaagagtccccacccctggggcccatcctgtcacaggctcccgggtgagccaggattttccccctttctgagcatgaggactctgctctctcatctgtgagctgatgtggtgctgtgaaggacaagctgcggagccagacagacctgagttccaatgtcagttctgcctcagacttggtctgtgagctggggcaagccacggccccatcccgagctgcccttgcctcctctgcacaagcggctgggactagatggctggttgttccactcttgagctgcaaaggttttggcttcctgagaagcccagtggggaagctagatgtaagcagcagcgctggctgatggggtgggagacctgactcctaccctcccccggcaggccctaggaggagccctaggcctcgaagaatccattcaactaggtgatcccccaaacccttgtgcaagtgacccagcctctctcaatgtcagttgtcttctctgtaaaatggatacatcccagtagcaacataggcaagtacttagccatgtgacccctcctctgggggctctgccagttgtgagctctgcccagaaggtttccttccatctcggttggaggaatcccttttctgctcacccaccctgacttcatgctcacctggggctcggcaggtcacaagatgcagggtccatctacagaaccaaggaatgggctcatcccccagatacatacatcacctccatcccacgctgcctgcaggtacctactgggtggatccaaaccttggctgctcctctgacaccatcgaggtctcctgcaacttcactcatggtggacagacgtgtctcaagcccatcacggcctccaaggtacccatcagctcccacactgcccaccaggctgtctgcctctatccccagcctgccctgggccacaaccaacccaggttctgttctgagctgtgcctgtcttactgcatgcccttgggaaagttatcgcctccttccgagactcagtttccttatctataaattgggagtgagtaggactaatttgtaaccacaaaccctttcgagtcatatgatgctgatgattctttcttcaaatagaatcttctgcctaatatctaaagcagagcagttggccaagctggcctggcttgtggaactatgaatcatcagcatgaaataaaagagaaaactagcatgatgctcatctgaagcatgttgtgtgaattatgtatgcgaatacttaactcatgttcaatgcctgcgtaccacgtgcctgtttctgggttgagcattttaggtggtacagggccactcaacaacaaaccaaggcaggtggcagcatgagacctgacagctccctcgcccagggatcctcagtggattgtgggtctgtagttccactaagccttccgaatttgggggcaatttatgccacagtgagaagctgctccgactgcgggggaaaggaaccctcccatttcatcagccacatcccctaggagatgccttgtgctgactgggtcagactggcagtttgagaatctctaggagaggcagccagccagtagccaggtctttgttgggtccctatcatgtgccaggccctgagccaggacggggaggtcagactcgaaactcccctgcggccagagctcacagtccagcagggacttggtgacctccacaggctctcttccctggtgactcgaaggttttgggatcacgcagcaaacctgcctagcagaggggtgaggctggagttggcgcctgggttggtggcatgaatgcccaactgggtcaccttctccatcagaaacaatggcagggagaggccctggctctgtgtgggaaagtgctgaagccacaaatcctgccgtgttgtttgctctcaggtctgccatttccggcagcaccccatcgcacctcacagggatcttgggacttaggaagggtctcgaaaacacctctcatttcctctgcattccatgagcctcttagtcttgggcaaaaccctctccctcgctgagctcctggatcctagctcagcccaaagaccccccatacagtaagggagtggatcagatggcaccaagatctttgaagctctggctctggagtcaggcaggcccttcccacttacgcagccaagaacctgtaagaccagctcacgcagacctcagtttccccgtctatcaagtgggcacatgtctgggagcatatcaggaaatgcttgccaggaaggggcctatccctgttccctccatagagaggcagggaaccctcggtgtggggggtgtggggggcagcctgagccgctcactgccgttgcttctctataggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtaactctcagagcccctcctaggcccttcatgtggggacaactggaaaaacacttgtttggaaaaatgtgtttctattataagattatatctaacattttaatagtatactatattaatgtgatagatatgatttcatctttgtgtaatataacagttttctaaaatcgtttttactcactttcctctctgggaagctatgaggggaggtctgggctggtaaaaattctttgggctagtagatgttgtacttacttgcaaggctctttcaaagaagatacatttcttcttcctgctcccaccctagtcaggctaatttcttctcattatattttttggtcattttcaaatgtcctgaacagggtgggttgtcaggggaggggaagacagaaagttgagaaaaggcaaaaatcagttttataagactaaacaaaactaataatactacacagtgttcatgaggatgtggggaaaccaacaatctcgcatgaagctgttggaagaaaataaattggtagaggctttctggatagcagctctaatatatatccaaaaccttagaaatgtacttattttcaggggagctaagctatgaagacacaaaggcataagaatggtacaacggaatttgaggacttagggaaaagggtgggagaggggtgagaggtaaaagactacacattgggtaccgtgtacactaaagaacttattcatgtacccaaaccccacctgttccccaaaaacttattgaaaaaataaattaaaaaatatatatatatgtatatgagatgtacttgttttttggtctagcaatctagaacaatccttctagaatttgttctagggaaataagaatgcacacaaaggtttagttacagtgatgttcatgacagcattccttacaagaataaaaagagtggaagcaatctaaatgtgccatataggtcattgctacaatgaaatacagtatagccattaaaaattgtgaggaaagatggaagggaaaatgctcatgatgtatgataagaatcacgatggatgtacgtgtgcacttttccttctgccttcaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaagcatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgacacgcctgtggtcccgtgctgcttctcaaagctcaggggggcagtttctggctgggctgggatagggagtgggaggagatgctcagaggatgtcctccttacgctgtaacaaataccacaaacttggtggctgcaaacaacacagaaccgtctctctcgcagttctggaggccagaagttcacacaggcagtgttggcagggccacactccctccaaagcctcaaggggaggatctttccttgcctcttcccgctcctggtagccccagtcattccttggcttgcagctgcagcacttcggtctgtgtccctgtggtgacacgtgttctgatgtgtctctctgctccatcttctctttatgaggaccccagtcatattggattagagcccacactcatgaccccaccttaacttactttcatctgcaaaggccttatctccaaatgaggtcacattcactggtgcagggggttaggacatatcttttggggggacacgattcaactcctaacacacagggaggaggtacactgaggttaacatgagcaatttgtttttattattattgtggttaattacacataacataaaatttgccactggtgatagtacattcagaatggtgtgcaacgttaccatgatctaatttcgtattattttcatcacccctaaaggaaacctgtacccattttagcagtcccaccctcccccaacccctggaaaatcaccagcctgctttctgtgtccacggctctgcctactccagacattttatattacattggtgccaaagtaattgcggtttttgtcattacttctaaatggcaaaaaccgcaattactttggcaccgacctaatacaagtggaatcatacagtatgtggccttttgtgaccccggcctctttcactcagcgtgatgttttcaagattcatctgtgtcgtaacgtgtatcagtacttcattctttttatggttgaatgtactccattgcatggataaaccacattttgtttacctactcataagctgatggatatttgagccaaactggtggacatttgggctgtttctacctttggctattgtgaataatgcttcaaaaggagtgatccctgcctgtcacattcttgagagaagtcacaatagtacctgccacggaagaagtgagtgggtgtgagtctgggagatggcgttgccagacttaaaaaataaaactataggatgcccagatcaatttgaatttcagataaacaatagctattttttagtacaagtatgctccatgcaattttgaggaaatgcttatgctagaaatctttttatttgttatttatctgaaatttatacgtatctgagtatcctggcctggagcccacatttcctgacccttgtttcagatctctttcttcctcagcttattcctccttccctgggacaatgaataatcagaacttttctgccattctcattgaggagaaagagcacatcactaacagttgagtttatacccaggattttatattttaaaaacttgcagccgggcgcggtggctcacgcctgtaatcccagcactttgggaggccgaggtgggcggatcacgaggtcaggagatcgagaccatcctggctaacacagtgaaaccccgcctctactaaaaatagaaaaaaaattagctgggtgtggtggcgggtgcctgtagtcccagctacccaggaggctgaggcaggagaatggtgtgaacctgggaggcggagcttgcagtgagctgagatggcgccactgcactccatattaagggatttattatatgaaattggctcatgcaatgatggaagctgacaaatcttaagattggctgctggcagctttgagacccaggaaaacccaacggttcagttcaagtccaaaggcagggaaaaaacctgtcccagcttgaaggcagtcaggcagaaggaattcgctcgtactcagcctgtttgttctattcaggccttcaactgattggatgaagcccagccacattggggagggccatctgctttactcagtctcccatgggattacccaaatgttaatcccatccaaaaacaccttcacagacacacccagaatagtgtttggccaaatatctgggcaccctgtggcccagtcaaggtgatacataaaattaaccatcacactcctcaagctgaggttgaaagagaaggaatagaagtgagccagatggggaagggcacttggggtagagggaacagtgcctgccaaggcccagaggtaaaggtagcactttgcatttgggaacggtaagtgttcccatgtggggctgcaggaaagggtgaggaagcctgcggtatggagctgggaacatgacaagtcacaggtttgcacagatgagcagaggtctgagttggcaagttgggtttgactgccatggggccctggagcagagccatccaggaggcagctgcctgcgctgcgaggaaaggagagaggtctgcactgcactcagagctctggaggcatcagcagtttctgctaggcctggaagacatgggtagagattgaaaaagccagccagaagggccagagggggaaagcaagaagagccatgttagaactgtgacactcacgactctcggcctggtctccaatcccaggtgggccagtgaggatgctggagctgggccagctcattcccagcaggggcagataggaggttgttggggacagaaggaaacttttcctaaactggcagtacccacagttcccaatctcctgttgcacaactgagtgtcaggaaacagtcaggtggacttcccaggctgggccaactccaggggaaagcccaggccagcctgtttgccctgttcacaatgaatcaaaccctagctatggtcacaacccataatggccggcagcccaggattggaaaaatgaggaaaagaagagcgagaaaaagagaggctggcaggcagattccagttcctgactgggacatggccctgggtaggtcattctttctctctaggcctcagtttctctctctgcaaaatggggccgatatgctctgcctttcttgccagccacagaaaggactattgttcaataatagtagagtgaacggtatgaaatagaataatatccaatgcttttggacctgcaaaacccagtttcatatggttcaacccaagaatagcaccattcagaagaataatggctacaatttcttgtgcatggacggcacaccaggtggcatgctcggtgcgatctcatgcgcatgtgcatgtgatcccacattttcatctcatacacaatctcgtgggacacatgttgtaaccctggcttttcagatgaggaaactgaagttcaaagaggtttcttaagttgcccaagatcacaaaacaggatttgaacttgagaaaatctttttgggtctttcctcagcccagtcacagagttccccatgaggacaatttgctcagcctatgtattctcatgtggaagcaggtcacaggttggtcttacacagaccttggctctggccttgatgaagaagggtggaatgtgactttttcaggaaatgaagtgtttcaaacaggtgcatttccctgatgacttccagctcacctgctgtgtgacgtttcccacactgcctcgcctctctgggccacttttttcctcatctatataatggggggaatgtcttattttcttgagcctaggatagacacgttttcatgttttgatatctttaaaagagagatgtagcttgcaatcactgaagtacatatgcaatgcagaaatttttcttccctcctcaccccagcttgtctgggggatggttaaactgacagcgatagttattataatcagaagacccttaggagcaaatttattttatttaacaagcattttatgggtgtggtagctcatgcctgtaaacccagcactttgggaggctgaagtgggaggatcacttgagcccgggagttcgagaccagcctgggcaacatagtgagacctcccatccctaccaaaaaattttaagaactttaaaaaaccaagcattacaactatgtaccaatttaatcttcataacaacccaatgaagtaggtaccactattattctcattttacaggtagagatactgaggcacagagaagttcaccaacttgcgcttcaccaccagcctgtactgcctgccctgaggccttttctctctcttttgttcctgcctaacttcttttgacatcctgccagggccagatggaggatagggccagacgagctagaaggactacttaaagcctcagtctttagaggcattcatgcatacctgaaatgttaggagacagagaaaattgtactgtggtagggtaggtgccagatgagcttggaggaattacttggatagtctaaggtggagagtgagacccccaagcggcagcctgagggacagtgaggacactgaagaccacttactcctgccaaggagaggcactcggaagcgcctctgtactgcattcacagtgcacagctccgctttgaatggtggtagctctccttattcacccttcccctacacaggctgcgcctgggatctctacactcgagcagacggagaccccagaccccattggcctaagtgcctgaacgttataaatcaaaagtattttaaatgaagctgacatgtttacatttaagttttagaaatttaattaattatcccagcactttgggaggctgaggcgggtggatcacaaggtcaggagatcgagaccatcctggctaacccggtgaaaccctgtctctactaaaaaaatacaaaaaaatattagccgggcatggtggcgggcgcctgtattcccagctactcaggaggctgaggcaggagaatggcgtgaacccaggaggtggagcttgcagtgagctgagattgtgccactgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattagccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcagtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaaggacagaggtgcttatctgttatttaataaactgttgtgtgtgggtgggtgtgtgggtgggtgtgatatgtggggctctctaaatccctgggccccaatagtccaggtctaatggtggtgctgtccccaacaatgctcagcttctcctcaaaatacatggtatctgggctgggcacggtggcttacacctgaaatcccagcactttggaaggccgaggcgggtggatcacttgaggtcaggagttcaagatcagcctggccaacatggcgaaaccctgtccgtaccaaaaatacaaaagaaattagccaggtgtggtagtgacacctgtaatcccagctactagggaggctggataggagaattgctggaactcgggaggcggaggctgcagtgaactgagatcgtgccactgcactccagcctgggcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtccccatcatctcacccctggaccactgcatcagctccagctggtttctcaggtttaatctccttccctagccctccccattcttcccattcagacagagcgatctttctgaagaaccaatctggttatgcctttccaacccctttgaaatctttccatttctctcctacacctcctaagtctagcgaacccctcagcctggcttccatgccctgcaggctccatctcctgccaacctcttcaacataaagtctggccactcccacttatcatgtgctccagctgcacagactttccagctccctgatacacccactctctcacctgcgctcttccctcttgataactccaatcattgtttcaagcctcaaattagagcaatgcaaattcaagaaacaaaccaagctggcaaaaacacaaaaaagaaaggaaaaaaaaagggtcatttctgttctgacaaggatggggataaggagactcacttgtacactgccaaactgacattcaaaatccttagtgcttttggatttgtcatgtttgggaggagggtttttaaatcatcggctttcttgaggttgaataaataaaagaaaatgcacacattttaggtttactgttcaattagtttttacaactatacgtgtgtgtgtataatggccaccacgatgacaacctggatcgttgtcatccacttcagtgttctctcatatgcttttgcagtcaaattgccctcttttgcccttggcaaccactgatctgatttctaaaattatagatttgtttgagctgttctagaacagaaccgtacagtatataagctcctttgtatctggcttcttttgttcagcatagtgtttttgagattcatccatggtgttatatgtatcaatagtttaactatttttattgttaagtaatattcctttgtaagaaaatgccacatttttatttaccattttcctgttgatgggcatttggattgtttctttctttttttttggtttttgtttttgcttttgtttttgttttttagacagtcttgctctgtcaccaggctggagtgcagtggcacgatctcggctaactgcaagctccacctcccaggtttgagcgattctcctgcctcagcctcctgagtagctggtactacaggcgcatgccaccacactcagctaatttttgtatttttagtagagacggagtttctccatgttggccaggcttgtctcgatctcttgaccttgtgatccgcccacctcggcctcccaaagtgctgggattacaggcgtgagccgtggtgccccacccttggattatttctaattttggctattttgagcaatgctgttatgaacattaatatgtaagactttgtgcatagcacgtggtttcctttcccttggatactaaggtaattttaaaagggaaattggctgctctctgacacttatcatcagaggaaaaatcacaatatgaaatgctgttagataggctgggagtggtggctcacgcctataatccagcactttgggaggctgaggcaggaggatcacttgaggccagaagttcaagaccagtctgggcaacatagtgagactctgtctctacaattttttgttttttaaatttaattagccaagtgtggtggtgcatgcctgtagtcctagctactccagaggctgaggtgggaggattgcttgagcccaggagtttgaggctgcagttgagctatgattcataccactgcactccaacttgaagagcctgaaaaaaaaaaaaaagtgctgtagacataaaggacatgactaagtaggttagaatatagtaagcgggccaggcgccgtggctcatgcctgtaatcccagtactctgggaggccgaggtgggcagattgcttaagctcaggagttcgagaccaacctgggcaacatgatgagacccccatctctacaaaagtacaaaaagttagccaggtgtggtggcacgcacctgtggtcctagctactcgggaggctgagctgggaggatctcttgagcctgggtggcagaggttgcagtgagccaagatcccaccactacactccagcctgggcgacagagtgagatgccatttcagaacaaaaacaaaaacaaaaaaagaatagagtaagtgaatgaaaagttgtgcatccattacacttttatttatttatttatttatttatttttgagacagggtctcttgctccatcatacaggctggagtgtagtggcaaaatcacagcttactgcagctttgaactcctgggctcaagcaatcttccagcctcagagtccagagtagctaggctttcaggtacatggcaccagacctggctaatttttttgtttgtttgtttgttttccttgagacggagtctcactctgtcacccaggctggagtgcagtggcgccatctcagctcactgcaagctctgcctcccaggttcacgccattctcccatctcagcctcccaagtagctgggactacaggcgcctgccaccacgcccagctaattttgtttttgtatttttagtagagatggggtttcaccatgttagccaggatggtctccatctcttgacctcatgatccgcccgcctcagcctcccaaagtgctgggattacaggcgtgagccaccgcgcctggccgacctggctaatttttaaatatttttgtgtaaagatagggtctcactatgttgcccaggctagtcttgaactccaggactcaggtgactctcccatcttgggtccattaagcttttaactacaaactacactgaaatatgaaagttattcagaatgaaatgaataagaatgcaaaattataatcataccgtaagaatactttctgagtaatcccagcactttgggaggccgagacgggtgagtcacctgaggtcgggagttccagaccagcctggccaacatggagaaaccccatctctactgaaaataacaacaacaaaaaaaattagctgggcgttgtggagggcaccagtaatcccagcgactcaggaggctgaggcaggagaatcgcttgaacccaggaggcacaggttgcagtgagccgagattgagccattgcactccagcctgggggacgggagtgaaactccgtatcaaaaaaaaaaaaaaatgaatactttctgaaagtatttattcatacaaataaagacttgacccgtgaggtaggaacacaaatgggccacggaatcactcattccacagaatataccgagtgcccttgaagtgctgggcactgctccaggattgggggcgtattggtgaaagagaagcaagctgcctgctcagatggcagggaatgggggaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacacagctgttgccacactcagtggaactgaatctatgtttgtcttccccggcatccttcaccccaactctccccgccacaacatacatcccatgccagcctggggaccctcaaaggtggcttcatcattaggtttgtggctgggtcccactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcggacccccactcccggctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggctggctttaatctccaccagactcttgccccaggactgtgatgggcgattggccacttctcaataatcttcctgttttccttccgccttctgtttggctttagacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaaggtcacacagcttataattagaactagaattggaactccaggctggcttcagatctgcctctctctcatgccctctttaagatcctttgcaaaccaatggtagaagcctgtatgttggagaggtggtaccttcaactatgtcccccatcaccgcagaggtggcacatggcagggagctgatggagctgaactgacaccatttagcatcccgagcctcctctctgggcctcattttcctcatctgtaaaacggagaaaggccctgacagccacggtctgtgtgaggctcctgagatctcatgtacagaaagtgcttggcgtggagctgggcatgcagcaggggctgggcacacggtggcccaaaggagccctgggccttcactgatgggctgtgtggccactgacacacctaggcctcctcacctgtaagacagacaccattgtgccatcccatgttctcacccagaggctccttttctcttccagtgggaggccaagagcatttcgctcacttgctgatcctcagggacaccaagacctacatgcttgcttttgacgtgaacgatgagaagaactgggggctgtctgtctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgcgcattcccaagtcagatgtcgtgtacaccgattggaaaaaggtaaacgcaagggattggacagtgcccaccttgtccatggcccaacttgggcagccccagaggcccagagcaggagagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccactcatttttaatacccgtgcagtggggaattgatactgtggttttcaatgtcacccacactgcagcacggccacagtcaccatcccgatttttgctacaaatgaaaattactttataatgagctccttaacacttttctttaaacctgtgtttggaagacttgcgttggtgtggccctgtgcccaatacctgtgaaatcacagcaccgatgagctggttccaatttttaaaatatatacatgcagtacttccatgactattcaaagaaaaacaattccttccatttgccatctgagatgaccaccagtggtgtgaactacctcctgcccccatctgcagtcccaggatcctgggacagggcttatgaacacaaccactgtagtcagctcacctgatccacagcctggcacccccactgtctggctagggagcctcgaatgggtcccaaggccaccctgctcctcagttacatcatctgcatagtagtggtggttgtgaggaattcaggagctgcagcataagggctcggcaggtcctaagtgcacagtaaatgccagtgattcttaagagtctgagctcccattgtagaggcaagtaagctgaggttcagagacagaaaatgacttgcccaagatcacccagctgggaagtgacagtgccagggttggagccctggttgagctggttccacaggccagagctcattctgccctctccctggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagttcaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggacgtgtcctcagggtgctcacctgggagacccagaagaaggagacaacacgtaagggtgaggctggtccctggaaatcagttgacatcttgcaaatgtggagccctgaggtggagccaagcccgaggcacagcccactcagtggcacaagccacgaagggccggcctcacccagacctgggggctcatgattgacagcctcttgttacgtgagggaagcagcactcctcccgtggcagaaaagttgggcctgagttgttccatctattccgtatgtgcagctgcgtacaccatacagggtgataagaccatgagcctgaggctctgacaccccagggtccagtcctgtgtcctcaggcaccactcccctttgtacctcctgtcccaacagccaagctccacagggccaagactacagcatcctttgctcagcacccaaaccactgctgtgcccacagcacggaggctggggacaccgagctgatgtcctcagaaggcaagtggacaggacagcctctggggtcccacagtggcctggaactgaaggctcagaacctaaaagaagtttccccatttcaatgttactttcagtaagacaccattttcaaccatactgaggaggatccgctgaaaaatgaaacagaaatgagtcgtgatgggcagggcagggagaagcaagggagacgagaagtggggaacatggaaggaaaagccacgtgaggaagaaaccagaggtcaagagaaaaagaatcatggaggtagaggaagcaaaaaacacacataacaaagaatgtggactttggagtcaaactaatgtgagtccaaacccaggctctctcccaaaccagtttgggcagatggcccagtggaacctcactctcctcatcagtaaaaagggggcagagtgagggtcctgagagctagtacagggactgtgtgaagtagacaatgcccagtgtttagcgtaagaatcagggtccagctggtgctccctaaacagcagctgctgttcactgttgaaaggcgctctggaaggccaggcgcggtggctcatgcttgtaatcccagcactgtgggaggccgaggtgggcggatcacctgaggtagggagttcgagaccagcctgaccaacgtggagaaaccccatctctcctaaaaatacaaaattagccaggcgtggtagcacatacctgtaatcccagcgactcgggaggctgaggcaagagaattgcttgaaaccagcaggggaggttgtggtgagccaagatcgagccattgcactccagcctgggcaacaagagcaaaatggcgaaactccatctccgagaaaaaaaaaaaaaagaatactttctgaaagtatttattcatacaaataaagacttgacccataaggtaggaacgcaaatgggccacggaatcactcattccacagtatacaccgagtgcccttgaagtgctgggcactgctccaggattgggggcatattggtgaaagagaagcaagctgcctgctcagatggcagggaatggggaaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccggtgagagcccccattccaatgcacccccatctcagcttctggccagaagacctgagcaagtccctccttcttcctggccttggccttcccatgggtggaaccgggagggttggctttaatctccaccagactcttgccccgggactgtgatgggcgattggccacttctcctcgataacattactgtttttcttccgccttctggttgactttagccagaaccagtgcttctataactccagttacctgaatgtccagcgggagaatgggaccgtctccagatacggtgagggccagccctcaggcaggagggttcaccgtgggaacagggcaggccagcataaggtgggggctggatgtagagccctggaggctttgggcacagagaaataaccactaacatttttgagctcttaccacgtgctcagaaaaaatccctaagaagacactgagagaattagatgaggaaacataagaacagagacctcaaatagtttccccaaggtcacacagcttataattagaactagaattggaactccaggctggcttcagatctgcctctctctcacgccctctttaagatcctttgcaaaccaatggtagaagcctgtatgttggagaggtggtaccttcaactatgtcccccatcaccgcagaggtggcacatggcagggatctgatggagctgaactgacatcatttagcatcccgagcctcctctctgggcctcattttcctcctctgtaaaacggggagaaaggccctgacagccacagtctgtgtgaggctcctgagatctcatgtacagaaagtgcttggcgtggagctgggcacgcagcaggggctgggcacacggtggcccaaaggagacccgggccttcactgatgggctttgtggccccggacacacctaggactcctcacctgtaagacaggcaccattgtgccatcccatgttctcacccagaggctctttttctcttccagagggaggccgagaacatgttgctcacctgctgttccttagggacaccaagaccttgatgtttggttcctacctggacgatgagaagaactgggggctgtctttctatggtaggcatgcttagcagccccaaactcatgcccctctcaggcctcaccccccattcacccacccctgggctggcccctagaaccccagccctccctggcctcccgccgggccccaccatgtccccagtcagtctccttgctccccctgcagctgacaagccagagacgaccaaggagcaactgggagagttctacgaagctctcgactgcttgtgcattcccaggtcagatgtcatgtacaccgactggaaaaaggtaaacgcaagggattggacagtgcccaccttgtccatggcccaacttgggcagccccagaggcccagagcaggaaagctgccaggcaaggctgcacagctaggcagatcttctgcttttaggcacctgcctcactgtagggacagctgagctctacagaggcccaggggtggtggatgagagcccaggagggagaagtccctgtgaaaccagggaggacctgaaagctaacaggagggaacagcgtgagccacggggttgggggattggcaattggaggggacgtaatgcggggagttaccacctacagacgcgtcccaaaccccaggctttcaccccacctccactccccgctcatttttaatacccgtgcagtggggaattgatactgtggttttcaatgtcacccacactgcagcacggccacagtcaccatcccgatttttgctacaaatgaaaattactgtataatgagctccttaacacttttctttaaacctgtgtttggaagacttgtgttggtgtggccctgtgccctaatacctgtgaaatcacagcaccgatgagctggttccaatttttaaaatatatacatgcagtacttccatgactattcaaagaaaaacaattccttccatttgccacctgagatgaccaccagggatgtgaactacctcctgccccatccccagccccaggatcctgggacagggcttatgaacgcaaccactgtagtcagctcacttgatccacagcctggcacctccactgtctggctagggagcctcgaatgggtcccaaggccaccctgctcctcagttacatcatctgcatagtagtggtggttgtgaggaattcaggagctgcagcataagggccctgcaggtactatgtgctcagtaaatgccagtggttcttaagggtctgagctcccattgtagaggcaagtaagctgaggttcagagacagaaaatgacttgcccaagatcacccagctgggaagtgacagtgccagggttggagccctggttgagctggttccacaggccagagctcattctgccctctccccggaagacctcccaccctgtccccatgcctctgcttctccctcaccccaattccccgctgccttctaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacagctaagctgttagtcatttgttcattcattcattctgaagcctgccctgagtttaaccctggctgggcactggataagacgctgtccctggtgggaagagccccacacgtgccaggatggaggatgacaggcaccgagtgctgtgggagcccagcactgtgggaagacattttcttctgcagggcgaaaatctgggaaggcttcctagaaggggcatctgaaccaatctagaaagatgaggagcataatacaacctgctgttctgtgtacaatgtgtgatgatcaaatcggggtcatttccaccacctcaaacatttaccatttctttgtgttgggaacattatcacacagttccccataaatatgtacattatgtgtccatttaaaacaatacaagcaaacaaatgtgaatttctaaactgagactactgtaaggcctttctcctaatagcaagattgtaataaaacttcaactagtcataaaaaaaaatccttttctgtttctgctgcaagcaaggaaatgagaggatgcatttgagtaaccttgaggcagaagaccctaaacaggagtggaggtgtgatattgtttggctctgtgtccccacccgaatctcacatggaattttcagccccatgtgttggaggcgggtcctgctgggaggtgattgtatcacggggctggtttctaatggtttagccccacctcccaggtgctgtttctcacaaggtctcattgtttaaaagtgtgtagcacctcccccttcgctctgtctctcctgctgtcttgtgaagaagggacttgcttcctctttgccttccaccatgattgtaagtttcctgaggcctcccagccatgcttcctctgaagcctgcggaactgtgagtcaattaaacctctttttttcataaactacccagtctcaggtagttctttatagcaatgtgagaacagacaaatacaaggtggatggggtggggagagttcaggcatgtggtgcctatcacaaggaccttattccagtattaccatggccatcgggggaggcacgttgtggggaccaggctggaggcaggaaggcctgagtgaaggctgctgtgggcaactaggcaagaggcggttgcctgggccaggacagggcagggcagggaagggctggggtgatgcagagggcttggggcccaggccagaggggctgggtgtctccatggatgtgttcttagggtgctcacctgggagacccagaagaaggagataacacgtaagggtgaggctggtccctggaaatcagctgacatcctgcaaatgtggagccctgaggtggagccaagcccgaggcacagcccactcagtggcacaagccacaaagggccggcctcaccccaacctgggtgctcgtgattgacagcctcttgttacgtgagggaagcagcaccccttccgtggcagaaaagttgggcctgaattgtttgagcaattccacgtgtgcagctgcgtataccatccagggtgataggaccatgagcccgaggccctgatgtcctggggtctagtcctgtgtccacaggcaccactcccctttgtacctcctgtcccaacagccaagctccacagggccaagactacagcatcctttgctcagcacccaaaccacagctgtgcccacagcacggaggctggggacaccgagctgatgtcctcagaaggcaagtggacaggacagcctctggggtcccacaatgtcctggaactgaaggctcagaacctacaggaagtttgtccatttcagtgttactttcagtgagacaccattttcaaccatactcaggaggatccgctgaaaaatgaaacagaaatgagtcatgatgggcagagcagggagaagcaagggagacgagaagtggggaacatggaagaaaaagccacgtgaggaagaaaccagaggtcaagagaaaaagaatcatggaggtagaggaagcaaaaaacacacataacaaagaatgtggactttgggtcagaccaatgtgagtttaaatccaggttctctcccaaaccagtttgggcagatggcccattggaaccccactctcctcatcagtaaaaggggggcagagtgagggtcctgagggttagcacatggactgtgtgaagcagacaatgcccagtgcttagcaccggaatcagggtctagcaggtgctccctaaatggcaggtgctgtttgctactgaaagtactggaaggctgggcgccatggctcacgcctgtaatcccagcaatttgggaggctgaggtgggtggatcacctgaggctgggagtgcaagatcagcccgaccaacatggagaaaccctgtctctactaaaaatacaaaattagccagacgtggtggtgcatgcctgtaatcccagctactcgggaggctgaggcaagagaatcacttgaacccgggaggcggaggttgcagtgagccgagattccaccactgtaccccagcctgggcaaccagagcaaaactcagtctcaaaaaaaaaaaaaaaaagaaaaagaaaaaagaaaaaaaaaagaaagaaaggagcactggagagtccaggtgcatactcttgtagacagcaacttgctgtgtgcctcatttacatctctggcctcagtcaaaagggacttggctaggcagccccacctcaaggccctccgcagttgaaagatttatggttctgagataggcaaagggggaaaactggagaaacagaagccaccagagggaggcaggcagagcacccaacaggtcccctgggaaagggcttggctgggcatcaaacctaccaccccataaacttgacattgaaggcaaaagttaatgacatacagcagagacacggatggctttgggtattttttttgtcttcttttctttttttaagatcaatattcattcttcatttgccctcgtaacgaaaatagatttttaaatgcctcaaatatacaaacatcattgatgcacacacattccagaaatgcagaggtatgctgctgccacggggtaggggtgcgggaggcggcctggcctcatggccgcagaccgtgccccagcccgggcctggcaggtagctggccactgataaacgccactgggatcctaggagaagctggggaccatgcgtgaggtactgaaggggaccatggtggatggcatcctgggcactttgtagcttgtctgagggaaaggcctctgctgccatagaaaagctggacacatgtcaccctggggccctgacatcctaaaatgccccactgactaccagtcactaggagaaaggtctccggctatgcccttcccagtgatgcttgccccagagtgactggtcacaggtgggggacaggtttgctccagaaaccgtaggcctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggaggcctcgctcacagcacctctgtgaggggactggtgctcctgggaagtcacttctcttggtgaccgagctgacaccccctccacttggaaagcacagggactgagcaggcgggacctgtgctggagggagaccctcctggtgaggaactatgcgggccttctgggcctcagcagctccagcccactcctggcctggcaggccacctgcccacccacccacccatctgcctctgggcccccagtgaagtcagaagaggcaggagccccgcaggctgtgagcctggcgcaggtcggctgacagcgagcttctcatctgcctggtggtagagcggacgctctcggcagcctgcacggcccggctcagggccttgttgagctcctctaggtcgcccaggtcgagctggatggagtgccggtgtctccgggctggtgggggagaggctgtgggcggccacttggcagctggttgggctgaggtaggtcctgcaggcgcatagtacctgaggagagaagtgagtgggctcgttacacatggggagggctggggacaagccgaggagcaccgtgtgtggggtcaacccccttctaaatcccagctgggccagtggctcctactctctgggtctcagtttctttacctctaaaatgggaataatgggcacacatccagggatttcttagaaagatgaaggaagataacaacatgagtgcctgacccagaacaggtgttcaaggacaggaagttcaatctacctgttcatctgatttactgcccatctagtacatgccagccagcgtgccaggctctggggttacagtgggacaagaaaacatggactcctgcaatcttcttggagccggatcttggggaggccaggatcaccctaggcttgatagcaaaaccccctcatggaagaatatctgggggttccatttgccaagcaaggggtgctggagaaaggcaataattaataattaataatagtaataataataataatagggattctgcaggagtgggagggtctggccccatgtcctgggaagtgggtagaagagcatccttcctagcccagtcctataggaatgtgaggtgttgttttaaagtgctgtgggaatgggctgacaagcccattgagatgaagcacggatttccctaagaggtgacaatggcatccatcagggccactaagtttagggttcaaggaaaccagcagtgggcaagagggggtgtggcctcagcactgttaaataaagggtgtgtgtggtggaggagggagataaagaagcatggacctaaatcaggaataagtttaggaggacgcagcagagtcattcattggcatcttgcttggcacactgtaaactctggctttattcctgagcccctgctgtctaacttgcattgttatacagtgtgtagaaacagatgatccaaacagacatttctccaaaggagctattcaaatggacaatacgtacatgaaaagatgcatatccttagccatcaggaaatgcaaagtgaaaccactgcacaccctctaacatcaaaaaggacagatagcaacaagtgttgacaagaatgtggagaaactggaatcctcagcactgctggtgggaatgtaaatggtggagccactgtggaaaacagtctgacagttcctccaacagttaaacccagtgcctagcccagggctggcatcctcatctttggtacccatgtaccagttggtgcctttatctttattttacagatgagcaaagcggagctcagagaagctaagtgattcaggaggcagtagaatgcaccagccttagcagctcaggccctggagccctgccccaaatcccagtcattctgctgggctactcatgggactctggacaagctaagtcactttgcaaggcctctgttttcccacctaaaacgaccacagttagcaacctctcagcttagagctgatggaaaattcaggtaaaaagctggcactgcctggctccggtaagtgctccataaacgtgagctcctaagacccagagtcagacagctggaaggggcagccatgggttcacacctgggcccgactctccccacatatctaatgtgtgctaattggcaagcagcagatgctgataaaataatctgaactgtatgaacgggcttcttgcatccccaaaacagcagcctgcactccctcctctagggaccgtctggtgtaagtaactacagaggctcctcaaattacgatggggttatgcccctataaacccgctgtaaagtcgaaaaatcataaatcgaaccattgtaaaagtagggactgtctgggctgggttttcatacacccccaccttctgttaatttgatgaccaacttggcctgaaagttacccaaaactctccctagggccaacactgaaaaagtccctctgggctggaaagtctcggctgcaggggctatgggacggctgcccagcagggggcagcacaggcccactccgctttccaaactacactggtctcaaccactgggcccgttcagtcctgctgaccagcagctggagaaatttcagggtgtcaccagcgcaaattctagcagcattagaagcaccatcattattggcaacttctatgtactatgggctttccatgcattaattcattcaatcctcagcacaacccatttcgcagagaaggaaactgaggcataggtataacccgcccatcctgagttggaaacagcaacctggtgagttctgcccacaggcctgagcctggaagaatgtgaaatggggcctcaggagaagtaaagactccatggctaccgtggggtcaccaaattctgggcaaaacctttcccgatcaatgagttggaacactggcaggcgctttcccccgtgtctgctggaggtctgagcatgcagcattggttctcatctctgctggagtggaagattccttagcgacttgcttagactcagctgagagggcagcaagaaagcaaatttacataccgggcgcggtggctacaccttgtaatgccagtgctttgggaggccaatgcgggcagatcacctgaggccaggaggtcaagaccagcctggccaacatggcgaaacccatctctaccaaaaataccaaaaaaattagccgggtgtggtggcacactattgtattcccagctacttgagaggaggaggcatgagaatagcttgaatcttggagatgggggttgcagtgagccaagatggcgccactgcactccagcctgggcgacaaagccagaccctgtctcagaaaacacatatacataaaaaatttttaaaagcacatttataggcctggtccccgaatagaggaccagggctggatggcgccttgggtccctgctccaccaagcaccagccctcacagtgacgcaggccctcactgcctacacacccaggcttctggcaacacagccactgaagacatccagtcccaatcgactcatttcacagcaggggaagcaggcagagaagtagctgctgacagctgagacaagaagacaggtttcctacttctggggactgggcttttgtccctgcacaatcctatcatgttgaacccacttttactccttcttcttcctactagtgacaacactgagcaatagcaacattctctgtgatggcgaagctactgtttgctcagcaatgagcacgtgaccaaatggcaccacaaactccacacacttctcatttggttcctgccacgtgccacacttaatcctcacgcacaggattaagtacgtggttgagactcttcctccatttaacagatggggaagtggaggctctgagaggaagttagtttgccaaggccacagtgctactagggggcagatgggactccacggtagctctggccaactccaaacccaagccacttctgtctcggctgccctgcctctcctggcttgactgatgttacgtccagaatctgtgcaaaaagtcctacaatattcccgaccaggactccccagagatgtccaggtcatcaaaaacaaggaaggtctgaggatctgtcacagccgagggggcgtaaggaggcatggcaatcgcataccacatgggatcgtggatgggatcctggaacagagacaggactttggaggaaaacggcctgaaggaactacgaacttcagttaccaataatgtatggatattgcttcactaacgtggccaatgtgccacattattgtaagatattaataataggggaaactgtttgtgcaggagtgaggaggattgtgggaatctctctggactatctgctcaatttccctataaatctaaaactgtcctaaaaaataaagtctattaaaaaaaacccagtgctcatcacttacttgcggagaaaacccataaggaaaatggaagatggttaggattctcagtctccacaaagttataagctcccagagggcagggccctcttgctagtccccttcactgctgggtcccagggccgagcactctccttggtacatgggtttgttgagtgcctatatgagtgttggctttgttgagtgactatatgagtgttgggctcctactgcatgttatccacgcagggataaaacacaggaggagtatactgcatctcagctgccccacccaggtctgaatgctaacatattcagtgatctatagaaagaggctgggaaggtcagaatgaaggctcttacacagcggcaggtggataaggcatgatgggaaccgaggagatgtaggcaaaggctggaggggctggtgctgggggcgctgttgccagataccacagtccggggggtgggcgtggcgacgaccccgcctgcttgctcctctgcttggggctgggagttgaagatgcttttctcctcgtggtggccttctctgcccctatcagggagggaacagcacagagagacagagtctgaccacttggcagatccagccaaagatggagggtccacccagcccttcccctatgagagctggacaggccctaccctgtgagactccatgtcggggaggtctctctttggggaacaaatcctctgccccagttgctctgtcccagactggaacaacagctgctccagttaaactcacccaggtctaataaccctggtcaaggagagctgagggtctggctaagagaagaaacagtatttgtccctaccagaggtggctgagcctggaccatctgcctctgggggagacccaacttgaccacacaggggacactgaagggtatcagcgggaggcggtcccagtgggtcccctgtgacagcacca

SEQ ID NO: 341 - DNA, 82566 bp, Homo sapiens
gcttctctgagtagtatacaaaaagttgagccttaatctttccctgaacactcttgaaattttaagttaattatccacttataagttaaggaaccattatattcattttattttactaggaatctaaaaatgtgttagatttttagaaatctaacacatttttagatatctaaatctaatgagaaaactattttatactaatatcatttttaaacgtttcaagaagaaagaatctatacactttaagaattaaaagcaaatctctttactttttttcctgtctgtctcccactaaaatgttagtcagctcagtgagggcaagccttatctatctagttgacttttgcgagcccagcatatataacagagcctggcccacaaaaaggtttcaataaataattatttttaaaagagagaaagaaatgtaaggctctggggaaagacagatagtatacagataatacttatctgtattcatatgagggagattcactttcccctacttaataatggaaaatgaaagaactttggaaacactatttggaaacgctatttgattgctttttcctatgtgcctccacagcctttgttcataccattacagtgtcatttatcagacattattacagctatttgcatatctatttttcccaatatactctgggtgcccaggacatatcttatttatttttatatacccagggcccaaaatagtaccaaatataggcactaaatatttaaccaaaataggtaaacagtagacattcaataaatgtttgcaaattaataggaaaaaggcataggaaaatagtataaatagtttcttttgtgatcctcttctttctctcctaacaacacccactgttatactgactaatcacttcctttccataatctttctctctcattataaactcttatttctgattagaacaaatgctgagccaggcttattttatattccactattttttcctgttctttttatattcatcaaagcattaatgaaaaaacaagagaatgccttttctattgcaattaaaatctataattccatgtgaaaagtttttagtagttgaaagcaaaagctaaaacctggataactgagaaccttaccctctgtggggatctcatagtactactaagccacctttcaagtaaatttcaaccaagtttgctctacaactctaaatttgactgacaaatctttaagacttgttacacacagatcattagttatctttttccccaacaacaaaactaaataatatttttgcttactatttgtctctagaatttattctgaaagacaactcatgatgctaaaaaaatctcaaagtcaagttatcccagctaccataataatagatcatgtatcactatgctgactacactgtatacatttttctctatcttagaaaaaatattcctaaatgtttatgaatacaaaatatattaattatctgttacaatactctgttctttgcaatatcatgtataagcagcaagtatcatatactacattacatcacttttgcaaaactggttactcacataagccaaacaaagtactaaggctttactatcctaggggatcccaaagggacaggccatgtgtgtttgcataattcaaatgttttctgctttttaaaattaccattcaaatgtttcatttcagagaaaacatctcatcaagtacctatcttaaaaaagtctattgcatttctatacaccaccaccaccagaaatggaattgatctgagtcaagaaacatagccatgcatatatggaactttggcatttgacaaacgtgacataccaaaactgtttttcaaagtagttgtaccaatttacattcccacaagcaatgtttaaaagatcctattgcttcaaagtctttctaacatatggtattgtcagactttttaatttttgccagtttaattgcataaaatgatacctcatttgcatatctatctcactaatgaggacagacatctctttatattcttattgatgtcatgtgtatactcttctgtgaaattcttttcgggccattttccttttgttcattttgcttttctttttgatttgtgaaggttcgctatatgttcttgttacaaatcccttgttggatttataccaatatcttttctcagtgtatctttccattttcttttaaaaattttttgacagaacaaagttcttaattttgaagtagtaagatttgaattagtaaaatttaaactagttaactttgagctagtaaaatgtatgtcttttcatagctttttgtttcatgtttaacaaatcttgctctactcccaaagcgtaaaaaaaaactcttattttttaaagagtatttaaaattgtttttgacatttagatcctaagtctacctggagttgactttttgtctatagttatgagaagccaagtggtagagagactgaacaacaaagaagtcaaaagaatgttgcagctgattagaggaactgggcaaataattttaagccttttctcagcaagttaggaaggtaaaattggagttctgggcctacctaggaagaaatgtctagccaacattccacattttaaatggtactttaccaaactttaaaaattaattctataattttaatacacaatatccagcatccaataaaaaattatccaacataccaaagacaatattggatacttaagaaaccaaaaggaaaaatagacaataggaacaaacctacaagagagccatattacacaaattagatatggatattaagtataaatgagatgatcaagaaaaattatatcatgatgaaaatttcagcaggaaattataatttgtaaaaacatattaagtggaaattcttgaaccaagtaatataataaagattgaaacagttggattcaatgtcacatagacatagctaaacacaggattattaaccataatatgttaatagaaaatgtccagatagaagcatgaagagaaaaacaaatgtacaaaatacagaaaagagcataagagacctatgagacatgatgaaaaaatattaaatgcataatcataatttgaaaagacatgtaagagaagaagaaaagggatatctgaagagaaaatgatcaagaattctccaaaataaatgaaagacatcaaaccatagacttccaagtgctataaacccctagcaggataaataccaagaaaaccacatgaaggcatattataataatattactgacagcaacaggagacaaattcctctgcagacagggatgggtccccagtgaaacccaaccttcaagcaaaggaaagtctaaaacctgaaaatcgaactgccagttcagcattagagtccacgactggagtgagaactttcatccctatcttaccccctctctctcaactggttccttctgaatgatgtcttttaaccaattgaatggtgctttttccaagaccactcaaggacctatcagcatgcagtcccccattctaagcccataaaaaccccagactcagcctcacagccttacccactttcaggacccctctcattgctgagagttttctttctgtcactcaataaaattttactttgtcttactcaatctccaatgtccatgtaccttattcctcttggtctcaggacaagaatttgctgaactgctggagcaaaatagctgtaacattcctcctcaccaagctgggggcagcaggagtaaaattgctgtaacattccctcccactcaccaaacaaagggagagaagaagctgctggacaccactctcttccactcgccgaactatgggagcaaaaaagccacaatatttctaaaaacaaaagattttaaaaatggtttaaacaagtcagagaaaaaaggcacagtaccttcaaggaagttgcaaaatgacttatagttaatttgtcagtagcaacaatggaatccagaggcaaaagaataacctctccaacttgctttaaaaaagaaaaaaagaactgatttccaacttaaaattatttactcagaggaaaaaataaactcaaaacagaaagtggcagtttccactgctagcaataataagatagaatacatatgactaatcctctcacaaataacagacaaaatatataaaccaactactttttttaactttctccttccaacatttattttaggttcgggggtacatgtgcagatttgttacatcagtaaactgcatgtcactgggtttggggtacaaattatttcatcacccaggtagtaagcacagtacctggtaagtagttattcaatcctaacccttctcctaccctccacctttaagtaggccccaatgtctattattcccttctttgtgtccatatgtacccaatgtttagctcccaagtataagtgagaagatgtgatatttggttctctgttcctgtgttcattcactcaggataatggcctccagttgcatccatgttgctgcaaaggacatgacttcattcttttttatggctgcatagtagtctatggtgtatacatggtacattttctttatccaatccaccattgatgggcacctgggttgactccatgtcattgctattgtaaatagtgctgcagtgaacacatgagtgtatgtgtctttttggtagaatgatttattttcttttggatatatatgtaaattgctttaggcagtatggccattttaacaatattgattcttctgatccatgagcatggaatgtttttccatttatttgtgtcatgtctgatttctttcagcagcattttctagttctccttgtaaagacctttcacctccctgattagctgtattcctaggtattttgtactttttgtggctattgtgaatggattgtattcttgatttggctctttgcttggatgttattgctgtatagaaatgctggtgatttttgtatgttgattttgtatcctgaaagtttgctaaagttgtttatcaggtctaggagcctctgggcagagacgatgaggttttctaagtataggcttaaatcgtctgcaaagaaagataggttgaattcctctcttcctacttggatacatttttttttctttctcttgactgattgttctggctaggacttccagtactatgttgaataggagtgatgagggtgggcatccttgtcttgcaccagttctcaaggagaatgcttccagcttttgcctattcatatgctgttgactgtgactttgtcatagatggcttttattattttgaggtatgtacctttgatgcctagtttgttgagggtttttaaactgaaaggatgttgaattttattgaaagccttttctgtatctattgagatgatcgtgtgttgtcttttagttctgtttttgtgattaatcacatttattgacttgtatatgttgaacggaacttgcatcccagggataaggcctatttgattgtcatgaattagctttttgatgtgctgctggattcagtttgcttgtactttattgaggctttttgcatctatgttcatgaggtatattggcctgaagttttcttttatcattgtgtctctgccaggttttggtgtcagagtgttgctgacctcgtagaatcagggaggaatccctcctcctcgattttttgaacagtttcagaatgatgggtaccagctcttctttatatgtctggtagaatttagttgtgaattcatctgttccagggctttttctgattagcagggatttttttattactgattcaatttcagaactcattactgatctgttcagggtttcaatttattcctggttcattcttgggagcttgtatgtttctggaaatttatcagtttcttctaggttttctagtttatgtgcatagaggtgttcataatagtctctgagggttttttatgtttctgtgaggttgatggtaatgtccccatttttatttctgattgtgtttatttggatcatctctatttttttttcataatctaggtagtagtctatcaatcttatttgttctttcaaaaaacaaactttaggtttcattgattttttattttttaaaaaaattatttccatgagttttggaggaacaggtggcatttggttacatgagtaagttctttagtggtgatctgtgatattttggtgcacccatcactcgagcagtatacactgtacccagtttgtagttttttatccctcaccccacctcccaccctttccaatgagtccccataatctattgtatcattcttatgcctttgcatcatcatagctcagctcccacttgtgagtgagaacacacaatgcttggttttccattcctgagttacttcccttagaataatagtctccagctccatccaagttgctgtgaatgtcattaatttgttccttttatgtctgagtagaattttatcatgcatatacacaccaaaatgtgttttacgtctcaattttattcagttcagctctgattttggttatttcttttcttccattaactttgaggttgtttttctcttgcttttctagttcctctagctaaaatttagactgtcaatttgagagccttctgcctttttgatgtgggcatttggtgctataaactttcctcttaacactgctttagctgtgtcccagagattctggtacattgtatctttgttttcatttattccaaagtatttcttgatttctcccttaattttattgtttacccaaaagtcattcaggagcacattgtttaattttcatgtcattgtatggttttgagagaccatcttggtatttatttctatttttattgcactgaggacctggaatgtggttggtatgatttcagtttctttgaatttgttgagaattgctttatagctgagcatttggttgattttagagtatgtgccatgtgcagatgagaagaatgtatattctgtggttgggtggagtcttctgtagatgtgttaggtctattcagtcaagtgttgagtttaggttttgaatatctttgttagttttctgcctccatggtctgtctaattctgtcagtagggtgttgaagtctcccactattatagtgtggttatctatctttataggtctgtaagaacttgttttatcaatctggatgctctagtgttgagtacatacatttttagaatagttaagtcttcttgttgaattgaaccctttaacattatgaaatgcccttctttgtcttttgtcatcattgctggtttgaagtctgacttgtctgaaataaaaaatatcaacctcagctcttttttgttttccatttgcttggtaaatctttctccatccctttattttgaacatatgggtgtcactgtaggtgagatgggtctcttgaagacagcatgcagttggatcttgcttctttatccaacttacttctctatgccttttaagtggggcatttaacccatttacatttatggttaacattgatatgtgcagatttgatcctgccatctatgttgttagctggtgtttatgtagacttgattatgtagttgctttatagtgcattggatctatgtacttaagtgttttgtggtggctggtaatagtcttttgtttccatgtttagcactcccttaacccatttatacctgaggttgcaatttttttaatttttacaatcagaccttggtgatgaccttgagtagtaggatataaataattcccatatgcttattgttccaatgatggaacactaggtgtaaatgggttttaaggacctcttgaaagacaggtctagtggtaacaaattcccttagcatttgcttttctaaaaagggttttatttctcctttgcttatgaagcttagtttgactgaatatgaacttcctggttggaatttcttttcttcaaggattaagcatgctgaatataggcctgtagtctcttccagattctagggtttctgctgaaaggtccactattagcctgatgggattccctttgtagatgacctgccccttctctctagatgcctatagtactatttctttggcatttgccttggagaatgataattatgtgtcttggggatagtcatcttgtatagtatgtcacaggggtctctgaatttcctgtatctgaatgtcaacctctttacagagattggggaaatttttgtggacaatatcctcaaatatgttttccaaggcattctctctttccctctctttcagggatgccaatgagtcatagatttggtctctttacataatcccatatttctcagaggttttctccttttttgtctttttcctttatttttatctgactgagttgtttcaaagaaccatccttcaagctctgagattccttcctcagcttgatctattctgcttttaatacttccagttatattacaaaattcttttggtgagtctttcagctctatcagatcagtttggttctttcttaaaatggctattttatctttcagctcttgaatcatttgactggattccttagattccttggattgggtttcaactttctcccaaatcttgataatctttcttgccatccaaattctgaattctatgctgtctttcagccatttcagttgggttaaaaaccactgctggtgagctagtgcagtcatttggaagtaagaatacattgacttttagagtggccagagttcttacactggttctttctcatctgtgtgggttgatgttcccttaaatctttgagcttgttctcctttggatcgagctttttgcttttatattctttgatgcccttggtggtttgactgtggtataagttggatttggtcaactggcttcatttctggatgatttcagaaggtcaaggctcagctcatcacttctgtgctgcatgctctaaccctgtgggggctgggaccaagcccacagctttgttctctggccctgctacactggagagaccaagattttcctggtccactggcaacaatactctgatggagggtgctgacaaaagcccttcatcagggtggtgtcagtggggttcatgctcacatgtgtgcacctgcagcaacagggcagtggtagggcggtgggggctgtgcatgcacatgtgctccagtggcaccagggtggcagtggcaaggtttataggaagaggctgcaggtgaatgcacaccagcaaagtggtgggtggaagctgtgagagggtgcacactggtgagggcccatctgcaaaagttatctgacagttatattggatctaccagccaaagagttatggtggtggctacaggaaagtatatcagctgggcgtctgaggctgtactgcaagtggatgcagccagacagagaccttgggagaggctgggcagacagaggagcactcatcagactggctccaccctacagttagatagccctgttctgtctagatctgacagttaagaaaggccaaaaccacctagaggagtatggcaagccttgggggctgggcatccctggccatgtgccactgtgatcattcttgttccaaaccttctgggttccatgcaggctggattcctgtctttgccagctctccaaacagctctccttgtcagttcaaatgtctatggggatcatggggtctcctgcacctaggattcttgaggtccctggtgagagcaggccactctatgcctatttaactcatcccttccctgggagcctctcagggccaggaatgagtcctggtgcttggcaaccccatgcagggttcccaacttcctccccccttcagcccaggatctgcattctccttccaaccactttcaatgccttccttccgaagtactgttcagaatgtgctgattttgacggtgtggtctcttggtgggagaagctcttcctgaaccctgtagtcagctatcttggctcctcccaaaacaactatttcaaggcacctgacaaggacagaaagaaaaaagaaactggagagaatttgactcttgaaatactagaaaccgtagtggttgagagttacatttatatggcatttcctgtaagtacactctccactgggacagcatagggcagttagaactcaagtagaaagctaccatcttactgatttaagatgtcacaggacagagtctgggaaaggacagaatgagcaaaaactgaaggtaaaaaaatctcataaaagagaaaactacagactggggagccctaaaggtacacatgaatttttctaaaattggggagatgctgaagaacccaatagaaaccaatactcataaggaaaaaaaataaaaataaaaatctgtgctgtgatttcaattgctgcccatttcatttcaggaacaacagagtttaaagtttgaatcctgcaagttagatgggttttgtaaacacatcaaactgtccactgaaactccaccaaggccacactatagaataaaagactatgtcccaggactaagaattctctgtaagaataaaaaccgaatcaacctgttaaaaaggctacacaaactcctggttattcatcagtaatttaaccacctgctgaagtaaaactcaacactcttccaaggaaaataaaagaatccgaaacatctctttctttttccatctctaccatttcacccaaacaagaatccaaaatacttatagtctattttctatgctgtcaagtatataaccaaaacttactatcatatgaagaaacaggaaaatgtcacccatagtaaaagaaaaatcagtcaacagaaacaaaacccagttgtagtcagcaaataaagggtgtaatgcaactatcataaatagattttaaaagaggctagtcctaatggatgaatagataggacatttcaggaatggaaactattttcaaaaaacaaatgaaaattcaggaactaaagtaaaaaaaaagttcactggatggattttaaaatagactggagagggcagaaagaattattgtgatatatttaaattaaatgttataaagtaccatttaaaatatcagaagatatgaaatacttggggacaaatttaataaaatatgtgcaagatttgtatccacaataaatgtagagatatataccatgtttttaatcagaagactcatcactgttaaaatgtcagttcagcacaaattgatccatagatctaatctagtcctaaccaaaatctcagtggacttttttgtaaaaattaacaagctaattctaaaatttctatgaggttcaaggcacctagaataacctaataaaaataatttgtatttcaattactatgaggtacagtaattaggactattgtggcattggtgtaagaatagatatataaatcaaagattcatattcatgtaagagcacctaagtagacccatacatatatggtcaactggttttcaacaaaggtgaaagagtaattcaaaagaaaaaaacagtttattcaataagtggtactggaaaaactaaacatctaaatgcttataaatggtactggagcaattaaatttctgtatttcaaaaaaaatatgacctctaattcacacaattcataaaaatttattcccaggtagattataaaacaataaagcttccagatagtaacgtaagaaaatatcttcttgactttgaagtagttatgttaacaaagtttttttttaacagaacataaaagtctctacccataaaggaacaaaataataatttggaatttatttaaattaagaacttctgaatattaaaaaatggttaatattatgaaagggagaagatatttgtaatacctacaactaacaaaaggactcatatctagaacatataaaaagttatcacagaaatacaaattaaaactacaatataataccactacatacatttgaattaaaaacactgacacttgccaacaccaagttcaccaagttcacaagaatgtggagcagttggagctcgtattagaaaattcactttggaaagctgtttggtaatatctactaaagctgggcatatgtataccttatgacccagaaatttcattcctaggtattagtccaaaagaaagtctacattaatgcactgaaagtaatacacaaatgtgtatataatagcaatgctcattaaagaaaaaaccagaaataattcaaatgttcatcagcaatagaacagatagataaattatggtttattatcaatgaatgaatgaactactacatggtgagctctcacagacatacaacattaagcaaaagaaatcagacacaaaatacaacatactgtatagtctcagtatttgaagttcaaaaagaggcaaaactcacctatggtgttagaagtcaggatagtgacagagtagtagctggtagcggggacaaggggccctcttagggttctaataatattctatttcttgacgtgggtggaggttacatgagtgtgttcactatgtggatatgtattgttgttagagataatgtgtgcacttttctgtatatatgttattcttcaataaaccatttaaaacattaaaaataaccacttgtgtggcttagaacagttgtccccaaccattttggcaccagaaaccggtttcatggaatataatttttccacagatggtggatggggggaatggggatggtttcaggatgaaaccattccacttcaaatcatcaggcgttagagtctcataaagagcacacaaactaggtccttcacatgcgctgttcacaatagggctcacactcctatgagaatctaatgccgcagctgatctgtcaggaggtggagcttaggcagtaatgctcacttgcctgccactcacctcctgctgtacggcctggttcccaataggccatggaccagtaccggtccacgacccagggttggggacccctggcttagaagcaatgtctagagattttagggtaatagaaactatataaaggtagtatatatgctacaggcaaaacatgtaatctagacattataaacaactcttacctaattcctgggtaactgctatacgaatattctaaaactatttaaagaaaatgtcaaatttaatactttgtcattgtattggtagtgtaggagtaagccataagatcatgagtaactataagtattacttacaatgtgaaccacctctgctgaatctctacacttctacccacatactacacatactacctttcctttcaccgtctctcctttatactacccctgtttcacctttcatgggcaggttctttaggtaaccaaaatacccacattatttatcacttcaagtctgtaaataaagccacggatagcaataaaacagaatcttgtagtaaggctacataaattatagtatgtctttattggaaggaaaagttttctaaattggtctcaaaattcttaaaaataagtcaataaatatataataaagctatctgtactctcaatatattttcacttttccaaatactttaaccttattagttgttcttcattagtccttcaccttatgccactggacaaatacctttaaaaaaaaaaaaactcaaagcaggaaactacttaaaatatgtttcaagtattttgtagagtttattggatcagaatccattcttcttatacttcaaccccaccactgagcttaaaattccttccaagcttttgggaacagtgctttcactgtcactatccctactatccataggataatcattggctgttccccaaattccagaacgatgtgccattgcattgctttcctcccacactgaagttgctggcggtagctcattttggcagtttgtcaaataaatcacacagtaaagcatttggtgatctttaaccaaatgaatctgttgtgtatacagcatatgacatgtagaggtatttcacacattataatagaacacagtgaaggatataccctgtacagcataatcctagaatcaagacttctctttgagaacttctctttaaaataacatcttttttttgaactaaaaagattaacttacttaaaaacaaagggaaataccatctcatggcaattattgttcccttctgagaatgactgatgacgtacatacttattaccagacagtttatggaaactatgttgtcaaatagatcacattttcctacagaaacaatgtcaggatagggctcatatcccttaccaaagaatcaacagagaaactataattatgagagttaattttccgtaaaagcaaagataagactattacaaaattttataatataaagtgacaaaaggatgcttcaactttttaatttatttaacaaacgtttaacaggtgtctgtgatgtgtcaggcattggtaatcaaataacacttggtacctgccacgctcaataaattaactaacagtcatgatttactaaacaagtacatcaatgtttactgtatggggtggttagtgtcatgaacgagaggtgctcagtctgtaaggacacagaagacagtcatctaaatcagcatacggggtcagtaaacacttcctggaaaagatgacctgggctcagctttgctacatgagcaaaaactggctgaattagaaaagcaatccaagtgacgggaataaggtcatgttttgcataacaacattttggtcaacaacagatgcgtacatgacggtggtcccataggaatatagtagagtcgaaaaactcctattgcctagtgacctcatagccatagtaacattgtagtgcaacgcctgtgggttttggtaacacttccagaagaaggcattgttatcacaggagatgaaaattcccatgcgtgttattgcccctgaagacctttcagtgggacaagatatgaaagtggaaggcagtgatattgatagccctgattctgtgtaggcctaggctaatgtgtgtatttgtgtcttagattttagtaaaaaaaactttaaaccgtaaaaaaaaaaataattaaaaatgtaaaaaagaaaaaaacttatagaataaggacataaaaaagaaaatattgtgcagctgtacaatgtgttttaatctaagtattactacaaaagagtcaaaaagttaaaaattttttaagtttataaagttaaaaagttgcagtaagctacggttaacttattattgaagaaggaaaaatatttttaaataaatttagggtagcctaagtgtacagtatttataaagtctacagtgatatacagtaatgtcctaggcattcatgattccctgactcactgagagcaacttccagtcctgcaagttccattcatggtatgtgccctacataggtgtaccattttttaattttttataccatatttttactgtgtcttttctatgtttagatatacaaatacttaccgctatgttatattaataattgctggcagcattcagtatagtaacatgctgtacgagtttgtagcctaggatgcctaggtgtgttgtagactatgccatctaagtttgtgtaagtacactctatgatgttcacacaatgacaaaatggcatatggatgcacttctcagaacatgtccccattgttaagtaaggtatgactgtagctgataacacatgcacagaggcataaagcaacacggaacattcaagaaactgcgagttcctgtttggaggaacatatgagggaggtgcatcacaggaaagaggtgcaagataatggtagaagccaaatcatgaaatgctttgggaggtaggtttaaaagtttgaactttattgaaaaagatagtccccctgatcctccaacagctactaaaaatgattttaagcagagaagtaaaatgagcatattttcatttttaaaagatctatttgattttactatggaggaaggctaatgcaataatcctgaattcatgaagcaatgttaggaatagagtagaaggaacagatctgagagacaacaaggagaaaaaattcattgaacctgactgataaaagaatctgtacaccaaacccccatgacgccaatatgacaaacctgcatatgtaccctgaacctaaaataaaagttttagaaaagtttttaaaagttcattgaacttagacattaattggaagagagggtggaatgaaaggaagagtctaaactggcttggtgactaagatgatgatcaagaacaaggacaaagagagggtctcagttggtagggagcagggaaaaacaacaaatatatttcaaattattttgcacattatgttttctatttattgtctgaagaatacctataaaatataaattgtatataacatacataacaaagtgtagccattttggaaaacagtatggaggttcctaaagaaattagaaatagaactaccattaagagccagcaatccctcttctgggtataacactgaagtaaaggaaatcaccacttcataaagatgcctgcactcccatattcactgtatcattattcacaatagtcaagatatgaaaacaacctaagcatccatcaacagatgaatcgataaagaaattggtctatatatacaaaggaaaaaaggagaacctgtcatttgccacaacatggatgaaagtgaagaacatcatgctaagtggaataagctagacatagaaagaaaactattgcaggatctcacttatatgtagaatctttgtttaagaaagtcatacagagacagagaataaaacagtatctaccaggggctgggggcaggagtgaggaaatgggtcagtgcaaatcaaaggatacaaagttgcagttatgaagaatgagctctagaaatctagtacacaacatgaagactatagttaataatgctgtattcaggatttttactaaaggagtagatttagatgctcttgctacacacacaaaaaaatgggtaactgtgagattatgaatatgtcaatttactttattacagcaaccattttactatttatatgtatttcataacatcatgttgtataccttaaatatacacagtaaaatttattttaaaaataaattcacataaatacaaaaatttttttttttgagacgaagtctcgctcttgtcccccaggctggagtacaatggtgtgatctcggctcactgcaacctctgcctcccaggttcaagcgattctcctgcttcagcctcccaagtttacaggcgcctgccaccacacccagctaatttttgtgtttttagtagagatggggtttcaccatgttggccaggctggtcttgaactcctgacctcaggcaatccacctgccttggcctcccaaagtgctgggattacaggcatgggccaccgcactcggccaaaaattttttttaaatcccctgtatcatacatgtgacataaagcttattgttactagtatattcattttaattatttaattagcaaaggcttcctgattttcttaaagttacgttgggggattgagggagaaaaatatttaaaaatcccaagtctcttttacaaagctgaacaagaaaatttaactttccttttcctcccaaaatagatacttgcagaaagctgatatatacgaaatcattccactaaccaaagaatattcagcaattattttaaactgtcctacagttgagacctatattcattagaaaattgctgtattatcataagtaaagatctcaaaaagatgaaatatatgcttttattatgtaatattaacaaagcagcaacttggctcattcacagtttatgcaaagcattttttgaaaagtttaggaagtctaaacctccagaaatttgcaaggttaaaaatgtacttctgagatggtcaggtctgaaacttctatttcccagctgttttcaaggaacttcataatttatttatgtatagacaaataaatcttcagcttcattagtcatttctcactatattctaagaccaaaaaagggtactcttctctttgtttattatggaaaagctatggcaaggcaggggaggaagaggaattgcctggggggaccgagcaactaaaaagaagagcctggagtgggactgagccttggagctgtctaatgagccactctgcctcccacagctagctcctcacagctctgcaaaagactaaaaaactggagccaacaaaaacaaaacactcacaaatctaatttgggtgactaacaccctaaagatatgcagtttgctcctgaccaggattggagtactcactttctttgcgaacttcctcaagtgaagccgtaagctcatcctttaaaactgtagcttcctgggcaatcttctctcccttgtctaataaattccaagttgcttcctccacagaagctagaaggacactggctcttttcgaacgtccttttttcctgctggaagggttctggggacagtttacaagtgtggtaacctaaaattggaaaaatacaaagtactaaattgacaaattgtaaggagaacacagtcctgggatattacagaccagaacaaaagacagtacagttgacacttgagcaactcaagggctaggggcgccaacccaccgtgcagttgaaaatctgagtataactttcaactcctcaaaaacataactacgaatagcctactgttgaccagaagcctgataacataaatagtcaattaacacagattttgtatctgtatgtactatataactatattcctacaataagatgagctagagagacgatagtgttatttgttattaagaaaatcataaggcagagaaaacataattaaataaatcaacaagtagaaatggatcatcataaaggtcttcatcctcatcatattcatattcctgaggaagatgaagaagaagaggagggttggtcttgctgccttgggggtgtaagaggcagaagagatggaggaggtggaagggaaggcaggagaggcaggcacacttgatgtaacttttattgaaaaaaaatctgattaaaagtgaacctgcatagttcaaaccagtgttgttcaaaggtcaactgtatttcatagtaacatgactcatttccagtgctgttggtacacctacaaaagtcaagtcatggcaccaagaacagcaacagcagccaccgtggagttcccaactaaaaataggaaggaagtgggagtcttagtgattgaatttcaaaatatagacattaaaatgtcctctcttcaactaccccagtcatcaaatcatttctatgttaaatatttactgaacacctattttttacattgttctggatgatggaaaagaaatgcatttcatgctttcatggagtttacattcttaatatcggcagcatacaataaacatataaacaaatttaaaaatgtaaggttcagtaaatgttttgaggaaaaataaagttggcggagggaatacagtgagagagagtggggatcggggtggtcaggaaaggcctcttgacaggggactttgagtgagacctgtttgagaggccaaatgagttaggggaaagggtagaagacagatctgaaaggttacaaagggcaagaaagtaggtcatagtaaggatttggactttgtcccctgaagcaaccactgttctatatgattcagaatgtttctccctctcctaatattagttatctctattctcagcctaaatagactaatactgacttaattataattatttttggctccctcttaatgtagattgctggcttaaaagtggtataaattttattttataattatttgatattttggagatacataattttctactctcatttttgactgttttatcaaagttctgtattttttatatgaagtttctgtaattaaaacaatacacacatacacagccttctagagcattcttcgagtagcaaaacttgaacaaactcctcaccacaagtatatgaagtgagaaatgtgttaattagcttgatttaatcattttacaatgtatacatatatcaaaacatcacagggtacaccataaatatatataaattttattcgccaattttaatttaataaagcttggggaaaaaaagaaagaaatgaatcttaacaaatacaagaacaaactcataataagaacattatttgaagataaaaattaagcttctgtatttggaaacaaaaacatcatactgaattacattattaaaaaacacccatttctggccaggggcagtggctcatacccataatcctagcactctgggaggccgaggcgggtggatcacctgaggtcgggagttcaagaccaacctgaccaacatggacaaaccccctctctactaaaaatacaaaattagccgggcatggtggcgcatgcctataatcccagctactcaggaggctgaggcaggagaatcgcttgaacccggcaggcagaggttgcggtgagccgaaatcacgccattgcactccagcctgggcaacaagggcaaaactctatctcaaaaaaaaaaaaaaaaaaaacaacccatttcttaattaaatcttggatcacaattacaagttttggattaaatttttataaacaaagctttaaaatcaccatcgtagaggaatgagagaaaggaaaaaaacaacttgtatctaatatttaaaatagaagacctgaaactcctcttgaaagctaatctgctgcatgtcatgaaacagtggaggctcatgataatcatgcatcacatctttgacagcaaactacataatgcttcctgctcagtagtccctagagattttcgttgttgtttgtttatggagcattcgatgtttgtttacttggatatctggacccagtttttatccatgaactaaaaaaaaaacttaagaagttatgggggaaatatgcggatgaaaatcattttcatctgccctcctaccctcctccccttacccaatagatcctctgtttcattctaatttgctttatttccatgttcatcacccagagtggaatgtcttgtggcaggcctttgtttcctctcttagaaaataaaaacaatcattgttatcctacaagactggggaaggtcaaataaggtaaagtattttggaaaatgcataatatgacacaaatatttgttggcatttcatgtatattttctagtttgttccccatgtaggtgcagaaaattggttataggaatctttaacaaaggtattctctctggatctaagtttatcttgctcttggggccccccatgctaaatgtggcagttagcaaagctcattctatatgctttacaagcagctaaataagatcatgtgtcttcatcatggattatataagaataataataagcctgatttattacatgggttttcacaaattccaaaaggcaaatatctcactcttgtcagtctaatttatatattgagagttgaaaggtatttgtccagattaagacaaattataactaccagtttaaaatctttgtttaaaacaaagaataagtatcattgtctgaagtgttccctcggaatgtattttaagtgctgcaattcatgatgcttcccactgcacattcctcctctattgttcagatcctccatgcgccaaatgttttccatagaatagcctgggctttgaaattaaaatgagcgttccagaaatgctttgttccttataataaatgccagagaagtaagaaatgtgaaaagaactttgtataagaacatcatgcttccatcaaaaaaggcaattgcaacttgcaagttattcacttttataagttgtttgtacctacgtcttcttttaaaatactccaatacagttatttgatattgattaaactaaagtcaagtgaggttttcaatgattccttttatttcagaaagtaaatatggcttggcaatcctgtggaaaaaaagaaagctgaaactattttttttaaccctaactcacctaagagatttaacttactcctatcagtgactgtgactcaccatagcagatgattctcaccaaggcggaggataggagggcgctatttgaaaaggtctcccacctcttgaaggaataccagcaaccagtaaaattagctttcaagttatcctgtaaaataaatcctgtgtcctcattttctttttcagtactaaatcagttatatttctgtaaggaagtttagttggaacaacttgcaacaaagatgattctaatgtagggtttaagcccatgtcttgctaactttaccttttgccatagatacaaaaccctcccattcccctctttctcagacttcaggggtccctctcatatagaaaatctccaagcttgcagcattagagagcttgggtttgcttactttctttagtctgtaaatctgtgctaggctataaagacacaccttcatcgtagatacaggaaggaacttccatgggaatggtgctaaattaaaagtttcaagtaatttataaagaagaaattcccactctattaattctgcaagtttaacattccacaaaaccggacatattttcaatggtgtgtaaaaatatttatatattaaaattaagagtataaaaaaggtttttatagattttccaaatttaggtgtgcttctctaaatgctctaaagatgctgaaaattaaattgataagcttaatgaaccaagccatcaactgtcattatatagagccacactggcacacaatatgaacactgtagaatatgttgacttttttttttttttgagacggagtctcactctgtcgcccaggctggagtgccgtggcacgatctccgttcactgcaagctccgcctcccaggttcacaccattcgcctgcctcagcctcccaagtagctgggactacaggcacctgccaccacgcctggctaattttttttgtattttttagtagagacagggtttcaccatgttagccaggatggtctcgatctcctgacctcatgatccgcccgcctcagcctcccaaagtgctgggattacaggcgtgagccactgcgcctggccgtgaaatgtcttttttaatgccaacttgggtaacacaattatattctataaccttgttccttcccaatatagttctgattttttttaattctaccctcattgtagtataaaaaggccctgttaacagccatctcttttcttgtttattagctaaaacactttgaatttcaaccttcctccaatagctcacaggagccttcagggctacttttgctcccttgagttaattttaatgtatgaaataaaatataagacatttaagctatgttaattagctaaaacttcaacagggttctgaaagaaattagaagggtagaaaaataaaactgcctatagataagtaaaaactgtgatctttcaaagtaaaaggtacaaaccagtctcggggaggagagggggtgtcccttcttcaagtcattgataatttcaactattcttttacttctaccaaaacaacccttactggattaacaaaagtacagaggaagattaaagggttgagaacccaaaaaatgcctctagataacattcaacacccccccaaaccaacttcaatcttcttttagttcctttcaagccaataaacacttatattttgttcaaaataataccctaggcattcaggaaataaatatgaataagctccaatatggcaataagagaaatacacaactagttgcaacattaaaggcagaatgataactgtttacacttatataagtacaaagaaagtgctgccaaaattgcaaacattcacaaggattaagtaggacttccaagaagagcctttaagaacagataattttctaccagaagagataaaagggaggtatgtaagccagggaaagaaaattgtgtgcaaaggggcagagaaaaaaatttattttgtctgaaaatagcagatagccaaacttagcaaactgtggggtaaacacaggcaatagggtgagaaggccaagaaataggtttcatcttaaataaaaagttataaaagtcaaagaaagagttaatatttaatgtaataggtgatagaaaatgaaaacacagcatgcccaaagtagagaagcctttgcccatcaacctgcctctccaccatctgtattttttacctcagtggctaacacctctaacctgaagcagaaacccagaggtcatctgggctagtctctctctcatcttcctctccaagtccttgtcatccaagacacagaaacggggcatcattctctgccccattcaccaatctatcattatgaaaagtgtgtgcaatgattctgccctcgttgaatctttcatgaagcgtcttctgagaggtctcactgcctctgcaccagccctacattcccactagagccgtctcttgaaaatgtaaatctctcatatttgcactacctgtaggctacctgctgcctacaagcaaagtccaaactctttagcgtagcttttgaggcaattttgatctcactgctcactaaattttcattctcatcttctatctgtggaatctgaccacaaactacttgttaggctcagaacaggaaatgttcagcaacctcaacctggggtgactccctcccctcacagctccttgttcgtagctcttgtatcactcattatactgtcttgtaattagctgttcacatattgcctcctctgctctaccacgaactcaataaggacaggggccgtgcttgactcatcctgaaaacacagagccagcgtactgtgaaaaataaacaaacagtggtttactggatgaaaaaaaaaaaagaataaaaccctacattttagaagcctttaaatcaagagtcacaatgttcagtgattcatacgaggttaccaaaagaatgggttgctacagcaaaattaaagtttagtgataacacatagcagctttcattaaaaggaagtccttaatgtgggattttctgccatatctcctgtctagtttagttggggtctgatcagttcaatgtaatctaggatcaagtatattatatccagtctttttttgccccccccaacaaagacacgttacataattcattttcaaactacaaataaaaagagctggcacatcctttttattactgattttttcatttttttcaatccttgtgttagttttctagggctgccataacaaaataccacagactgggtggcttaagccacggttccccaacctttttggtaccagagacccattttatggaagacaacttttccacagacccaggggtggagtgggggtagacgtttttgtgcccggagttggttccttctggtgggttcgtggtctcgctgacttcaagaatggagccacagacctttgcagtgagtgttgcagctcttaaagatggcatggacccaaagagtgagcagtagcaagatttattttgaagcgtgaaagaacaacacttccacagcaaggaagcggaccctaccaggttgccactgctggctggagtggccagcttttattcccttatttgtccccgcccatgtcctgctgattggtccattttacagagtgctgattggtccattttacagagcgctgattggtgcattttacaaacctctagctagctgcagagcactgattggtgcattttacaatcccttcgtaagacaaaaaagttctccaagtcccctacttgacccaggaagtccagctggcttcacctctcagtttcaggatgattcaagtggattacatttattgtgtactttatattattattacattgtaatatatatgaaataactatacaactcaccataatgtagaatcagtgggagccttgagcttgttttcccacaactagacggtcccatctgggggtgatgggagacagtggcagatcatcaggcattagattctcataaggagtaggcaacctacgtcacaataaggttcactttcccatgagaatctaatgccactgctgatctgacaggaggcagagctcaggcagtaatgcaagcgatgggggttggctgtaaatacagatgaagtttcttttgctcacccacccactgctcatctcctgctgtgtggcccagttcctaacaggccatggacatgcaccagttggggtactcaactggtactggcactggaggcctaggggttggggacccctgggttaaacaacagaaatttattttcttacagttctggaggtcagaagtccaagaccaaggtgtcaacaggtttggtttctcctgaggccttgctccttggctatcagatggctgtcctctctctgtgtcctcacatgtatgcacacaacaatgatgtctttccctgtacatcctaatctcttctgataaggacaccagtcatattggattagggcccacccaaatgaccccattttaatttaattacttctatatccaaaggccctgtctccaactacggtcacattctgagaaactggggttagggcttcaatatgtgaatgttggggttggaaatggcacaattcaatccataacaatctttaccacaagtgatacaaaaagtgtaaaataaccataacctttttaaaaatataatttagggttttgtttgtttgttagataaacaaccactgctaacataagccattactccgaactattgagggacagtaacaaagcacatgtagatccctctccaattccaccagccctctgtgccacacagatggcataacaaagcaaagagatttacgtgtcaaacacataagcagttgtagctaaatatcctaatccaagaagtgcacttactcctggataaatataaagctaaacacaactaggaaaagaccacatgctgagaataataccaaattagtttcttctagttttcacttaaccacttaccatccaaaaacaaacgagtttggactttaccattcatttattcaacaaatattgatggtgcacctacactgtgccagaacatggcaatgagcctcattctaagaaggtgggggaacagagaataaacaaatacataagtaaatgtgtaacacaacggcaggtattctttttttttttttttttttttttgagacagagcctcactccatcacccaggctagagtgcagtggtgctatcttggctcactgcaacctctgcctcctgggttcaagcgattctcgtgcctcagcctcccaagtagctggcattacaggtgcctgtcaccacgcccagctaatttttgtgtttttagtagagatggggtttcacccatgttggccaggctggtctcaaactcctgacctcaagtgatccacctgcctcggcctctcaaaatgctcagattacaggcgtgagccactgcacctggccaatagtaggtattgacagatgctatgaggaaagtgaaaaagggtaagaaaataaagagtgaaagagaagagctagtttagactgcatattagggaaagcatctctgattaagtaagaaggatccaaggaaacagaagaataagacatttaaatatctggaggaaaacatcccaaacagaagaaacaggcgcaaaggttccaaaacaagagcttgactgttgtattccaggagcaataggaaggctggtatggaggcaccaaattgtgcaggacttgtagatcaccactaatgctctcaattctattcttatgactggaagttactgaagtgcttgaaacaggaaagtaacatgatctgaccccaaattttaaagcatcattctaaatgctctaggcaaaacagactagagacagctctatgcaaaacagactaggcaaggatgggatgaggaatagaagaagggaaagcagttaggagtccgttgctgtagcccaagtgaagaccacactggcttctttgaggaagcagtggcggagttaagaaatgacaaaattttggtatattctaaagtgtcaacaaggtttgctgacagattgaatatgggttatgaaagcaatatggcatcaaggatgactctggcatctggcctgagcagctgagtaaatggaggtaatatttactagttgaggaaagtaaagggacatgagtaggaagggaaatcaagagttgatggattaccatggcattagccatgttaaatttgccttttagagtttttaaagtggagactagtatacaattctggaattgaaagaggtaaaagttggagatatgtttcgtataggttactttttcaatttaattgttcacttgtcagtagttttgctgatcttaccaaaattgcaaagacgtttggggaaaaatttttttttaatcagagattgaatgagatctcttaaaaacgatgtataactggagaagaagtcacaggactgagctttgagaaaccccaacaattaggtgtagtatttctcaggaaacccaaccgttaacatattaattctaggatatgtagattttgtcatttcgaacattactattatttagaggaaatgcctggtttttgaaactaaatttaatagttgttttttaacttttattttaagttcagaagtacatgtgtaggtttgctaaataggtaaactcacgtcatgaaaagttgttgtacagattatttcatcacccaggtatgaagcctagcactcaatagttatttttcatgattctctccctccaccctcttataggacccagtgtctgttgttcccctctatgtgtccatgtgttctcatcatttagcttctacttataagtgagcacacaagtggtatttggttttctgttcctgcattagtttgctaaagataatggcctccagctccttccatgttcctgcaaaggacatgatctcatttttttttaatgacagcatagttttccatggtgtatatatgccacattttctttatcctgtctaccactgatgtatatttaggttgattccatgactttgctattgtgaattgtgctgcaatgaacaggcacgtgcatatgtctttatggtagaatgatttatattactctgggtatatatccagtaatgggattactgggtcaaatggtagttgtttttaggtctttgaggaactgccgcactgttttccacaatggttgaactaacttacattcccaccaacagcgtataagcattcctttttctctgcgacctctccagcatctgctttttttttttttttactttttaataatagctattctaactggtttgaaatgttatctcattgtggttttgatttgcatttctctaatgatcagtgatgttgagctttttctcatatgcttgttggaaaaatgcctgttttatacagaacaaaaattcagacaaattcagttttaaaaatgtaatgttaatcatatagtctccttttctacaaataaatatttcaaaaaatgagaagaaaaactataaagatattaaattaagcaaactaaagagaaattatattcatgctgtaatttattcctaaatcaaacaactagtaattccagtaaatcaataatccatagtttataggacagtactgattcaaagaaatgttgaataagaaaaagcaaaaagtcaacctttttccatcaataacctttgactgcttaaaggaagcaaaacaaaaagtaaaaaatccaatcataccaaagaagactctaaaataaataagttgactgcacatgtaatagcttagatatgttcacataatcccttggtccgtccagccccgcattccacttccagcagtgactgatggtagaatatggttatgactcctacttacgtattccagaattgtttgataatcatttacaaccctatcaaccataaattgaataaactatgccaatattttgtcatttgtgtttgctttaccaacataaacttagaaagttttatctgcatttccctcccactatctgctgccggattccctttttcacatctaccttagatggtcagatttactctttcttgttctcttctaacacaaaactccattttattgacgatatccaggagaaaatatacatagctacttgctcatcatgatgaatatgagagataataaacattaagcaaaaaagatcatcaaagatagtgattagatttgcagggctgaagattttatagcaaccaaaatatgatttaaatatagctcatcagcaaattaaatacttatattcagtttaagattgattaggctgtatccacctcatttgtcagaactctctctaagtcaatagtcattttgtctcattgtttggggtaaaaattaaataccagtcacccatcttgaatctcattggccagcacttgatctttaatgtcccaaagtcccttctttgatattaccatagtctctcaattctaaaatactatcaactacaacacaaaccaccaatgtaatcacttctcttaaaagtgtaaatatggatattttgtcaatattgaaccttccataaccaaggtgaagccaagagacttattgtctaggaataaagacagcagacagaacaaagataccattgatcatctttgagtttcaaagctgactttcttaagctctcaagaaagaaaataattgtgaagctggaggcatcatactacatgacttcaaaatttactataaagctatattaaccaaaacagcatggcactggcataaaaacagacatgtaaagcaatggaatagaatagagaacccaataccaaatccatacatttacagccaactgatttttgacaaaggcaccaagaacactcactggagaaaggacaatttcttcaataaatggtgctaggaaaactggatatccatacacagaagagtgaaatgagacccctatctctcaccatattcaaaaatcaactcaaatggactaaagatttaaatgtaagaccaaaaattatgaaactagtagaagaaaacacagaaagagaaaatcattttctaaatccttttggctctcatttagcaaaagctagatctgatagactagatcacagttttatgataaagaagatctggtcagacaggaaaaagaagtgtggactattggaagaaaggtctcagaaacaggttagacacattttatttctcttctctgggcttcacccagattaaaagctgtaatggctctcaactaacacagttagttgggaaacacagaaagccgaggaatttttattccatttatcttcaagactttgaaagaaaattgttttatgagctcccctgcacaaaacttcaggggtagctacagtgtaatcttgccatcacaatcttgaagctcaataatacataacaatgtaaatgggtagagagaaggtcagcttagctttcttaaatcagtcttgattcccatgaggcttagatgaaacccagaacatcctagataccatgaaaaacaatcaaaatgaggctatgttgaaaagcagtgggcctgccctgagttcaccatggtgaagagccaagtgatctagcagagtctgagggtacacagataatgccagatactggatggaggatgtagctgggacttcgaatctgaagcaccatcaagggccaaagtggggttaaagcatcctggagaaaccacagaccctagccaagctacaaaagaacgccccacaaagcatataaggacatcaagaaatgcacagaggtgcccacaagatgaccatgcatgggacccatcactccctcaaaggtcacagtccagagagcattccagaccagccactcggcaggcactaagtgtccaaaggtcaccacatgggtccaaaggccgcatctcccaccgtgaaatcatataagcaacaccctcaacccaatctcctgttttagagcattttatctaaaaagactgagcatttaccaaaagggactgtttatattgttgaatcacatcagtttaccatcttattggcttaaacagaaggcatttattccaattcccagtaggtaggagtttatgaggaaggtcagatcacttacgaaagataaactaaagtgtgctgtgggaaaacttgtaatcccctacaagtacaaaaaggaaagctacattaaatgtttatttccattatacgatgcatcctaatttcagaaatggtaaaaaatgtgaggtggacaatgtgggaaaatgtgtttaaattaacgaaatatggtatcttgcaaatcaagattgcgaatgcaaactgtttcctaaaagaaaaaactcatctgaaaaaccacatttattaagccttaatttatttaatttgtagagctttcactactgtacatatatatgtgtatatatatgtatatgtgtgtgtgtgtgtgtgtgtatatatatatatatatatatatatatacagaaatgtggatatctatgtattcaaattcagctacaatgaggttaaaaaggcatagaaggggcaccattttatggcaagctttggaccaagaggcagaaccatgctcactactggctgatatcatggccagcataacagttctgacatggtaatcacctgggagctttaaaaattattgtctagtcctacttccagagattctgatttaactggttttgtgtaaggcctgggcatcaggacttttaagagctccccaggcaattttattgtgcagccagggttgaaaaccactgggctaacagaatctcaacaataacagggattttctgaattgcctacttagtactcttcctccaagtaagccttctgtatctcccatagggcttggccacaaaccactccatcatactttatctcactgggggctctcaattgtgtgtgagataatgcccatttcttacccttccttaaccagggagtgcagagtagctccatgagaaaatggtcagtctaggccaggcgcagtggctcacgcctgtaatcccagcactttgggaggctgaggcagacggatcacgaggtcaggagttcaaaacctgcctgatcaacatggtgaaaccctgtctctactaaaaatacaaaaaattagctgggcatgatggtgcacgcctgtagtcccagctactcaggaggctgaggcagaagaattgcttgaaactgggaggcagagattgcagtgagccaagatcgagccactgcactccagcctaggcaacacagctagacatcatctcaaaaaaaaaaaaaagaaaagaaaagaaaacggtcagtctagaaccagggccttccaagacatagaaggggcaccattttacatcgtaggagccaaatctggcctcttgtctattttggtaaataacaaaattttactggaacacagccacacccatgtgtttacatattatctaagtttgctttcacattacaacaatagcagagtagttgcaatagagacgctatggtccccaaaactgaaactatttactatctggacccatacagtaaaagtttgccaaccactggtctagagtcagagttttcaagctgcaacagtatctcataagacaagttagatgtcctgaaatagccccggggagtctatgaagggtagagtcagaccttgagcagtgaaaatgacgacatctggggagatatggactcttctatcctttcagccagctgaagcacaattgcttctatcaatctattaatatcattttccactaagagggcaggtgtatcttggcttatcagtctgcatcacctggctgcccacacaatcagtttataagagaacaattatatcctaaagctaagttagaagtgggtatctatggaatcagtctgaattcattgaggaaaagatgagctgtgattgaaagataaagtattaacagaaacagagtgaactggggttggttggagaaccctgaaaaagaggggagcaacattaaagtgaagaaaatcacagtctaataggacaaaaggtttaggaagcaagctgagaagaggtgaagcacatacaatgaatggcagctacccacagatcatctcaaagctaccagtttctgctggtgggggcctccttgtatccttgccatgcacgctcccactggacttgtactattttaatcaattagctatgggttttcctatccttattttaatgtaatgagtgacttcctttttctccactatttgtgtcttaagaaatactatagcctagccattttcccatgggagcagttttctggcagtaaaatcatgcagaaattggagaattcactttattagaatcaactcagctatactgaatcatcttaaactttaaaacattactgaggcagaattaagtttatttcttcatcctaccataaaaataacatctttatacttattaagccttaagcctattagtatttaaaagacacttaatttactaacttttaaggttactcgttgaggttatagtcaaaactccaatatttgcttacaacgtgccctacaagaacactctatgtgtgcagacttccttttgagatttccttggaagcttcaagattaattctgatacaaattctattgatagaataatcagcaagagtacaaaaaagaagcttggaggtaaaaccaagaaagcataagtaaatggcatcatgcttattcaaaatgacctatagaaatgacagaaagcaaccacaaacaaaacttgaactgttttctgaaagaaacaaaggaaattatcttctagaaggctaagaagccaaagggggcagacatgttctctccctgctacctgaaagccaatcaaatctgtctgtagagcagtggaaaattaactctttgggcatctaggcatctctttgcataaattgatatatatgattgcttgctgcctttagagggggttgtggtcaaggagagtagaaaggaattttgacgagagtggggtgtagcagagaggttcttcataggagccaggcaggaaagaaaaacatggtgcttggaaaagctaggactaactactccccatgcagtcactaggactggccttgactctagtaaggagcggggagagagtagagaagaagctgaaagggatcattttcataggaattgtgtgtgactctaggtgcaatcattgcctcactggggcccatatgagagagtgcagcacagaattgggaagagaggcattctcccctcttttgtaggagcctagcgccattctaccacattgaggattggcagctgaaggagaccagagaatttcaccccaaaatatggtaccctggtatgtttattattattattattttgagacggagtttcgctcttgttgcccaggctgaagggcaatggtgcgatctcggctcactgcaacctccgtctcccaggttcaagcgattctcctaccttagcctcctgagtaggtgggattagattacaggcatgcaccaccacgcctggctaattttttgtatttttagtagagacaggtttctccatgttggtcaggctggtctcgaactcctgacctcaggtgatctgcctgcctcagcctcccaaagtactgggattacaggcatgagccactgcgcccagccgattattttaaattaaacacccctggggaccagcagacactggaaggagctttactttgatactccctaatctgcctaatgtccagactcgccaaagaaaaaaataattacttctggtcccttccctgagttttcatcaatttaataataactctaatcacaggcaggtagactgaagtctgtcaacacacctggacagacgtttgtcaaaaatcatgctctgcgggcccaacaaactttgtcccaggccactgtatgttctccaagtccactgaatttcccctaaaaatcatttactacaccccaagttgacacatttcccctatctcccctcctctatgaaaaagggtatataagcttctgtacccgttgggttatgaggtaatcattctcctactattcccctgtgttatgcacattgaaataaattttgtgtgtcttttctcctgttaatctgcctcttgtcagttgatttttcagcaaaacttcagagggcaaagaggaagcaatccctttgaccttacagatttggcattgttggtgggataaccaaaactgctctgctcctctagaagctgcagtcaaaggaacacaggacctgataggtgaacagaatgataagaaattcttaccagtcagactcccagtctctctctctgcataatctggtcaagcagacgagaaaaatcagtttgtctcttttttctttccaaatttaagattaatgggagaaaagcatttgtatgactagtcttagatgtaatgactctggtatatttttgctatgaatattcatattgtccatccttttcctcacagaagtagtctttattttttcctttgtctctgtctttctgtgaagagtccctcttgttttatgtccttgagagcttgacttttgaccacgtaggagccctatctcttggtctctgccatccagtgggcatgatttttgggccacgtctggtggccagcctaaaaggactaggaacccggaggtacctaagatattaagcagcacactctgttccaaatgtgccaagctctcagcaaagtttttcttaaataagaaatcccatccataaggggcttttgttgtcctaactcttgttgcctggatagtcctggaaagtccaatcccaggaggacctactcagtgtcacagattaacagatctatgactggtgcccctccctcctcaatactggaggcaccatatgaacaaacacctcctcaaccatctgtcacaagtgtcctttgctatattagactttttctgaaagtgaattttgaggggatcatgagaactacatcatcttcccatttttatactgccacttatactgtccatgatagtctaaacctggaaagctacctctgagactccatgaaaatggctcattaacttgagtcatttatggaataaataaattggctatacttaaaagaaaactttttagagagtgcttgtcttaaacagctatcttattcgtacctatttttaaaaatattaaaggaatatagccttagaaattctcttagtaagatttttaaagcagaaataatattcaaaggaaacttaaaatcctgtacactcaattgcctgctttggatccatctaggatctgcaaaaagcactctggcctatggtctaatggctaggattccactgtttcattgcctcaactcaggtttgatttctagtcagggaaccagccccttggagatgtaaatcctttaactcaggggaaaaaggaaacatttataaaaattagtttgagggtcaggcacggtggcttatgcctgtaatcccagcactttgagaggctgaggcaggaggatcgctggagcccaggagtttgagactagcctgaaacagatcccttctctacaaaaaattaatttaaaaaattagccaggtgtggtggcatgcatctgtagtctcaaatactcaggagactgagacaggaggatggcttgagcccagagatcaaggctgctatgagccatgattacaccacttcactttagcctgggcaacagagcaaaaccctgtctcaaaaaaaaaaaaaaaagaagtttgaattacttattttgaatttatatttgtgtgacccttgactttttggggtacccatttgtcattgatctttttcccttccatggacagttatgttcctgttcatcactaagtctctattttcttccagaggtctttgtggggtggctctggattttgtgaagactgcttctttgtacctctttggagatgtcttgtgctcccttggttaaatcataaatggcttttttggttctgaatcacttggtagttacctttggtttaaaagaaaaaaaactgaagttcagataaataaagttttaaaaaaataaagtttacttctccttcctttctctacgtctgatacacatgaagggatctagatgggactttgagtgaccctgaagcctcttgagaaccacaacaaaaaggtaccactgactccctgttttggggttctctgttttcctcatggagactcaaaagtcgtgaatgggttcctctcaggtctgaaatctctactcttttttgcattaaactccctcatctatttgacttttgtatacatacatgtatacgtgtgtgttgtatgttgtgtctacatgtatgtgtctatacatgtgtttgcatattatctacatgatatcaaattgacttaaaaataaatgagtactcataaattatataactagcccaaaacttttcaagttcccttgactttaataaatctttggtaaataaagctagttttaaaattgctagtaaaataaaaatgtcttcaaaatttaatttagacatttttgcctaggtctactggtcacacaggtttatgctacctctgttagatgttttaaggtcataaaactgttgtttctatgatattcttgatattttcttgatttgtatataaactaaaactgtaagtgctggctgctgggctcccaaaagtcttacacacatcctactgtggcttgttgagccaagcccaatatggccccatcctccctggtccagctctgcctcctggtcatgctgagaggggtcagatcctcccaacattgtcttcacaagtccgtcctctgccctgggccctatattaggtgtgcaaatccaggattcagacaggtcctacccttcgtagtcatcctgggtgccacatgggtactcagaacccaggacaactagagtagggacaatggggagggacctgtgtccagtatctcaaaggccttagttaagataaaattagctgatgctggttttgctttttcaaaaaaaatacataataacctaaataaatagctttattttccatgaataattcaaatataactgttaaaaaatatttttcaataatttaaaatcttaaggacatgttatgttaagtagtagagaatcatgaaatgtttgagtcatttctaagtaagttaaaatactaaaacattaattattaagcatagtttagataattttgacatcttgttcttatatggcatagaaaagctaaatatatctgtatctgttaatgagcaaaaaactgatgaaacatctttctaaaaattataaaattgttttcatttacaaacactgatataaaacagttcaaaattacttacttcctaggttttcagtagaaactagggttactaagagttactattataattagtatataattaaaactactgtatatgataaacaactatgtatggagtatgtaagggaagtaaaatgttataaggtatgaggatgtgcttttgttgagaaaaagcaatttcatatagttcagagattatgtaaaggttgtttcaaaatgagaaaaatgatataaataaaactaaatgggtatagaaagttgagaaagagagaatttcaaaataattaaggtgaatgaaatatttaatatttaatattaaatttatttaaaatttactatttgtttttaaactgagccttaaaatcaaaaatagtctacaaaactagaattttattttctcctttgaacaagattttcatatagtatcaataagaaatagtaaacgactttggttcacattttgagtaaactgcaaaaaaaaaaaaaggggagaaacagcttttgtgtgcctcatgctatcttaataggtcttttgagtatttgaaaaactaagtctcatctctgtcaaactgtcaaagagtaaaggttttggcttttggaaatcctttattacaccagctaaatgaatgactttatttcacagtaatttttgatcaaatattttaaatgtttgacatacttgacaagcttcccaaaatcaaccttcaaattctaaagtaagtctttttgacttcaaactaactttgggattttcccaaagacccctgaagtatccaaaagagaaataataaacaggtttagtttatatattaaattatatgggaagaactgtcaaataacaaataatgtttaaccttttttctgagttatatttatatggctatcttgttagtatgtgttccaaaactgtatgagatttcttaaaatatgatatatcttggtatatgttgtcattcataattatgagtgttatgttgaattgttgtaggccacaaaaaaaagaccaaatatctttgtcaattgtttatttaaccatggccattttaagtcccattgtccacagttaattgttttattctgatgctttttttttcttgaaagctcttcccaaatcctgaagtatgggtcttcaaagaagttcatgggaataacactgacaaataaaggtttctgacaactctgaaactgtataagtgaatcaatgaactgtgtaaaaattccagaactctaataaaaaaaaaaactggactcataaaattgctaaactaccatcaagcagaacaataattaattacatgggactgaactgataaaagactgaaatgattatttatgattttttatttaggctaattatttttatgttttgttctccagagttaaaaaaaaaacaacaactttttaaaggctacaattcccctgtgttatgcacactgaaataaattttatatgtcctttctcctattaatctgccttttctcaattgatttttcacccgaacttccagagggcaaaggagaaatttggccttcacccctacactgctttgaagccactaggacatggctaccttggcatgttcatttccagtttcccagagtaccaccagcagcagtcaccatccaccagcaataagctgaagccagacaaaactggaatacacggcagatacgctggtttgggagcacaagtgagtcataattcagagacttcaaaatttggaaatgcaggaatgaacagaagagaaaagaggttttataggaaaatccccactctagcacaagcaagtgaggtcaattacaggaactctggattgctgctgctaatgggacttcctttgaacttgcaagggtagagtaggaggccagggaatcagattacataaggataagcatctggcctacatggcccagtggtctgggaactgaaaacaatgagtcccacagaggctgaagtataattctgagaatagaatgtagtttggaaactgaaaaaaatctgttaaaaccctggcaactaggtaatcttattgttcctgaacagcaggagtttgtgaatccaaacctgaaaatgccacattcactatgactcaactcttccccttgtttctactttctgtgtatctttcagctttgcacctaatagaactgtttaaccctaggtactaactgcttaaatctcagaatatagtcaactcctcaaaaagaggatgctaacgggaccaattcataatcatcccccagaggcagagctctcatggcagagcacgtcacagggttcttgccaacctataactgagtgtcactaagtcagttgcccaccctgataaagttagctgtaacaagggtgccaaagtgtcttgagagcattatggagacttaacaaaaggaacccctaaaaagaaggcaaagggaatgtaatagttattaaggctgttcacaaatattcccattgtcctctgggcacagggcaggatcacatacccaacatccactttgaccacataacttgctttgacaaaagcaatgtaaatagaggattgacatatgtcatgtccaggtgaacattttaggagttctcgcatgatttatcatgttccatttccccagttgcaatgacagtggaagcacatgttgagataagtctatattagcctgggtctctgagtgcctgtctcaagcagaaaccccagctcacattgaacatgtagcttgagcaggaaataaattttattaagcctctgagatttgggggttgtcttcttatcacagcacaaccttgcttatgctgactaatacaggggctggtaggtaaacttgccccagtgagtattaaaagctatccccaaggggacaggtgggagacactatggaggtagaaatgaaaaaaaggccaagaggtcctacaatacttagaggtgaacgacaaagaaataatgtttattactgttcttctaactctagatttacttcttgaaaacatgggatatatttacagtcagaaaatacatttgacctttgcccttcaaaaaaaaactttacaaaagataacacattataaagagtttgttattactattattttaagggattttgagtaagtcaattcttttaactcacattcaacataaatctgacacctaccaaactgtattttgcagcaaataagattatagacagtttcattatataatgactgtagcatgatctagcagtttatatccccttcagagagtatacaacatagagatgtaaattctttgaagcacaattctgcataaatagactttctgcattgcattgccaaacttggatcttgaaagtgataaagtgcagatgcctacagttgcagtcataaaaatgtaattgctgagaaattatttctgatccattggaagaatttattacagagggatgcaactgtgtaagttatcacacaagaaactgaaagtgaatgattgaaatatatcccaggctaaatatccctgcaaaatgacccaagagaaaaaaatctctgtgcccaagagaaaaaaaaaatacattaaagataaatcaggtttggtagggaagaatttggtaaccataaaagagcagaataaagatttatgaagaaatgaattcagaagttagagtgacataatagtatctatgaccaattactccaaaaattaaaatgtaattttgactttgagttatatacagaggtgataagtaatttctgtggaaccctggaagcaaaggaatataacatgaagataaatcatgaggaaagtgaagaaatttttaatgggactactgaattaataactttagctggtggcaatgtgaacttaaagacatgaacttcttttggaatgttttccagtgaaatcagagactatatcatgtacttaaaccatgtaactatttcaaattaaacactctttgtaacagtagccaaaatatgggaacaaccatctacagatgaatgaataaagaaaatgtggtgtttatgcaatcgaatactattcagtcataaaaaaaagtaaatcctgccattttctaacatggatgaacctggaggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaatcattacacattgcatacatacatcaaatcatcacatcgtacaccctgaatgtacagaatttttatttgcctcattacctgtccattaaatatattaaaaaaaaaaaacactccttctcctcctcccctggggtagatggcggcggctagatttggagccccaacctcgctgccggcaccaagatggacaattagaagcagctgcggtctgcgcactcagagaggaaggaaaggagcaagtgaattcagcaccttcaactgaagtatccaggttcttgcattagggctgactaggcaaacaatttgacccacgaagaacaaagaaaagcagggtggggcgatggtccacctgggagcagcacggagccaaatgaacccccaccctgagccaagtaaagcagtaagtgattgtgagaccccacctggaaaaccacgcttttcccacggatctttgtaatccgtggatcaggagatcctctcgtgagcccacaccaccagggcgttgggtctgatacacagaactgtgtagaatgttggcaaagcagccgtccaggcacacacagagacccaggagttttccacactccagccccaggatccctggcaagacgagagatctgtccgtatatatccctaggaagggggctaaaaccagggagccaaacagcgtcattctgcaggcctgctcccacagcaccccacaagttaagacccactgattggaattccagccagccaatggcaacaggctgagatgagaccaagttccttgcgggaggggcggccaccatctccatggttcagtcgactcagccattccagcctgatggctttggagaatacaaatggtccagacaaagaagggtccccgacaatagcacagctgccttgccagattatagccagactgattctttaagtaggaccccaatccattcctcctcacagggtgggacctccctgtgggggtttcagccaccccagcaagggctctacagacaaagccctgatctctccctgggatggagctctcaggaggaggggttgccacaccatctctgtggttcagtggactcagccattctagcctgccagctttggagaatacaaacggtccagatgaagaaggatccctcactccccgccccaacgcagcatatctgctccaccagaaagcatccagactgcttctgatcccattcctcctgaccaagtgagccctcccaacaggagtctacagacacttcctacaggcacattaggaacagcaacatgtcagtacccccactgggacagagcttccagaagaaggagcaggctgctgtctttgttgtttcacagccttcactggtgatacttccaggtaaggaaaactgaggcaactagggtctggagtggacccccagcaaaccacagcagcccaacagaagagtgacctgactgttaaaagaaaaacaaacagaaaacaacacaacaccaacaaaaaagaccccataaaaaccccattaaaagtgagcttgaagactatcttgctgaaatagagcaggaagacaagattagagaaaaaagagtgaaaaggaaaaaacaaaacctctgagaactacaggaatacataaaaagaccaaacctatgactgattggagtacctgaaagagacagggaggatggaaccaagttggaaaacacagttcaggatatcatccaggagaacttccccaacctagcaaaacaggccaacatataaattcagggaatgcagagaaccccagtaagatgctccatgagaagatcaaccccaagacaaataatcgtcagattcttcaaggttaaaatgaaagaaaaaatgtcaagtgtagccagaaagaaaggccaggtcacctacaaagggaagcccatcagactaacagcagaccactcagtggaaaccctacaaggcagaagagattgggggccaatatttaacattcttaaagaaaaaaattccaacccagaatttcatatctggccatactaagcttcataaatgaagaagaaataagatccttttcagacaggcaaatgctgagggaatttgtcaccattcagtctgccttgcaagagctcctaaaggaagcactaaatatggaaaagaaaaagcattatcagccactaaaaaacacactgaagtacacagaccagtgacactattaagcaactacataaacaagtctgcaaaataaccagctagcatcatgatgataagatcagattcacacaacaagattaaccttaaatgtaaatgggctaaatgttccaattaaaagacacagaatgacaagttggataaagagccaagacccatcacagtgctgtcttcaagtgacccatctcacatgcaaagacacacatcagctcaaaataaagggatggaggaaaatttaccaagcaaatggaaaacagaaaaaaagcagaggttgcaatcctagtttctgacaaaatagactttagaacaacaaagatcaaaaaagacaaagaagggcattacataatgataaagggttcaaactgacaagaaaagctaactatcctatatacatacacacaatatgggagcacccagatgcacaaagcaagtccttagaaacctataaagatacttagattgggaaatttaaataccccactgacaatattagacagatcatcaagacagaaaattaacaaagatattcaggacctgaactcagctctggatcaagtagacctaatagatatctacagaactctccacccaaaaacaacagaatatatattcttctcattcaccacagagaatactataatcacctctatgcacataaactagaaaatctagaagaaatggataaactcctggacacatacaccctcccaagactgaaccaggaaaaaactgaatgcctgaatagaccaataatgagttctgaaattgaggcagcaataaatagcctaccaaccaaaaaaaaggcccatgaccagaaggatttatagctgaattctaccagaggtacaaaaaggactggtatcatttctactaaaactattcaaaaaattgaaaagaagggactcctctctaactcattctatgaggccagcatcatcctgataaaatctggcagagatacaaccaaacaaataaaacttcaggccaaaatctttgatgaacatcgatacaaaaatcttcaataatatactggcaaactgaatcgaagagaacatcaaaaaaattatccaccatgatcgagttgtcttcatccctgggatgcaaggttggttcaacatatgcaaatcaacaaatgtgactcatcacataaacagaactaaagacaaaaaccacatgattatctcaatagacgtagaaaaggacatcaataaaattcaacatcccttcatgttaaaaactctcaataaactaggtattgaaggaatatacctcaaaaaaataaccatctatgacaaacccacagccaatatcatactaaatgggcaaaagctggaagcattccccttgaaaacgcacaagacaaggatgccctctcttaccactcctattcaacatagtatcaaaagttctggccaggacaataaggccaagaaaaagaaataaagagtatccaagcaggaagagagaaagtcaaattatctttatttgcagatgacatgatcctatatctagaaaaagcccattgtatcagcccaaaagctccttaagctgataagcaacttcagcaaagtctcaggatataaaatcaccgtgcaaaaattgctagcattcctatacatgaacaataggcaatcagagagccaaatcatgaatgaactcccaattatgattgctacaaaaataataaaagatctaagaacacagctaacaagggaagtgaaagccttcttcaaggagaactacaaatcactgctcaaagaaatcagagaggacacaaacaaacggaaaatcattccatcctcatggataggaagaatcaatgtcgttagaatggccatactgcccaaagcaatttatagattcactgctattcctattaaactaccactgacattcttcacagaattagaaaaaaaactattttaaaatgtatttggaaccaaaaaacagctcaaatagccaagacaatcctaagcaaaaagaacaaagctggaggcttcacactacccaaattcaaactatactacagggctacagtaaccaaaacagcatggtactggtataaaaacagacacgtagaccaatggaacagaatagggaactcagaaataagaccacaaacctacaaccatctgatcttcgacaaacctgacaaaaacaagcaatggggaaaagatttcctatttaataaatagtgctgggagaactggctagccacatgcagaaaattgaaactggacccctaccttacaccatatacaaaaagtaacccagaggaaagatcaggcagcaacatttgctgttcaccaatattcgctgttctgcagactccactgctgatacccaggaaaacaaggtctggagtggacctccagcaaactccaacagacctgcagctgagggtcctgaatgttagaaggaaaactaataaacggaaaggacatccacaccaaaaccccatctgtacgtcaccatcatcaaagaccaaaggtagataaaaccacaaagatggggaaaaaacagagcagaaaaactgaaaattctaaaaatcagagcacctctcctactccaaaggaatgcagctcctcactagcaacgtaacaaagctgcatggagaatgactttgatgagttgagagaagaagacttcagatgatcaaacttctccgagctaaaggaggaagttcgaacccatggcaaagaagttaaaaaccttgaaaaaagattaaacgaatggctaactagaatacccaacgcagagaagttcttaaaggacctgatggagctgaaaaccatgacactagaactacgtgacgaatgcacaagcttcggcagctgattcgatcaactggaagaaagggtatcagtgatggaacatcaaatgaatgaaatgaagcaagaagagaagtttagagaaaaaagaataaaaagaaatgaacaaagcctccaagaaatatcagactatgtgaaaagaccatatctatgtctgattcgtgtacctgaaagtgacgggcagaatggaaccaagttggaaaacactctgcaggatattatccagaagaacttccccaatctagcaaggcaggccaacattcaaattcaggaaatacagagaataccacaaagatattcctcaggaagagcaactccaagacacataattgtcagattcaccaaagttgaaatgaaggaaaaaatggtaagggcagccagagagaaaggtcgggttacccacaaagggaagcccatcagactaatagctgatctctcggcagaaactctacaagccagaagagagtgggggccaatattcaacattcttaaagaaaagaatttttaacccagaatttcatatccagccaaactaaacttcataagtgaaggagaaataaaacactttacagacaagcaaatgctgagagattttgtcaccaacaggcctgcctaaaagagctcctgaaggaagcactaaacatgggaaggaacaactggtaccagccactgcaaaaacatgccaaattgtaaagaccatcaaggctaggaagtaactgcatcaactaatgagcaaaataaccagctaacatcataatgacaggatcaaattcacacataacaatattaaccttaaatgtaaatgggctaaacactccaattaaaagacacagactggcaaattggataaagagtcaagacccatcagtgtgctgcattcaggaaacccatctcacgtgcagagacacacataggctcaaaataaagggatggaggaagatctaccaagcaaatggaaaacaaaaaaaggcaggggttgcaatcctagtctctgataagacagactttaaaccaacaaagatcaaaacagacaaagaaggccattacataatggtaaagggatcaattcaacaagaagagctttctaaatatatatgcacccaatacaggagcacccagattcataaagcaagtccttagagacctataaagagacttagactcccacacaataataatgggagactttaacaccccactgtcaacattagacagatcagtgagacagaaagttaacaaggatatccaggaattgaactcagctctgcaccaagaggacctaatagacatctacagagctctccaccccaaatcaacagaatatacattcttctcagcaccgcactgcacttattacaaaattgaccacatagttggaagtaaagcactcctcagcaaatgtaaaagaacagaaatcataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaagatacaacataccagaatctctgcgacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataagtaagatcagagcagaactgaaggaaatagacacataaaaaacccttcaaaaaattaatgaatccaggagctggttttttgaaaaggtcaacaaaattaatagactgctagcaagactaataaagaagaaaaagaagaatcaaatagacccaataaaaaatgataaaggggatatcaccgccaatcccacagaaatacaaactaccatcagagaatactataaacacctgtatgcaaataaactagaaaatctcaaagaaatggataaattcctcgacacatacaccctcccaagactaaaccaggaagaagttgaatctctgaatagaccaataaaaggccctgaaattgaggcaataattaatagcttaccaaccaaaaaaagtccaggaccagacagattcacagccgaattctaccagaggtatgaggaggagctggtaccattccttctgaaactattccaatcaacagaaaaagagggaatcctccctaactcattttatgaggccagcatcatcctgataccaaagcctggcagagacataacaaacaaagagaattttagaccaatatctctcatgaacatcgatgcaaaaatcctcaataaaatactggcaaaccgaatccagcaacacatcaaaaaccttatccaccatgatctagtgggcttcatccctgggatgcaaggctggttcaacatacacaaatcaataaatgtaattcagcatataaacagaaccaacgacaaaaaccacatgattatctcaatagatgcagaaaaggcctttcacaaaattcaacagcccttcatgctaaaaactctcaataaattacgtattgatgggacatatctcaacataataagagctatttatgaccaaccgacagccaatatcatactgaatgggcaaaaactggaagaattccatttgaaaactggcacaagtcagggatgccctctctcaccactcctattcaacatagtgttggaagttctggccagggcaatcaggcagaaggaaataaagggtattcaattaggaaaacaggaagtcaaactgtccctgtttgcagatggcatgattgtatatctagaaaaccccattgtctcagcccaaaatatccttaagctcataagcaactacagcaaagtctcaggatacaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatggataggaagaatcaatatcatgaaaatggccatactgcccaaggtaatttatatattcaatgccatccccatcaagctaccaatgactttcttcacagaattgggaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagatatcgaccaatggaacagaacagagccctcagaaataatgccacacaagtacaaccatctgatctttgacaaacctgacaaaaacaagaaatggggaaacgattccctatttaataaatggtgctgggaaaactggctagccatatatagaaagctgaaactggatcccttccttacaccttatacaaaaattaattcaagaaggattaaagacttaaatgttagacccaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaataggcaacctacagaatgggagaaaatttttgcaatctagtcatctgacaaagggctaatatccagaatctgcaaagaactccaacaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctagagaggatgtggagaaataggaacacttttacactattggtgggactgtaaactacttcaaccattgtggaggtcagtgtggtgattcctcaggggtctagaactagaaataccatttgacccagccatcccattactgggtatatacccaaaggattataaatcatgctactataaagacacatgcacacgtatgtttactgcagcactattcacaatagcaaagacttggaaccaacccaaatgtccaacaatgatagactggattaagaaaatgtggcacatatacaccatggaatagtatgcagccataaaaaatgatgagttcatgtcctttgtagggacatggatgaagctggaaaccatcattctcagcaaactatcgcaaggacaaaaaaccaaacaccacgtgttctcactcataggtgggaattgaacaatgagaacacttggacacaggaaggggaacatcacacacctgggcctgtcgtggggtagccgggagcggggagtgatagcattaggaggtatacctaatgtaaatgacaagttaatgggtgcagcacaccaacatggcacatgtatacatatgtaacaaacctgcacattgtgcacatgtactctaaaacttaaagcaaataaaaaaacaataataataattaaaaaacccaagatggattaaatatttaaatgtaaaacccaaaactataaaaaccctagaagaaaattgaggcaatagcattcaggacataggcaaaggcaaagatttcatgatgaaaatgccaaaagcaattgcagcaaaagcaaaaacagacaaatgggttctaattaaactaaagagtttcctcacagcaaaagaaattatcatcagagtgaacagacaacctacagaatgggagaaaatttttgcaatctattcatctggcaaaggtctaatatccagagtctacaaggaacttaaacaaatttacaagaaaaaaaaaacattaaaaagtgggcaaaagacatgaacagacacttctcaaaagaagacatacatgcggccaataaacatgaaaaaaagtttatcagctgggtgcggtggctcatgcctgcaatcccagcactttgggagactgaggcaggtggatcacctgaggtcaggagttcgagaccagcctagccaacatggtgaaaccccgtgtctactaagaatacaaaaattaaccgggtatggtggcatgtgcctgtaaatccagctaccaggaagctgatgcaggagaatcactgaaacccagcaggtagaggttgcagtgagctgagatcatgccactgcactccagcctgggtgacagagcaagactctgtctcaaaaaaaaaaagttcaacatcactgatcatcggagaaatgcaaatcaaaatgacaatgagctaccatctcattgtcagaatgcttattaaaaagtcaaaaaacaacagatgctgacaaggttgcagagaaaaaggaatgcttttacattgttggtgggtatgtaaattagttcaaacattgtggaagacagcgtggcgatttctcaaagacctagatgcagaaataccatttgactcagcaatcccattactgggtatatacccaaaggaatatatatcattccattataaagatacatgcacatgcatgttcactgcagcactattcacaatagcaaagacatggaatcaacctaaacgcccatcagtgatagactggataaagaaaatgtggtacatatataccatggaatactatgcagtcataaaaaagaacaagttcacgtcctttgtagggacatggatggagttggaagtcattatcctcagcaaactaatgcaggaacagaaaaccaaacaccacatgttctcacttataagtgggagctgaaggatgagaacacatggactcatggggggaacacactggggtctgtcagcaggggtgggaggagggagagcatcaggaagaatagctaatggacgctgggcttaatacctaggtgatgggatgatctgtgcagccaaccaccatggcacgtgtttacctatgtaacaaacctgcacatcctgcacatgtactcctgaacttaaaataaaagttgatgaaaaataaatactgaggtctacttagtcttttcaaataaacaggttactctttttttttcttttattataccttaagttctgggatacatatgcagaacgtgcaggtttgttacataggtatacacatgccatggtggtttgctgcatccatcaacccatcatctacattaggtatttctcctaatgctatccctcccctagcccccacctcccaacaggccccagtatgtgatgttcccctccctgtgtccatgtgttctcattgttcaacttccacttatgagtgagaatatgtggcgcttggttttctcttcttgtgttagtttgctgaaaatgatggtttccagcttcatccatgtccctgcaaaggacatgaactcatccttttttatggctgcatagtattcaatggtgtatatgtgccacattttctttatccagtctatcattgatgggcatctgggttggttccaagtctttgctattgtgaatagtgctcccataaacatacgtgtgcatgtgtatttatagtagaatgatttataatcctttggatatatacccagtaacaagatggctgggtcaaatggtatttctggttctagatccttgaggaattgccacattgccttccacaatggttgaactaatttacactcccaccaacagtgtaaaagcattcctatttctccatgtcctctccagcatctgttgtttcctgactttttaatgatcaccattctaactggcgtgagatggtatctcattgtggttttgatttgcatttctctaatgaccagtgatgatgagctttttttcatatgtttgttggccacataaatgtcttcttttgagaagtgtctgttcctatccttcgtccgctttttgatggagttgtttgttttttcttgtaaattttaaacagctattcttatctaaaaaaataaaaataaacactttttgaaaaacaaaaaagaatgtaatgagacacttaacatgatgttatcctagaaaaaaaaacctttaatataatttaatgagatattttatttgtgttggtgggttatacatgatcaaagtgacagatacaagaaggctgaacatcaaatccagaaagatcagttattttaaaatataactctttgactttgaaatgtactggtttttgataaggagaatcccattattaaaaaaacaagagtgtatacaaataatttagttaaatagaattctgctttataagatagttattgcataagttgatattatataaattattaatattttaatttaatatcacttgagtattgctaagaccataaaatcatttttatacctgagacgttgatgttttataccaaagtacttttaagaaatcagtgactattttgaaaacattgacatcaatcttaaggaagacaaaattagcaattatatttacatgtaacagaactgtctggtatgtaaaaggtaatgagttccatttctgtgactcatctacttgtggatcatgaaaagtttgaatccaagaacatcaaaagccctctaaaactagtataatcacactttttaaaagagatacatttctttccaatcaaacaagattactcaggtcattttcatccttctaattttataggtgaactcaataaatgtttatagatggttattatctatttagaacatgccataaaatgtgcacgtgcgcgcacacacacacacacacacactgtgactagcattaccctttaatgtgaatttacttagaatactttctattaacttctttagcaatgtacttgactaaagcaaaatatctattagtttcagttagaatataaaaagtagtttccccatgatactctctctgtttataagcaatatgtcagcaacctttgtgattagcaagttttaagtgaccaactgtaatgttccattgttatagagcaaataagggttataaactagcattaatgtatttgttttcaccagccatctccgaaatgaaggtcatttccctattcctactccttataattggataggaacaaaaccttaaatgacttgtgagaactcatttaaaactgtccccaaaaaacttggtgatatgtatgaaaaagtataaaaatattcatatcttggccattaacttttacatttgtaactaattctagtgaaataatacaaattgatgacaaaaatgtatatacaaagatgttcagcagagcaatatttataataggaaaaaaatagaaacaccctaaatgtccaaaaatgtgaggctactttaaaaaaactgtagtgcagccatatcatatataagtaaatagcagctttattaaaccatgcttacaaataaatagggaaattattaaaatatcatttaaaatggaaaagtgggattaaaccctgcatatatagtactagctccacttgttaatatatatatattcttcatatatatatatataatatatatacgtgtaaggatatatataaagaagatatattctttaatattacaaagtacaaagatgataaaaatctcccacaactttattgtactggaagtaaacgcaccaaaacattaatgtttatctcttggtaaaattatgagtgtttttattcttttttttaactttttttgacattccaatttttttgtgaacttcattagaaaaacaaatgagggtttttctttctttttttttttttttaaacagggtctcactatgttgcccaggctggtctttaactcctggacttaagcgatcctcctgccttggcctcccaaagtgctgggattatacacatgagccactgcacccagccttttttctttttaacatgaaactgtttagtgagtggctaagacggactttaatgaagtctccacagtcatctagtataaatttcacaccagatattagtgccgttaagactgccaaagttaactattaaggtatcatcagggatgcacatgttttgaattgtctttcgagtagcagatatcaacttgtacaacatgtacaaattgataaaaatatgtaaacttgtaaaaatatatacaaagtctattctcagagctactcccctccccacatccatctcacaaaaaagataagcagaacatatttaaattatctgaggaaaggtcggcatagtttttcacccaagtaacccttgggttctttgagtccctaggaaaagggacttgaatcttgtattaggaggcaagatgtaaggcaggcctaaaggggagttccctcacaaattgtgggttaatgacaaaaatttaaatctataccactgcataagtttcttcaagccctgctctaagaaaatccaatacatgaaatctcgacttacataataaaaaaagtcagagaatcattatgcatatcatcaaaggattattcaccttatgaaagacttcatcacagaattcctttaaatagctgcttttctcatacattttagtattttaaaggtagtttcccatttggcaaatgagatgccatgtgcctgaggcaagttagtgaaattctctaggcctcagtttcctcatctatgtaataaagatggttttaaccatgttacctgcctcattcagttttcacgattatcaaagaagataatttatataaaggtactctgaaaattatatatatatatatatatatatatatatattattactgctattcttgctaaaagagaatgtgggggaaactttcagaatacatactttttcacatcttaacaacacacatacctacttttcacatcttaacaactctttaaaggacaattttagatgacatatttatatataaaaatcaaatcttttattcttcattattcatttttcccacatatttttcattcttctgcagttactatatatcataatttccatggtattaatacctggattatgagaggctccagtagcttctccacggtgaatgtttggacctgcagatcctgaggatcgatattcaatgtgattggtgtttcagctgacatgctgcctgtgcacaaacacaaaaggatgcttattaataaagaaaactgttttctaaagaagaacacttatgaaatcatggaataggtaaaacttgtattcagcacctcttcctgatatcaaccatagccctcagaggaccaggctacaaaatctaccttcagagaaagaagatattccccaactgttccctgaggtcatgctgcctgggcttaggtcctgtaacaaattaatctacacaagtatgttcatgattaaattaacaactcatccggggtgggtttgtatttgatcagtagtcttaagtgatcagaaaggtaagacacatcttacagcattcaagtcctttggcttctgtgaaatcacagcactgaggcagcctatgcccatattttgcttcttcttgttaatgatgacttagacaaggaacaagtaaacctttgaaagacatgggaacaagtaaagatatgtccttacttgatttagagattgtttatttgagggttttgattggagaaggttaaaggcaatttaccttcttggacaggaaaagaaactaatacaaattgcacagttgttgtaaaaagagagaagcccctgagaaggcattgatatttggtcaagacaaaataagaagaaaaaaaagaattgcaagccattctctaaggcattaacgttatccttaaaaatcaattcagtgagatttttgcctaacaatatacatttataccaaatgaccatatgtggcatgtcatagtcggattaacgttcaaaaactctagccatattttcaaatagctataatatattatttattaatctactaaaaactacagtaagtgttaagaattttagatgaaacccactggcatcgttgattgcaaagagagagcacacttcctgaaatgtagcacatttctagatagttctctttctcttattgaaaataacccaaatggcctgcccagggccccatttgccccttcaaacctgccaagtgtgtccttgttcctagtctgtgcttaactctatcacaagccacttacagggtggctacaattcctttactttttgaaagattttgccttgaaaaaataattattcaaattctattaagtgaaaagatattacttgagtttcttctcaaatcaaagtttcaaattactgttattggcatatgatacatcaacatataaagtcaaagccctacaatttagccctgttttaccttgtttctctctcctttgcgttgatttcattctccttctaaaagtagaaacatggtctcttttctcagcgattcagctgcaatgtaagagacacgcttcaagaaaggctccaaacactattgccaaatggtttctctcaaatgcatttctagaactgaaatgttttagtttggtttggttttgattttgctttttcaatcatttcacctaccactttgattccttctaacacagggaaatctaaattgacagatagcctattcctgtggtgacctttctgcatagcccagagccaatctgtgcaataggatatgtccttcagtgtatagccttagggttctatcaaataagtgctcacaaaagaatttatttgttactcctctacgacaggtactatcctacataaaaatcaagtcaagatttctgccattgctttgttctttcatctgaaggacaaaagtagaggagactgttgtgaactaaaataaaatttggtgaaccttcgcagcctttaaaaacatgtcattttcaccgtgaaattcacgactggtttccaaagctacatggccaccagaaattgaaagtaaggaagataaaaaattaaggagagcaaaaattatccatatcatatgtaaatccttctagaagaatttttcaacctagaaggagctttctaaaaggagtgctttttagccaagagataaaagacaacctaatttagccaaagtatcttttaagtctgtgttcatgtctttaacacaaattaagtaaaagtttttcaaaagttcatttttccatggtaaaaattacttaaaaaaaataaatccttaaagaacttggcttcatataattattaatctttaaataaatgctatttcttatttttaaaaagtcttcctgctcttttgtatgtcctggtcagtattcctgactgattggaaattagggctatcataggcagaaaactgcataattttgcaaatgaaattgaagcaaagtcaaaatctgacaaatttgtagatatagcaataccacaacgcaaatccaaaacaaaaatcctactaggttgtaagtattacattctgaggcatttgcattttattttgttttatttttgagactgagttttgctcttgttgcccaggctggagtacaatggcctgatctcggctcaccacaacctccgcctcccaagttcaagtgattctcctgcctcagcctcccaagtagctgggattacaggcatgcacctccacgcctggctaattttgtatgtttagtagagacagggtttctccatgttggtcacgctggtcttgaactcctgacctcaggtgatccgcccgcctcaccctcccaaagtgctaggattacaggcgtgagccaccaccctggccggcatttgcattttgtaatctataaaatcttaggagttaggcagtacctcccaaacgattcaagaataccttctacacaaccttcatttcaccaacacactgggcttggatgaatagaaatgatgagaagcttactataccattagatgctcgttgagttgaaacctgccacttttaaacttttatccaaaagagatggcttaataaaggggaaaaagtacgctttataaataaagtaagaaaagtacagatttggagagagactataacaaaattccagttttcagaattaaaggaaggagaacaaatctcttgacagtggtgatagatgtctccagagaaagacaccaaggcagggcaaacccaaccatatggatccttcccttctccccaaactatctttgtctgcaatgactcaattttcttcattccactttattccctgctggaaactgaacttttatcattttatatcaattttaagttcatttggtttaacacacatttcatttctaaatgcagttaattctgagaggtcatggggtgcacacattcagtcacacattagtatgaactagctcattgcttgccatttgacaccctgtgcacgtctctattacagcacgaaccacgttgtgttttcatcgtgccctggcagcaaaggagagggatgatggaagatcagagagatgcacagagaggccagtggaaaactattcatttccaaaatttgcctaagggttgccattccctcacaaatattaaacagaaaacatttggcacctacttctcctccctacagtaacacataaccaccaccccctcccccactgcctccccactcttcaccacccactctagagctcaggctcctcttagtaaaactacaattcttttacataagttgtcatgttcttgtgggatggcttggaaacctaaccatctgtaatgtggttcctatagaaaattccctaatatcaaatatttaatttaaaaaaaaaaagattaacttttgtaacacaattagtttgtaaggtgatggctgattctcctttaagcttattaaattccatgacacagtcatcatacttacctaattagtctaactttatactcacttttcaactaaaatgtttaagtcttttttatttcaaagattattgcaaactcaagtctctcatcacatctttaaacaaatgatttttatttactcctaaatgcagaattttattttgtcttcctaacaccttatcctgtagaatatggacttttattcctgctagtcaaaaattggtttgggagaacccaacacattaacaccccctcccatttccctgtttatccattaatttgtccagtatgaattctagaattccctattaagtcattaaacaggtgaaggccagacataaaacctaattttgatactgttacaaatctctttccagatatgtaatgatcaattaataaacactttagacatgattttcaatattattaaacactgttgtgtgaaataatctacctttttcatttcgtcaaaaatatagatatatcatgaagaggcttttcccaatgttttaatgaaatagaaacaccctttctacaccttcctgtttaagagctcaaaaaatatatatttatagtttggcatgacttgttcgtgaagaattcatgctgactgctagtaattactgccctttatttacaaattaggtttttagttttcctacagattggcacctagatgtccagtctaattaaagagatcatctttttacctatgttgaaaataagaatatttgctcttctctatgtattagttcatggtgctataacaaatatatcatagactgggtggcttaaacgacaaacatttacttctcacagttctggaggctgggaagtcctagttcaaggtactggcccatctggtgtctggtgagggccagctttctggtctgcagatggctgccttctctctgtatcttcgcatggcagatagcagaacacatcatgtctcttcttataaggacactaatcctattgatgaggactatacactcatggcctaattagctcccaaaggctccaccattctaatatcatcaccctgggagttaggatttcaacacatggatttgcagtggcaggtggggaagatacaaacattcactccagagcactctgctttctggcaggtctaccatttctcagggattcccaagaaagtttctgttatcacatctaaagatcattttagggttcagggatatactccttttggatgtatgtacttcaactaatttaaagagactaggctatcttctttactttcatcatctagagtttcaattattgtttaattaattaaacattttattaggtaatacaaggtttaataatgtatatagtgaaaccaagtctctctctctctcatccctgtcttcctaccacctaatttccctcccagaggcaactactttgggcacttactcttatagttccagagatatcatacataataccagaacatatggatttatatatttaatacgaattataacatttttgtttttctactcaattcaattcccttaatctttgttccacccttgccaatttgacatcatagtttagatgtatcataagtcatctattaatcccttatcatgtgactaatgtagaggatctattccttcctgtttttgtttttcttaccttcagcatgtcctgccagacctagcaaatgagaagtgctttagccttcccaactttacttttcctagtttctgccattctcttttatttgccttcagtcaggtgtccctgtattaagctattcttgtattgctataagaaatacctgagattgggtaatttataaagaaaagatatttaattggctcatggttctgcaggctatacagaaagcatggtgctggcatctgctcagcttctagggaggcctcagggagcttttactcatggcagaaggcaaggtggggagcaagcatctcacatggtgagaacaggagcaagagagaaagagagagaggtgccacacacttttaaacagccagatctctcaagaactcactcactatcatgaggacaacaccaagaggctggtgctaagccatcatgagaaatccgcccccaaagtccaatcactccacaccagaccccacctccaacactgggaatcacaattctacatgaaacttgggtggggacaaatatccaaactacatatgtccctcttctcatctttaattcatattctttcaaatttgtacccctacacagatacattggagtttggggttgtttatgttgttgttcaacaactatttatggaggacttaaacacatcagccacaatcttaggttccagtgaaagaaaatgtagtaaagcccaggccctaccaactatgcatcttctttcttcatgtttaatttatcacattccttttatgtcatatatagtcccttggaatcatatttcgtgttaatctgaaattgttgaaatttacttctcttaaagtctaggaggcatgtctaacattatcttatttgggattatcacccaaataaatggccactttctctataaccctgggcaaaagcttccccaccccctatcctcatgctttggaagtgtccatggggccaagatgatgcacccacccagagcccacatctattctatcctatcctacccagggtagccagtgtctcaactccctgctcaacgagtgcaaacccacttccagtgcctatgttggcctcttcgtggaatccatccttccaagactgaaccattcaatgtgcccaaccctatacctgagaggtagccaaaaggcagctgtttgccaatgagtgcagattgagtttgggtgtacaggctgggctgtcaacttgcaggcactcaaggcccctcaagtgcaagacagccagaagtgggaagagaagagaacaggccatgtgtcagggacacagaggtgagctccacctccaccacctccttctaaaaggaacccaaggattctaaaaccaatcttgccttctgggttatttgaaggtatatttctcaaagtagaaagattggcgagtagagcctactttagcagcctattacatagaattgtaacttatacacataggcatatggtgtgcaggcctccgtctgtaccctcacacttcccaatacaaacgttaaagataggcctgcccagactttctagcactccatatcaccaagtggtcagatttgcttctttcattgtttcctcaatatgccaagatatataattgccaaagagttaaggtgaaaagtcatgttattccacttttttttttttttggaggcagggtcactctgttgcccaagctggagtgccagtggcgtgatcacagctcaccactgcaacctccacctcccaggcccaagcaatcctcccactcagcctctcaagtagctgggaccacaggcgcgcaccaccacacctggctgttattccacttctaagagaaggtttcttaaaatttttagaatgtgtcatctgttactgtaatagttttttaaatctggaccagtaaagttactgaagtattaagctgtgtgacaatatctcttctcttacttctctttcctccatccaaatgctctctgttattattctttccttaagcttctgatttccatgcaagagtgtgcattcactatatgtgtatttctctacctcttttattaaaattattttgtgaacattcaaaattccattcatgagtaaataattaaaggttaaatagtcgaaaacacagaaataaaaaacattcatgatttattagtatatctgtgattatatttaatttgtgttctcccaggtaactattcttatttattatcgaccttctcccatgttttctcctgataagtactatacatcatctctattaacatggttctttctatgccctgattattgtcataacactaacacatacacacaggtgtgcacattcatatatgtttgatggttttatctggaaataagtgtctcttcctcaagtttaaactattctgatcatgtcaacaagtcttccaccaaaagtatctttgggcttcatggattcacagtggatctcatttagtgaaactctatttagttaaatataaaagagaaatatttgtattaatagtaggtgccaatccccaccatcatcacaaatgttaacctttgcctaatacctgtctcccaaaatatcagaagaaaggatcagcaactagtgaaagactgtcaagtactgaaataatgttataaaagagtattttaaaaattttcattaagaatttatcttgaggtcgcgtgcggtggctcatgcctgtaatcccagcactttgggaggcagaggccagccttccactacaatctcctgaggtcaggagttcaggaccagcctggccaacatggtgaaaccccatctctactaaaaatacaaaaattagacaggcatggtggcatgtgcctgtaatcccagctactcaggaggctgagacaggagaattgctggaacctaggaggcagaggctgcagtgagccaagattagaagatcgtgaaacagagcgagactccgtctcaaaaaaaaaaaaaaaaaaaatttatcttgaatgcataactgaactttataagcctcgctctcccccatcaccatgcctcagaaaaattagtataatatagtcaggaataatgtgaaggattgaaaccagatgttaactgaaaaaaaaaatctaaatcatcacaagaagatttaagtaaaggaaaaggaggcaagggaagtttgccatacaatattatcatagctgattttatacaattgagtcttggctagagtgaaataaaatggaaagaagacaactgtaatataaaacttccactacaatttctatacacactggttttccaagccccacctccatgtttccagtgcaataatttgctggtatgtttggcctaccaagaaagaaatacatacaccttctactctcttggtaaacaaaaggatctgaggtttgtcagatcaataaaatcaagaaactgcctgatatcgtaagtgatgaaggaatagttgggtctcattcttttcaaatgctcttcctggactttacaaatatttttgatgtgtttacatagagggcaataatctatataaactctcccacctagctttttggtaggctataagagcaaaatgatgtgagatcagacgtatccctagactatagggcatcattcatttattcattctttcaacttatatttactgactatctactctgtgccaatcacgaggagagtgtgaccataaacaataaagataataaatagtaaatgatttcgtatattagaaaataacatatgccattttaaaaaagaaaaagcagaatagagtaggcagggctgggtgatagggaagttcagagcagatttcagtattaaataaggtcaagactagcctcattgagaaggggacatctgagcaagactcgaagaggcaagaaaattagccaagcagacagccgggggaagagcactgcaggcagaagtaacatcacaacagaagcctaaggcagaaaagcagtggcagaacagcaaggaggccagtgtaagcagggcagagtgagctacaaagagcatagtaagagagaaagtcagaaaggtatggaggctgcagatcataagaactattgcagatgtttgagcactaaaacatcaactgttttatttagaggaatcactctggtgaatagaacgaagtacgaagggcaaaagaaaaaatagggacagccattgggagttcccatagtaacctagatgagataaaataatggcttagaactggttggtggtagcagaagtggacacagggttcagattgtagatatagtttgacaattgagacaacaggaattcatgaaagattaaacataggctagagagaactcaagatatctttaagtttttcgatctggagcaactggaaggatagagttgccattaactgaggtgggaatggctgcaagaggagcaggaagaagaagagtccagctggggacatgataaatttgaggtgcatattaacatcaaagtgaagatgtaaagtaggcagttagatatacaagagcagggtttgaaagagaaatctgaaatgaaaatataacttttggagttgtcagcataaaggtagatacaatgagactaccaaggaagcatgtagactagaaagaggtaggttgaagtccactattgcaagtgaatggaaatacaggcagtgatattcagagtatgactgtagaattgagatttgccttcaggtgaattaaaaaaatatgccccttctggacagatggattagaaaactgaccaggcacggtggctcacacctgtaattccagcactttgagaggccaaggcaggtggatcacctgaggtcaggagttcgagaccagcctggccaacatagtgaaatcctgtctctaataaaaatttaaaatattagccgggaattgtggtgggcgcctgtaatcccagctactcgggaggctgaggcaggagaatcacttgaacctgggaggcggaggttgcagtgagctgagatcacgccattgcactccagcctgggcaacaacagtgaaattccatctcaaaaaaaaaaaaaaaaaaaaaagacaagacaagaaaaaaaagaaaactgtgccactctctgagtagacacagccctgcaagtgttagcagaaaggcccacagtttgcccagcagagggagggctagatttcatctccactcagacccttagcagggtaatatgcagcagcccatgtgagacatcctttcgcttcaccctgcaacccccaccgtctgctaaagagttcttaaattctcttacctctcaccactattgggcctcagtgattatcagcatcagctttaaagttggactgcctgggtgagaatccaggctctgttccctgctcgctggtgactttagataaattactgatctttcctgaacatcagtttcctaatccataaaatgagaataataagagtacctacctcaaaaggatcttaaagattacctaagaaaatctatataaaatccattaacttagccaatatctctgacacctggcaggggctcaacaaacattagttgatatcattatccccttttaagtgaaagaacagaatctacttgtctacattcagattaaacctctccctcatctatagacctcataattattattcaagagtgctttcattgattgttttcataacaaaagactttaaaacaaagcttccctccggtggcctcattttattggatttcttgacttcaaaatcaataaggcatatttcctacatgtgcactaattagaaatgcaacatgcctaaagtactgtcttaaaaaaaacaaacaaacacattcctaatgcacaacagcctcctaaaggatcttgagccctttgaaatcaattccagagtggtacataaaaggtatgccccagggttagggctacaactgttagatgcactaagtgtggggaactccaagagtctgtactttttatttccttagcatccaaaatctctgaatttcaacagaacaaaacaatattacattttagaacaaaaggtaaatatcattagcatgttgtaattcaaactttataagcttgagtatttgaagttctctttattaaacctttagatagccatcttattgatgtttttgaaaaatgatcaaattgagcctcccccaaaaatgatgagttttatgaattctttatgaaaagattcaaacaaaattaattaaattaaaaaatgtgtttactctagccagagcaaccaaaattaaacatgtttcctcacacatacaaccaaaatgaaagcagcaaaaaaggtaaaaaaaaaaattactttaaccaatatgaaatatgaaaacaaaggaaaacaacagattctacttatatttaggtcttacaatgtccttctgatcatgaatagctggtcaaatctaatctccctcttaaaaaaagcaaaaagtcataattcaatttctgacttacctgaaaagtaatattgtacatgagaattccacaagatgactttatgaccctgacaacataccatttagttattttataacatgtcagttcatactaaaagctcaccacaatggcacacattttcaaaattgcagctacagagaaagaacagaaatgccccatggtcagttactctatgtagcaatgccttctacttaaggacattttgtaccatataaaaagtatgccaaaatggagacccatcttatataagcccagcatgaaggttacctacatattttttaaaagccatagaactaaattagtcaaattgaagtcaaagaagaagctaatctaatatatgagacaacagaaaagctttcactgaatcaccagaacaagaataaccttcagctacaaggcatcaactttaagcaaccacggcagaagtaatgtgcccttcacatacactttgaaagtgacagaggcttctgttgctgcaagtccagtgagcctatgggtccatcccattccataatattgtaaaacagctcaactgtatatgaattctcgtaaggtctgatatttttaaaaagcagagaacaaaaagagaatggcaaaggtagtagaattctcatcaacctcaatgtgaagccaaaaaattcccatttcttctttgttctctgttcagctagaaataaataaaagcctgcttatcagaataaataaaatgaaaccaaagtccttgaaaaacactatattcatttttctgtaaatcaataaatacacttaggaaaacaaatagtatgtaactggggaatttcagcttcttctgtgtctcctagttttccattctgtcataatccttgaagagaattttaaaaagtctctgctagaatctttaaatctaaccatccaagttcattatttatcaatattttcttaaagtttctccaggaacactagctaaatacctattaaccctacttaactgtttcttattacacatgttaaatatcctctctataggaaatagatgacttttctcccctggcttcaaaacaccaccctcctgcttctccccaacaatttagaattcaagaaacaaatggaagcaagcaacaaaacattagtaacattagaagtatcccatacacatggactgagaacacatttggggacatggtgggcagactagcaatttgctgtggaattacacagcaaaaaaagaaaagatggaaaagccacaaacactcatcttcactcatctttcatagcaagagattaatagatactatttgaggttgaatgcaatttctcattcatggaaaaatatgtaaacttaaccatgtaaaaagcctcccaacctcattcataataagagaaatgcgaattaagtccgggcgcagtggctcatgactgtaatcccaacactttgggaggccgaggcggtggatcatgaggtcaggagatcgagaccatcctggctaacacagtgaaaccccatctctactaaaaatacaaaatattagccaggcatggtggtgggtgcctgtagtcccagctattcgagaggctgagacaggagaatggcttgaacccgggaggcagagcttgcagtgagccaagatcgcgccactgcactccagcctgggcgacagagcaagactccgtctcaaaaaaaaaaaaaaagagaaatgcaaattaaaatacattgagatattctttctcacctttcagattggcaaataccaaaatttttataacaaactgttagtaaggctgcagagaaacaaatactcttataccttgcttgtggatatttaaaacattatccctatggagggcaaatatgcaatacatgtatatgtatatgtatgtatttaaactttgacccagcaattcagtttttaggactctaccacaaatataaaaataaaaagtgatgtattcccaaggcaattaattgcagcaattttactaaaacaaaaaaaaaagagagagagagaaaaggaaggaagaaagagaaaaaggagggagggagggagggaagaaagaaggaaggaaggaagggaagaaagtcaggaagttaggcagggaggaagggaggcagggagggaatgttggccctttcttcacatcacatacaaaaacttacttgaaatggatcacagagctaaaggtaggacctaaagctattaaacttctagaagaaaacataggaaaaaaatcattgtaaccttggcaaagtcttcttagatgcaacaccaaaagcatgatccataaacgaaaaagttgataaactggacttcatgaaaattcaaacttcgtgaaaatacaaaccatagacggggacaaagtattttgaaaatctacatatgacaaaggtcttgtatccaggaaataaaaagaacccttagaactcaataattaaatgaaaaacaactcaactctttaaatgggcaaaaaaaaaattgaaaagacatcttaccaaagaaaatatatacatggcaaataagcacatgaaaaatgttcaacatcattagtcactagagaaatgcaaattaaagccaaaatatgtactcctccacacatgctagaatggctaaaatttgaaagattataaatactggagctagcaaagatgagaaacaactggaaatctcacacattgctagcaaaaacgtaaactggtacagccactttagagaaaagcttggaagtgtcttataaagttaaacatatacccactctatagctcagcaattccactccttaggtatttagccaagagaaataaacacttatgtccatatagatacctgtatgcaaacattcatggtggccttactcataagacagtcatccccccaatccttgggggatatgttccaagacccccagtggatacttgaaacctgggatagtaccaaaccctatatatactatgctttttcctattcaacacacatataataaagtttataaattaggcacagtaagagattaacaacaataacataataaaatagaatgattttagcaatatattgcaataaaagttatgtgaatgtgctcactcattctctctcgcaaaatatcttattttgtgtcatatttttgaaccatgggtagctgaaactgctaaaagtgaaaccatggataagaggggactactgtagtcagaaactagaaacaactcaaattttcatctacaagtgaatggataaacaatctgtggcacaagaataccatcacatgttatgcaagaagaaagaatgaaccaagtatacatgcaatgacatgaacgaatatcaaaagcgttttgctgagtgagaatcagacataaataagtacacactatatgattccatttatataacatttttgaaaggacaaaaatacagggacaaaaaacagattggtagttgccagatgccaacagttgatgtaatcagttgactgcagaagggcacaaagaaactttttagcatgttggggatattctatttgattgtggcggtgatggttctataactgtatatggttgtcagaactcatcaaactgtaaactttaaaggagtgaatttaatatggtatatataagttatttctcggtaaatttgacttttaaaaacatcttttgtgttcatctcttatcccagtggcacagaaatatttctacattatttcattcactatataattacaagtttccactgatatcctttggctccaggagctcttccttaagttctctgaattaatactttcaaaagttgattcactttttcgaagtgtcttggcccttcttgtacatctgtcaatttacagtatttggtgcctaaaccctacctaacttcttaatagtattcattcccaggcttcacacctgtgtgttcaggttattctcaatatcatcctgtgcatctgatcagttatgtgttatatatttgatttataatttttctggcaagaactctaagtcaacctatctatgtgtttacaaaactacaaaaacaagagctttcagtatttgtttttgtactgctttaaaaaaaaatttctttttatttttctttgtgtgtgtgtgtgtgtgttaaagctagctgaggttttattttggaccaaaaaaaaaagcaattgaattgttttgtagctggaggcatgggcaagtgcggtccccagtcagtaaactctcccgtgggtgggctgaggggctagggctgagcctcaggtgggtctcctcttccctgtgctcctctgcacaacggcctccctcccaggatctggggcagccgcaggaggggcaggctgggaggggctgccgcagctgttgacttgggcaggacgtcagaggactcggacaccagcttcccatcgcgggtctcggtcttcttcacaaccacagccctggtgaatcatttcttattgaccttacttttaacaacgaataaaaaagagccaaatgactgtccctggctcatcatgttaatatcagaagacaacactgaaaatccttcgcaaattttaactactaccctcttgtcttttttcaattctgctctctgacagcagcgagtttctaagctagttcacttagacaagcccagtttagtgagtacaaggcccagagtccagaatcttcaacatagtaggtgtcctgcgagtatgtgaagatgaaagtacattataaagtcctgtctctggtttccttctttctacccaacaactttttttacaagttagatcaatccagttaattttgaccttactgaagttgaaattcaagttaaatttactgctagattaaaagtgtgaaaagaaggaaagtagctaatcccatttacaacaatttattttttaaaattgtaggactagtattcatacatttatacaaaattgctaaatatattttattttaaacattgtcttgatcatgtctgttctattatgtagatattttatcttatttagatcactctggtgtttccaaaaaactaagcttctttaatctctcttctgaactaaccaaatttttttctgaacatttggggccacatttactttcacataagttagtgtgtgggttaaaagggcagcatttcttcactatttttcaccaaaacacgagtgacatttaaagcatatttaatatttataatctaatatactctcctcattccagactgccaccaaggtaagagaaggcaactggtttgtatgaaactccaccataagatttctgaaaccctatattttctctctcatctatccataatacaccagagttatcattgagaattgctgcatttattttattgttttttttcttactcctggctctgttttatatcccacacttgttttctttcttctttcactccacatttaatttatcctatcttgaatttcatgtagccttataagtcaccttaaatcctttctagaacaagacaaggaataaataaagagtcattctaggtatctgaaaaagcaatcttttctcatttaccttagataaagccttacaactttaacttcttgctgcctcttagctatgctctaccgtattgaatacacaagtatcaaaaatcatgagtttctccttttttgctttaccaattctctgtttaaaaatatttaagtctgcgcacaaaaactacagggaaaaatccatgcacaatttaagtttaaaagcccataacttttaattaaaagcaattaaattatttgcacaaataacctactcgctgtacaatttttgtgtctaaagtatgtaaagtttctagtgccttgcatacagttactcaatcattatagtaatagctcagttacagagtaggagtttttaaatgagctgatgtaagactactatagcttgggtattggcacatgagaatctgttttagtgctatttttaaaaccactaataaacagcagactcgagcctctgctcaattgaatctgcctgagttgtgaaagaaaaaatgtgtaagagaaccacatttttatctaaatctgaaatgcctgctaatatactcggaaaagtagacatttaaaattggagctttcataaaatagtctagagtttagtgttactaaaacgaaaattagttataaaagtaaaaattgcacaacataatagtttctattcatcccattttatagaaataatgtcctttcatttcccccaaagttatctaaccgagcaacagataatctataattactaggatttgccttatagcaaagtttgatttttaaaagtttgacactccactcacctactgcaggacagagtattgcccatatacagatactaaaccaattgtctaagcaatttcttgtatttagaaattcagtgccactatcatggctcacaatttggcttatgatgcatctgtaagcaaacagcctgacaagcaccctagtgtatttcaggatgactgacaggacacagtggcccaagcaagaaggggggatgggtgctcttaaagcaacatgccagtgaagggtaacatcaaacagcagaatcagacctgaaattctatttttcagatttacaatgaaataataatacattacccactatcaacttctaaatacaacttgcatggtcattatgtacccaaaacactgtaaatcccaaagtagaatttttgagaatttgtaaaagtagaaagaaaaaatataaaacaggcatgttatatgatacttccctgaagcgatcaagctttcaggttacttaagaatatgcctgttatttttaacagaaattaaatcaggctatccacagaaaagccattctttcttttccttataatatcaacttttattttagattcaggaagtacttgtacaggtttgttatatgggtatactacatgatgctgacatttagggtataattgatcccgttacccaggtagtgtccagtggtggggtgagaaaagcagttcttatctcaccttcatatatttgtcaatagctcttacaacagtaatttaggaataactaatgaaggtaatttaaatatcttgaattaatctgaattgttattgaggataggggccagagattcacgtattttccccctactgcattccttccctatgacctacttcatgattaaaatatagaccaaaagattcagaaattctacttatagatatttctacattaatttcactttagaaaacattttagtaacatattggcttcattcttcacatttacaattttttcctatattatttcacaatactctgcactgctcaatccttttataatagagcaatcatccatattttaaaaacaaacaaacaaaaaagccaagtcactcatttttaaacacaattcctcatttagccagcagagggtattattagattctgaaagcccacatattgcacccaatgacatgtatttttatacttcagctaggaactgggacacatcatctcaactttccttagtaaatgtgcttagaaatatcccattttattttgcccatataaatttgacttttagagcccagattaatgcttctcatctgtatcacactaccattatttcctcctctatctgctccaacagctgcatcctctgaaaaaaagcactagaagaccaagaagtggcagaattaccaagaagaagcagaattgggttcaatcatcagaaagacttcccacaatcctaaatttttctgggacaaacaaatgaacaacaatcttacataaagattctaagctccattagaaaatcgaaaacaaatcctgaagaaaacagaactaaattacaggataaaatctctcttcaaaattatatgacatttgtaacctctttaactccctgtttaatatttgctaaattttcattatatattagaagccacagactaattttaaagatatacttcctgttattacagcattaatatatttctcataaacatgcggtattatgactaacaaagttcccttacaatttataggttctttatttcacaacttaacactcacttagtgtggaaagacatggacagcaatttgcctgatttattctaaaaataaaaattttactatctaattagctaaaatcattaacttccacaaatttatcttggctgaagataaaaaattttctgtttctttgatgcaattatatcacaaacatcaagttaactaagttaactatggcaaaagtgaaaaagcaatttcaaagagcaatctctttttcctgctctcagatttgccactaatggcacatcctctatgctaaagtactaaattttccaaagagaaaataaatgttaattctcttcctcaattgtcattcaaaataaaaaattataggttattttcctttaaaggggaattctatttctaataataaaaacaagcattgggttcttcattgaaagaaactgctctataagatcgtctctcatactcaaatgtggcagtttctttcctcatgtaataactaacaatagccaggtaaatatcatattttacatttggaaataaaataggatacctcttaattatattcttttatgaaattttatatcttcaattttctaaacagatacattcgctgtaatataaaatagatacctgggcttttttctcaaattaacttataggataacccactattcagaataaaactgaaaagtcagttttgccagtaatttgcttatcctttttgccaatcatccacacattttggaatatgtatataaataattttgttattgttgttgtttctagttacccacttaattctactttacttttcagctctgagtttggtacctgacacaggctctcctgaactatgtctcactcaatggtttttggttttcgcaggtgccttaagaacctacatctaaaggccttattagcctcaattctatttgtagattaaaaaaaattaaggataacgcttaggggtagggagagattgaataagcagtgaatagatactacttacttaaaatactcctttttacttttagcaaaaatgcctccatacactatatgctgtatctgaattttcaatatattttatataggcaatagtccccccttatagacaaggtatgtgttccaagacccatagtgaattcctgaaaccacagatagttctgaaccctatatatgtttttcctatacctgcaaactatgataaagtttaatttataagttaggcaagaaattaacaataataattataaaatagagcaattataacaatatgcttgcatcagaactcttgcgctttggggctaggccacgacagtccatttgaaaatctagatggcctctaggagtgactaatgggcaggcagcatatacagcaggacatgctggacaaaaagatgattcgtgtcctgattgagacataacaggataacacaagatctcattgtgctactcagaatggcacacacttaaaacttgtggattggttatttctggaatttccatttcatattttcagaccagggttgaccttgagtatctaaaaccacagaaaatgcaaccacagataaggggcctactgtgtttcttttttttttttttttttttttttgagacggagtctcacactgtcacccgggctggagtgcaatggcgtgatctcggcttactgcaacctccgcctccccggttcaagtgaatctcctacctcagcctcccgagcagctgggattacaggcactcgccaccatgcccggctaattttttgtatttttagtagagatggggtttcactatgttggccaggctagtctcgaactcctgaccttgtgatctgcccgcctcggcctcccaaagggcctattgtatttcatttatcttcaaaacaacttattattcccctaaattacagcagtgggctcttagcaggtaatattcacaccaattgacaggtatagtgcaagctcggactctgacataggttaggtatgctaagtttgaggtgcagtggcatatgcaaatagttatgtcccatgagcaactggaaatgcagaatccatgaactttggagaaaaattatgcctagagatacagatatagtaacctgtccatccatgttacactctaatccataagagtagatgagctctcccaagattaactatagaaggaatgaggcagccacattacaaaacaagtacagtgaagaatatgatgagaagaaatgtcataataagaatagtaagaaatgcaaaacaaactgggttcaaattcaaactcactttaccctctttggcctcatccacaatgaccccaatttaccctgttttcctgatgtgaaatgagacctataaaacttctatgaagagtaattacttataaaattacacatagaatataatggaatgctaattaccatgccaaataattcatttatcaattattgttattttgtggaaagatacttttctctttgtgaaattctgcttttcaaaaccaaaatgccattgaattttagagggctgctgtgaaacacatcaaacagattgcccctttgatttttaaatggatagagaatgattatgtccacacagctttatttagcaaattgaatccatgccatcaatggaagtcttctactccatccacgttaataatttataattggatagcaagaaaacctggtactgaaatggaaatatgtttagagcttcttccaaagttgcaacatgcttaataaattaaagggacactaacacatattaataaactgagtattttttggaagagtgggtatagaatggttaaagatagaataccgaactaaacacaaacaaatgacactaagaaaaaatagaaacctctgtgtcttgttcccacataagacttgtggagttgtgccaacctgcttcattccagagcagagagccactcagtcactgaggctatattagaaagagaggaaggaaatccttttctcccacactctctgtttccaaagataataacagaaaactagagagtgatggatttcactactaagcagccatgtctattttactcatgtctttcattgactctctaagtctagttctactgattttgcataatagaacaaaagaaatatatgtacaaaaacaaaatcaattttgcaaaacttgtaatatccctaaattttccaaaatataactgctatagtcactaaattaaaactataacatcattcctattaggtcatcaattgtattcaaaagaatgaagcttatcacagagaaaggtaaaataattaaattcagtcatagagccaatgaatcacacttcttttacttcaaatgataaccctgccaaatcaaacagtctgagtaacccacacacacacatcccaagccaatccacttttatccccctgggtcttgggtgcacagaattagactgacacaatcaatcatggtcctaactggtggactagtctatgaaaagcctgttttattttttgttttcatagtctatattccctgttctcagttccattcccctctctgcttcttatggtagttaatgggtacatttccaattaaacttccgtaactttttttacatatgctatatacgtctacaagaatatataactttatgtgtatggatgtttaaatttacacaaataatattgtatttcccatctctttctacttctatctctctgtgtctgtttcattgtgtggttttgtttttttgtttgtttgtttgttttttggtctatctatgttggactataaagatgtggtaaacattgcatgtttgctcactcagcacatagtcccaaccttattctcccttatctttctctgctatggaggcaggacatttgatttcccagccttctttgcaactcagaatggcatgtgaaagaattctggccaatgagacggtaaagcttttgctttccctatcaaaaggacatcagcatccttgcc

SEQ ID NO: 342 - DNA, 91851 bp, Homo sapiens
ccagagacagacagcatgatggaaagaaagattcagacagaaacacagagtccacaggagggcaggcggttctcagcaggagagcttgcagctgatccaggaaacagaagggcaggaatcggatctcagaggcagaaaagcagccagagatcccagagtcccctgggtccaagccctccataaagccaaaccccacatccactcaacctccaagacccttcccatcccgacccaacccagtcctaccgccaccagctgcttctggggtaaggcagcctgctgtggctgcctggggctggggccaggcactactgtcctgtggtctgaccctctaccccgcttcagggcccatttatctccctcagccccctggggtgggagctggtacatgcttcctggcatgaggcagccccccacctatgactcatccctcccgggggtgtccttagcccccaccctatctactcttttccggggacaagttggggactgagaatcacaagacagtgaccaggactgggcagagggactctgtacccatgcagaataataccaaccccccaaggaaaaccttcccccttgaaaccccccatcttcccaaacagtcacaacaggagccttttaaaacagcagctttaatgccccccagaatcagcaccatgtcatcacaggcttgggtcaaggggcgggtcagacgccagtcacatccgctcactgcccacagccacccccccacagtgagtcatctgccagggtggcaggagccacaatgggggtttgtccacaggggggaaggctagacccacgggaccaagtcactgaaataacggacgtgcacacgcacgctcacgtgcacacaagcctctagcaccaaggggagggacagtggggttctgctgagaccccgactcctccaggggatgctgaatctcagctcattatctgggcctcagtcctgggcagtacctggtgaggacaggttggaaacggtcgtcagccatctgaccttccccggagacgctcaggcagaggcaccgccaaggggagggagcggaggctacaacaggaagtgggggctctgacctcagaggggtccatacttaggtctttaaaggagggaacatggaaggggaccctactgggggctccacggctggggctctatattcagctctttggtctgggcgtctgccccaggtcccctactgcgagggagcgtctcctccaggaccctgacctggaaccctggcccaaggactcctcccccagaacccgatccaggcaggctcagtgcccagttccccacggtgggggctcagcccatacctgtcccctggctctggaccacccggggtgggcagcggcgctcgcaggcctcacgggtcccaaaacggttggcattccctccacagccaccatagacaaaagggtgacaggcctctgtgctgcctgtcacagcccgatggtaccagcgcagggtgtaggcagtgcaggagccctcatccagtggcagggaacaggggtctgggccaatggggtcaagtcagcagggtttgtgggaatcagagagggttgaaaggtcagggggaggtcagcagggctcagccctgcctgcccctccccagaccccgctggcagccccccattctcaccatcactatcccaaggagcttcagggtcctggtactcctccacagaatactcggagtattcagagtactcatcatcctcagggggtacccgctctgcaggtagggcagggtgtgctgggagcagtggctgctggccccggggcaaggtgggcagcactgatttccactgtgtgcacacagtgcccatgcgtgtgccctgcatgcagaccctacgtgcttggcgtgtgccctgcattcatggacacccatgtgcgtgtctcggccccacccatagctgccccacgggttcagctgtcctcaccttcctcctctgcatgagagacgcggagcacaggcacagcatggagctgggagccggcagtgtctgcagcataactagggaggggtcctggagccaagagcaggggcctcagggccctgaagtcaccatgggcagccatcccagccaacccccctgagaggaccccagttgataggcagggcagggcctggggtgaagaaagttctgggagtagaaaactactcacgtgatccagatgcgatgaactggccctggcaggctagagggggcagagagggatagagagacaatgacagagagaaggatgggaagatggagagacagacagagacacacaggcagaggggtagagatacacaaagagatagcaggagagggtaacaggagagagaggaagagagagggtgggaggtagatagagagatggaaaaagagaagaaggcagaggagagggaagttgggaacaggccaacaaaaggcaagagacagaagcaggccagacacagaaacaggcaggtggtgcagacagagacgggaagagacagcttcactctgatgcccctcccaccgggtccaggtcaggcccaaggggaccagctctgctcccaccatcatcccactccccacacagccaagctggacatctgagagcactgcatggcaatcctcatctgcctgtgtgtctccctccactggggacacatgtcatgtgtcagtcctgcagcacatgtgtccttctgtgtatccatccatccccccatcttcttgactgcttgccctgtaagttctaggggcctgcctgcccttgcctagggtgctggggtggagtgggagactgcgggctgggcaccactcaccacagtgctgactcatctcttggcgcacaaagccccggatgtcatcctcctgggagcagaagaccacagggaccataaagaacccatggcccacaggaaggacatagggcacataatacagggactatggtgagactgcatggagccagggcccaggggtcagggtgctgggtgagggaggtagggccccagcccacccaggcccacccaggccctcccaggcccatccaggcccacactcaccgtcagtgcagcttctcccttctcgcctcgaggaccggcaggccctggccgcccctatgtgcaacagatgggaccaggctgtgacctctgacctcagggacaacagaagtcaccccgatctctgacccaagccttggaatccctactcacctgctcccctctctcgccaggagctccagggaccccaggagcccccaccactctctctccggggggacctcgctcaccctgtcagacacagggaccaagtgagcagggtcagaggcagtggggatcagagtcaggcaggttgggggccacagcttcagaggttggggcaggcaggctggaagatggttatgaggttggaagggtagggaaggttcagggatcaggagtcagagctggggccccttaccttctggccctgaagtccttcggggcctctgggaccaacactgccaggtggccctgggggaccagcagagccatcatttccactggggcctgggaagcccccaattcctggggttccctggggagatataggacagagtcagtaatcagaggccccagagatggaccctctcccaaagtgcacgctcccctcaattcaccatgaccatggcttcaactcacccgctcccctttctcgccctggtcacccttggggcctggctgcccgtcaaagcctcggtcaccctgggaacagaagaagcatgagagaccttctgccctgacctccctcagctctggaacctccctgaactcccatgagctccctggcctaatgcccaaaccttctgtaacccaagcacctgtgagccaaccagatgtgatccccatgactccaactccactatagccccctgccctgatgcacatgccccctccacctcccatgctttcatcctaactccactgtgaccccaacccaccttgacacctcgagaccagccccacttcagcccccaaagtcccaaccctctacagccttccttgtccctacacccccatgacccgaccatgagcttccctgccccatcctgactccctgtcatgtccactgtccacagaccctgtaccttgggaccgatcaggccctccttgccaggggcccccgactggcccggcacaccaggctccccctggagaaaaaaagacatgaacttggcccccgtccacccgtggccccctcattctgagcgtgcccacactcaccatctctcctttgtgtcctgccagcccggggcggcctgggggaccagcttctccctgcaggcatcaggcagtggggtgagccttaggccccaggccacgtagccccccagcccccatcccctctgtaccttgtctcccttctctccatcaaggccacaggctcccttcactccccgttcaccctgagggagaaaagcagatgaagaagtgattcccagacacctcactctgtgacccccttcaccctgaaactaactctccaaacaggcctcagctactccaacctctgacccagtgccctaatatctgaccccaggtccctcgcccttcaacattaggccttcctgaccagaaaaaaaccaatcttgtttctttcctaccttgaggccccggggacccatgaagccaacatctcctttttctcctcggataccaggcactccatcctttcctggggatccctagcagggagagggtccatgtgaggtcagaggaggtcagtgagggaccaaagagaatcgccctggatagtgggtagggaacaccatggggtgggagtcacctctggaggccagagccactggggcttgccatggggacaagggtcaccataggcaggggacaccatcataggcggctactgtggaggtgggggaccctgggtgacatgaggacaccatgagagcactgggtcactataaggtcaaaagctaccacactggtgggaccaccatggtgacgggggccctctggggacagggggcccctgtgggagcaggggcatcttaccgggtcaccagggatccctgctgcaccaggttgaccctgtgagaaacacagatgggggagcccttcagtgggactgtccccaacactggcccatccgctgcatgtgtggccactcagatgctcagcggccagggcccaggccacacacagatcccgggtgaacacacatggggccggcagcaagggagccagaacccccagcacttaagaggacccccaggatatgtgtgtgtgtgatgctggctctggacctgggcctgggcctgggcctggggcagaacttgcctggggtcccaggagtccacgcagtcctggcaacccggctgagcccttgtcaccaggctctcccttgctgccctgtgggagtgaccaggagagggattcagtcaggaccagatcaggctgggggcttagaatacaacgagcccgccagctggggcagagctcaagtcactcccgaacggccctagcagcacgtcctcccagcctgtgccatagcgggtggaactgggggctgtagtccacagactggctcatttctcaccccaaggactccagacccttgccccgccctcttatcactgggttcctcatcccatctgaagcaccttcagatggggacacccaaggagcccctttcctgtccctatagggccccttcatagggccagtccacagagctctcctaacctcacaccaaggccttgagccctccctagagcccctcctctcggccactccatagtcagccacagaaccccttccccctaaaccccagaaagcctcctcctgtcctcccctcctgccctcacagatgctgtggaaccaccacagccacaggaccccacagagagtacaccaccctcttccctgtaccttgtcaccagggtccccattgtctccccgaggtcctttgtcaccatccaagccccgaggccctcgttcaccctgggttggtttgggtaagaagtcacggtaaggggctgaaggtccctcaccctctgggagtttgagctctcagatgccctgggccagccccacggggtccctctcgcacccaggggagacccagtccacacgtgggcccactcaccatgtcccccttggcaccccgtgggcctggaggccccaggatcacagctgagtctccctgagggggcaggcaggaatcagaggagtcgggagcaccctggcccctgccctgccctccccatgcccacactcaccttgtcaccctttagtcctgcactcccaacatcaccctattgggcaaaagagtgtgagtcccgcccaaactggggaggccccgcacctgaattctaatatcatacaagatccactcacccccccactcatgccaggaccttccccacgttcctaccttctccccacgctctcccctgctgccagggggcccctgtgtgagagaaggtgaccgtgagctacaggaaccagggcagtggaggacggaggaggatcagggggaggagggaaacagtggggaccagacaaaggggacaggggtagacgaggagggccagagggctagggaggatggcagagagtcctggggtacaaagggcacaggcaggggactgaagtcacagcactgtcactttccccagcgggacccaccgtgagtcctcggggtccctcctggccggggcggccatcttcaccctggatggtgacattaggttcattgactcagaggttggaaatcagaggcaagagctgggatgaagggagttcggctgtggagtaagacatacgtacccggatgcctggctccccacgctcgcctcggggcccaggcagccctactccagggtctccctggagaccaacaggacaccggggatcagtgaggggaatcagtgggggacgcagggtcatgggaggtcagtggaggctgaagggggtgaccagggcacaagagagagtcagcagcacttgtcccacctaccttgtctcctttgagtccagaggccccaggtggtccctgtaggtcagagtgaggtgagggtcctgtggctctcaaagcgcctcccccaacaccccacagtgtggcccgccccatcctaagtcctcacgaggacaggaaatcaaatacgtggggctttagggcacctctactcaccactgaccccggtggtccaggtggccccaggggtcctgggattccttctctccctggggggcctgccagaccctaccagaaaaatggggcaagagaggcagagagtgacttgggaaccctcctaccctctgccccctcaagactgggaacccccaaggcagggccccctcctcacccaccatggattcaccatgcccctacatgctgttcccagcccctcacccgctctccactagggcctggctgacccatctctcctcgagggcctgtctgacccgggaacccaacaacaccaggagcaccgggcaggccagggaggcccagatctccctgaaataaaaacagcaaagggagggaatggtcaatgcaggacccctcccaggactctcatcagaactccctcttcctcctgtgggggcccggcctgctgcccctacaactggtgatggggcattgacttaccttcacacctggagggccaggaggcccaggggagcccgggaccccgactcctgggtcaccctttgaggaaaagaggcatcggatcaagctcagggagtctcacgaccaggaccccagcagggacccttctgggtacacataccttgaaacctttgggtcctggagcccctttctgaccctaagaaaacccagcaaacagcatttgagagggtaggaacatgagcacagagttcagacacgggctgaaaatattcccaggggagttctgatgtgaccatgaacacatgggaactcagacatgcgaccaagaattggctcacaggagctcagacatgaccatggcctatctcaggacagcacagacagagggacgctcagatactaccatagacaggtgggagttcaggcatggcacaggcacagggagcccacacgcgagtgcagacatctggctccacagacgtgagtgcggacacacgggcgctcagaggggaaccccaacacgtccactcccgggtagagcaggcatggccacaggctgaacgctggcagccaggggcaggggaaaggaggattgtaaacacaggaccaaggagaggttcacaagaactcaggtgtgtcctgggatctgggagatcagaccagagcacacgtgtgcccagatgtggtgagaaacagaccaaggatgggcacacagaagccaagacagggcccccagagctcagagtgtggaagccgacagtgtgtggctccctgtgatccagagagcaggctcctggatgttgggacatgcagcccgactcaggggctcagacatgtgccccggcccaagagtggccccttatgcccgccatcacactcctcaggccaggctcgcccttgcctaggccccggactcacatcttccccagggtctccgggctcccctgcacggccagcttcaccctgcacagaatggcaggtgaggggtgtctggactgagccttctctgctcagtagtcaggccccagggccaacccacctcaccttctcgcctcgcggccctggcagtcctcggtcacctttggctccctgttgacagaggtcaggaggcaacacaggcatcagtcacagaaagatgagactccggagggaggcatggggccagagcttaaatatgcggtctactatgaaagctgagggtcatgagggtgggtaaactatgggtcgaaggtcagaagttaggccactggagagacaggacccccagaacatctgctgtcagaagttccctacttaccggctcacccaccaggtctccagcaaggcctccaggggctccctggtaagggggagaggtcagtgggattccttggcccccaccagttgaccccccctcactggcagccccacacacactcaccttctctccctttgctccagggagcccgaccacagcctgtggggaatgctagtgagtttcctcctcctcccccgcccccaccctgccacccccatggcatttggaaacaggcttgtgggtgaggcagaggagttgctgcagggggtggaagtcagggtcaaagatcacctgtccaggggcccccgtggggccaggttctcctttaggtccgacagggccaggcagacctggtgacccctatggcagagcagcgtgaggaactcagtgcctctccaccaccacccctgctgccccactcctcatatttcaggcccacagctgggcaccacaccctagcgagctgcccccagaacacatactggcacaccagggctccctctgtctccatcttttccactggcaccatctcgacctggggctcccggcttccctgtctccccctgagagggaagagctctgtcagggctgcctgtcgacccttgacccctggagcccaacccttgacccccagaactcaccacttgtccaggcaaacctggagacccctgtggaccctgacggagaacaagtcggatgtcagggtgacaatggacacaggacgacatgagagaacatgggccccaaggagtgaaaacacggtgtccctacaggggccacagggactcactcaccacaaggcctgaagggccggggggtccaggaagtcccacagctccagtaggtccagtcaggccctggaggaagagaaagttcagggcagtgccaaccccacccatctccctatgaccctaacctgtgagctaggccactcacccgtcctggaggtcctgtctctccaggctccccctgcaaacaacccagagactgcatgagcagagcccacgtggccagggctcctggagctcatcctcattgcaggagatgacagcccaggaggttggcgcacactaccccaggcatggacacagcttgaaggagcctcctcctcctatccacacacctagactcaccttcaggccagaaggtccttggggtcctgcagggccagcaagaccctagagaaaagggtcaagggcagggaacagggctcagggattaacacagagaaggcctggctcatcagctgtggccaatgcctatcccagcccttccagaccctcaccaggcagtgttccctggtcactcaccggggcaccaggtggtccagggtctccatgaccaccctgttgtggcgaaaaagagtctgatgagggggagttagccgcaccccaccaaggaaactgaggcagtactggtcactggggcagggcacaggatgggggcaagacaggtgaaggttcttgggtactcaccactgggccaggggggcctcttggaccctgcagaccctacatagagagggcactgatgagcctcaatctgggcctcacttgggcctgttcccaacctctgggggctttttccttgggggtcaatttccatacctcaccctttccagtcacagataatacctacccatggactgcctctcatagatagcacacacgggcctgcacacacacatccacatacaaccacacacagacacaggcacacacaggcacacacagacacaggcacacacaagcaggcacacacagagaggcacacagacacaggtacacacaaacacacacacacagacatgcacacacacagcagcagcagcacctagcggagggtccggagcctggggccaggtgcttcagccaccactcaccggcttcccttcaggcccagccataccacgctctcctggtagaccctgcagagaataggtttaaggccttagtttcccagttccaacttcccctccacccaccatccccctagacagagtcaggacccagacagtcccaggcagtacagaccccagccctgcacacaggacaatacatgtgagagccaccttcttgcacatgtgtggctgttgggcaaggacttaccgggttgccgtcctgacccctcggtccaggctctccccggtctcctttgatgcctggcacaccctgaaggcagagtgtcgtgccctgagcccccagtccctgccacgtgcccaggtgcatatgcacaccacctctagtgtgcccccagaaaggagggggactctatggaagggtggagagaggcctcaccctgtctcctttgggaccttggtcaccattgctgcccggctccccctgtggggatgagatgtcaagtcagtccctagtgccatggcagagggtggccccgagctgattccacacactgaccttagcacccttgagtccagggggtccctgttctccagagagtccaggacctggctcatccacagacacctacaaacacaaggtcacaggggagagatgtctctgtcatagaggcatgggggagtcatcacagatctcaggatcacagagggttatagggtcagaaattccagggttatggcacacactaccatatttctggggaccaagctaagggtggcttcctggtcactagtcacaggactaaggcagggatggggtgatcaccttggggccagggggtccggggggcccaggggttccagggagtccaggagggccatctctgccctgcaggaaacaagaaaatggggtggcagccccagcacagcctccagacagcctgccccacgaagcccatcgcagcccacctgttctccacgttctcctttctctccccgttctccctgaaatgcaaatagcgggtgagggccaagcccatggggggtcccacccctcccaacccctcttccctcactctcctggccagcccccagcctcaccctctctcctggccttcctgcctctcccacacccccagccctgcctgggagcccgggaataccaggctttccaggctccccggcaaggccggaaggcccgggggggcccctctccccaagggccagaccaggtggcccctgagggccagggtctccacggtcgcccttcagcccgcgttctccaggaaagccgatggggccctgcaggagtggaagagagaatgctggtggctgtacagctacaccccactccacggggcacaacccactgagccacttctgctcacctccttgcctggggggccctgttcgcctgagtcccccttggggcctcgacgccgttcgggcacaggcaggaagctaccagagctctcatcccaggtctccacgatctcccgcagggcagatgcctgagggacagcaagaggtcagaggagcggggtgcgtcgccgcagcccctatgcctgtgggcaccactagccccaagggcccccacttgtccctacccccagcccctaaacaacccaccttgatgccagcagtttccagcaaccgatccacattctggggacaaagtctgggtgaagggctgcccatgacagagaagctcctgccttctgccccgcacggcctcaggaaagcaccttcacacccttttccctaggcctcttgcccagagcaccctttagcacttggttgaggcatggctggagactcctgggagcccctttctggtgtgtccccactgcccaagttcccttgagtgtgggctacaagaaccccaatggggcagggcactgaacacacagcacagaacctatggagcctcatggcaaggggaaggggatggcaaggtggccccaatgggcatgcaaaacagagtcaaggggacatcccaagcctggctcaccggcacacttccaggctctcctcgcaggccacgctctccagggaggccctggagagatgaagacaaactgctaggaaccagcctatgggtgtgcatgtgcacatgtgggtgctgtggctacctgggcatgtggaaaaggtgggggcctcacctgctcccctttggatccagtctccccacggtcaccctgaaaacaagaatgaccaggtggggaaatggcccccagcctggtcagccccctcaccacgccccctacccaacatccgcactcaccttggggcccgtgcctcctgggacaccaggaaaaccctgagatacggcagaacacaaaggggtcacaaaggcccatggcttcccaggagggttgcccattgaaacatcatggcttctaatgctctgaagtcccagaatgacccaggacactcacctggccaggagggcccactggccctgggaggcctggaggcccctggggtccaaggataccaggagctccacgctcacccttggggccatcacgaccctgtgaaggatgcagccagcatcagcaccctgagacctcagaaaagagtggagtcatattcccccagggtcagggtcaggggtcagaggttgcagaaaactccaatactcacttctctcccagaggcgcctgaatctcctttctctccctaaggaagacaaggatgcttcaggcatggctccaagcagagaccagagagaccccaggtgggggactttaccttcctcccgtcttctccagggtccccaggttctccctgtgggcagaggactcacatcagcccaaacattcactggtgtctggctgcaagacactaccttgctagatttcagatgactgtgactgtatttctgtgcctgtagctccatggttgtgtgtgtcttggagcatggcctgtggccgtctgagtgagctgctacatgtctaagggtgtgcctgcataggcctgctcaccccaacaggcaactgcacacatgtcctttgactctggctctctagaggtagctccacatttatgcatctctgggttggtgatcgtccacatgtcctgggtgtgtgcatatccatgtgtgtcttagtacatgtacccatgggtctgtgtgtcctggtctgtttgcacatcttggcccatgtctgcatatgggcatgggcttatacatgtctccaaagagcatgggcttatacatgccttgagagccatgtgtcttggcatctgtctgcaactcttgtgtgtagctcaatgtgtatgaccataagcgtgtgggtgaccatataaagtcatgggccagcatgtcctagcacatgtcacaggtcagagccatccatgtgtgtctcaccatgtctcaacacaggtccacatgcggtcttgggtccatgtcttagcacatgagtctgggtggaagtgtctgggtatcaacatgtctctaagtgccccaaatgtggctacacaccagtgtgtttgtgcctgtcgacctgtctgtggctcttcacctgtgcctatggctgtgggttatctgggcatgtgtcagcccatcctggcataaattggcccattcacctaactccctatgtgtctgtgaggctgcctgtgtgtgcatatagaactatgtttccaggcctggcgcaatggctcacgcctgtaatcccagcactttaggaggccgaggcgggcggatcacctgaggtcagtttgtgatcagcctgactaacatggagaaaccccatctctactaaaaatacaaaattagccaggcatggtggcgcatgcctgtaatcccagttactcgggaggttgaggcaggagaatcacttgaacccgagagtcgaaggttgcagtgagctgagattgtgccactgcactccaacctgggcaacaagagcgaaactccatctcaaaaaaaaaaaaactatgtttctggatgcatctgtatgtctgggccaggatgcatgtgtctacacgtgtgcctcatgtgttgctacagatcttggctgtgtaggtgtgctggcgtttcttggcaggtttcgccgcagctgccctggacacactcacgttttttccattcaggccaggtttgccatcctcgcctggctttccctgtgggaacagatcactggttggatgtcggggatcgggtgagggtagtaagggggaaaagggggtaacatgaaagtctggtctcaccggtaatccagggggaccagaggggccagggaggccctgttctccacggaggcctggaagcccctggaaaaagtctttgttaagatttatagggcctctgagatatcccttggggcacaccccatggactaagaggaccccaaaaagatctccctccagggtagagacccccaggactgagaggtcccattgagatccctcaggcacagaccccatggatgggggcccctgctgagactcccaagggaagaacccccaggacttggagggcctatgaagacccccaaggcaaagaaggtcagaaagggggattctactaaaacctgtgtgccagggactgagaccctcccaaaggcaaggctgaaccgaccccccaccaactctctcggatgctgtgactatgatgatctggttggagcttacgcagccccgagccccctctgtcccagcatctcccctcacttacgtctctccctgggtccccagctttgcctgcagcaccctgaggagagactcaaagtcagttcatcatggtcatggggtcaggggctctagtccctgtgagcctaaggcctgcatggcaagaacatgccccacccaggcagggctctgggagaagacacagacaacaggtctcgccccagagctcgtcaaggccaagaccaaccaatgaggctggggtctagggtcctcatgtgaaggggtaggggaaggggacaaccaggcaggactaccaagactcacattcggcccagagggcccagcggctcctggtttcccatccagtccgctccggccatccagcccagggggaccccggtcaccctgtggaaaatagagtggtaagaggccaccaaggctgaggtggatctgataacccaggctcatgtcctgagaaacccccacaccctctcaccttttctcctgctgggcctcggacacctgggtccccctggagggaacagggtcagataagaggtgagggtaagatggggacttggcagacggggcaaagtgcatcactcacctgtgggcctgggggtccccgaaacccttcaatgccctgaggataggggaggaagaaatcagagcaggccctcccatgcctgcacccccgaggaccaatcacactcaccctttccccaggggctccagggaggccaggatcacccttgggccctcgaggaccctcttgtccgcggtccccaggctctccctgtggcagagataagcttgctgaggaacagccttgaagccaagccatgcccaaggtagaacctgctgggaggggcactggggtctttcttaccctccacccacagaccctaataccttctctctggctccaggtcctgtgtctacctgtggggggaatgaccagtgagaagaatggctcaacaaggggaagaggagttggcgaggggatacagggtctgtgaggggctccagggatccgcggaggtttcagagggacagtgggggaagtgggagttagtggaaggaatgaggggacatgatgtggagccaaaggggcaagtgagaacaatgacagaggaccagacccagcgcagcccttaccagccgtcccgggggtcctgggggaccctgggaaaggaaatgattatagtcaataggagccctcaggtcccaggccatggctctggtttgccccaggctcaactctgcccccaagttccccgaagcaccccaatgccagcccccagcaggcatgggtggccatccatgcttcccacctggacctccagaccccttgtgtgaaggcacactggcagcagcgccaggggaccctccatcccttctgagcccaggacaccagccctactcaccggctccccacggtcacccttgggtccagatgatccagggctgccctgcagaaaggcaggggtcagggccactcaaggtaggcagcagtttgggagagctttggaagcaccatgaggactcatgggaatgttggtagccttcagatgcgtgtgtgcaggggtcaaaggaagtgaagattgggagggtttagcattacagggttggggggtaggatcaggtattgggaattggctggttggagggttaaggttggggtgaggagtcataggctgggactcacatttcgtccatcctctccaggatctccctggtctcccttttcacccacaggcccccgaactccaggtgccccctaagaagagcagctggcctgagacagaccctcccaatattttgcaggtgcccctatgacccgctacactgccccaggttccccattactccaaaatccacatcagaggttcccatcaccccatgcctccctgcagggactcccatcaccccttacccccctcagcctttcctatcaccttcatgcccacctcccatcacccctgttacttctctctgccaagactcacccgaaggccacgctcgcctgcttttccaggcaaacccgggtcaccctggtgatagagagaaaagtcatactgcacagggcagtcaggatctaactcactcagggagaggggacagagaagggtctgagcagcagctggacaggaggcagggagtggatggatgaactggtggagcaccagcctactgggatcctagttcaagggtaaaggatcagaaaccacagtgggaaggagtctcaccggaggaccctcgtcacctttctctccaacttcaccctgtgaaacatgagagtcagccctggttccaagaacccccatgatgctggcaacagccctactcccttacccgccatgactcccccgactccagcctcttacatctcgtcctcgggggccaacaggtcctggggggccaggccgcccagggtctcccttctctccaggaggccctgagtcaccctgtggaggaggcaagagggaggtgatgcaggacgctcgaagcaagcagttctcaaggggaggggaccccagaagccttgaggttgcccagggtaacgggtactcactgggggtcctgctctgccagtaaggccaatgggaccctgaaggggacagaaggggggcaggacttagtcagggtcccaccacctcatctccctctgtcacactccccattcccacattgattcacccggtctccagggtctcccttggggccagggtctccaggaagaaccaagccgggtgggccctgtggatggaaggataagaagtcaggaagacaaccttcaccaactgccccctaaacacttcgcttcacttacccgttccccttggactccggtagctcctctgggcccagcgggccccacatctccctggaggtgacaaagaccatcagtgctagtcccaggctccagttaaccccctgacccagcaagtcctgtgaccccccaagtcccatagataggccctatgacctagacctcaaccctgtagaaacctccccttgccccataccaggcttaccttttctcctttgggtccagcaacagcaggtccctgaaaacaaacaggacagatacagcttggccctgccttggggttgtatgatcaaagtcttcattggaatggaggtcacatggaattggaagtcatacagctcagtccccgcccagaagtcacagagtcaccgctgacagcagggaaggggttatacaaaatggactgacacaaagagctcatgacctgcatggcggtcttggggtcacaggatcatagccaagagtctgggggcaggttctagcagaaggagagccgcagagctcccagcctgctcacgggcccagcactgtggaatcacagcccagatagtgttctataggagggtcactgctcaagggctgtgctgtgctcagagcgccatcctcccgtcactcaccaccactgcagggtccccagggcgaccaggctccccctgtggagagaggataggagcagggacaggtcagggagtcacctaggagcccaaaatcccagtgtcccatctgccacatccctagtaccagacagtgccacccccagccgaggacccaccttctctccttggcggccagtgggtcctggtggcccctgaatgtagagaaagtgtgagcccaggaggggaagggaaaggggagggacacacaaaagtcccactcctggtcccaccacagtcacagactcacttcaggacccttggctccaggacgtccagcaacccctggcagcccctggaggagaggaagggaagagctgtgcaggtgggtggggacgggggatatggacagacagggctagaggctggggtgggggctggagaggggtcagggaagattgggatttaggttggcaggggtaagacttggcaggagaacagagaccaggtcagtgaaaatcaaggtcagttcagcagggtcagaggttcaaagccaggtccctggggctgagggttagagcctgtatcagcagggataagtggtcattgaggaggggtgaggagcaggggtagcaggggtcaagggcaagaagtcagaaccagaaagggcacagccaggtcagctggtatgagcattgcagccagtgggtttacccgggatcccgctgggcctgggggtccacgttcgccctgatggaaaagaagaggtcagagctgagttgggcccagatcctccagggcccttggcaccccccaggttgcacttaccttctctccagcctcacccaggggccctggaaagccccggtcaccctgaagagagagggtgagagaaagacagagagagagagggttggtggcggggcttgaacgtcaaaccccagacaaggggtcccaaactccaaccaccccctccaaaaccacgacctctgacctggagggaactcttatctccttatcttccagcctcccctaacaccatggggagcccagagtagcacccctcacacctgaatcccccaactggtactcactttggggccaatagctccaggaggtccccgtgggccctggaagggatgaatttgggggttcagagatttgggtttgggcatgaggatggagcagtggttgatgattgaggtaggggctggagctgtgcccaccatattcagaatccctggcccctccactcacctgctcacccggagacccaggttgtcctgggaggcctggagctccatcctcagagtcaccctgaaggagaaacacacgggtgggaagaccgaagggaggccctgcccccagcacgcagcctcccaccccagaactgggacatcatcaagtcagccttcctactttttctcctttctttccaggggggccaacggggccttggggtccagggcttccgggaagaccctaggaagaagtgagtaaaaatatgagccaagaactatgaagcccagcacccaaccactgccccaggagagacccacacccctgagcagggcccccagcagagcctcaaggcccctcaccggcagcccaggctccccaggagcaatgccaccttcacctggtccagggggaccctgggagagaacagcaggtcagggaatgaacaggggaatcagactccaagccacccctagcacaacctgtccctcacttacccgctccccacgatcgcctttgtcaccctagaaaacagatgacgaccccatgaccctgggccacacctcactcccaaagataccaggagtgatgagggtcatggggtccaattggatttcaaggattttgggagaactgaggcgtcatggtgaggatgggggtaatcaaagggtcacaagggccagagtaactggcaggggttatgtgggttcaaatggggtcaccaggtctctgcatcacatggcactcatgaggctgtcaccttcatggctgttccaggaagccctggggggccacggggtcctgggtcccccagtggtccacgaggtccaggggggccctgatggaggagacaaagtataaggtgcaaccccacagacctcactctcgcccccctcgtgttggtccccccactacacatcacttgcctccacataccctgcacttaccgatggtccagggtcccctttccgcccaggaagcccaggtccttcacctccgatgacttgtccgggagccccctgtaaggacagagagcagtgggcaggattcaggctatgggggccttgagctggaagaagcccctagacatgtccagctattcctattcgcgccttaggccctgcacagggtctggtgtggggcagtcctgctcctccctgggacatcccggccgcctcccttcccccttcacctaccggctccccctttgggcctcgaggtcctcgctctccctgaggacgaaacagagcagagggtggtgcttgggctcaggcgaatgtcaacgtgggcactgcaccaccaccccaggctcccaccctgtggaagaaccctgggaagacacttagagagcaaagaagggaaggcaccttaccgggtccccacgagggccaggcaaccctggagagccctgcaaatggaggccagaggcagaacagtcggagccaccccacccactcaggcagcgcccaccctgacctgcaggacaaggcttgctcacctttaggccaggggctccaggggtcccaggattcccggcgcggccagggctgcctggacgcccatctgctccagggaagccctgaggaggtgaagaggtcaggacaggaagggaccctcccccaaggcccctggtttgctggaggggcctcaccccatcaacaaggggtcgcctaccccactgacccccaagtgttattgggggtggaacagtgaggcagagaaatggcccctcagagcttcacagagcccaattccaggcacaagggcagcgacaaggcagagggcttccctgcctctgggacttggagctgctgctcaggctctgcagcggggctagaggccccactggcccttctatttcagagtgtcccccaaagtctctgtggtggtttataacctccagctgggcttctaggaattcccgatgattctaactctgcttcttccttctctcttgtaaaaaccccgagacagctttgaggagtgcctcagagaaacctcgatggtctccacactcaccctctcgcccttggcagtggcacttccagggggcccctgggggccgggagcaccggtcctgccctgaaagaagatagcagttaggtggggataagccagtcagggtgcagggacagatgtgggggacactcaccgggaggccagggtcgccaggaggcccaacttgtcctctcaggccctaggaagggtaatcagtgagacctgtgctgccaacctctcctgccccactgacactcaacccattctctattccccgcccgcaggggcactcaccatctctccaggttcccccttctggccctggggaaagacatgtcagatgtgggtcagagtggctagccccaggtgcagcctctgttcacctctcgatgagggactcttacctttggacaatacactgggcagggctctggccggggctgcggacatagggtctctttgaggttgaacatttctaccaagaacccccagaccccttatattctaccacccagtcccccagaggcctcttccaaacctgagtagtgaaggatgcctgacacagggctgtggccagaccactgactgcctggtccaggcttggcccatcatccacggcgaagaaggtctggacagagtccatacccggcgccaagcgacgcagctgctctgggtccgctccagccattcccaacatcaccacattaagccctaaggtggggtccagtggctgcatgatagccttttcagggccacccctattcccagaccccttccccatcagcctactccttaccagaagcctgggcctcacggatggggctgaatatgtcacctctcaagggttcatccactagcagaaccatcacccctggtacgtgctggcggcgcccaggagcatctggtgccaacatgtatctgtgagctgtgaccacggctgtgcctggaaggaaggacatgtcagaaccctggggcaccaagctcccagtggatagccccaggagtccatgcctgctgcagtcctcacccaggttgttcccacttgggtccatgtagggcatgtcacggatcctttgcaagataatgccaaggtcatgggagccattcagtgggaacagtggggagggccgatgactgtaagacagcaggccaacctggggtggaaggaaacacagagcctgaggaggatgacagagcagggatgggggtgcacagagcctggagaaacacatcagggtgtgtgtgaccaaaccctatctattagggagtcagcagtgatggcaggatagggagccaggcagtaggtgaggtctggagcctgtgagagagctgggagaatgcctgaacctattgggtggtcaggagatggtaactggtatggagcctgggtggggggcctcagggagaggtagaatctggctgccccagggccaaacctgaactgcctgtggcccaagaggcccaagtgccaacaccagacgctccaggaccctcctcgtagcctccgcacggtgagcattgtcttgagtggcatgtggtaggaacaccacatccgccaggccacgggggcacactgtaggaaggggaacaagttactgaagcgggcagcccacccagacacacctttctgcccttcccactacgcccactatacctggcgtctgtgtgacagatgcctcaggaccccgcacaccatccaggacaggcgtcagggagaagatgtaagagacgccaggctctagccctgtcacccgctgggagcttgagatccctggaagtgtctgcggggacccaggcacttctgcaggagacagaacttgattaaaaagctgtctccacagagccccaactgccagcccacccaaatcctggcctccccctcaccctggccagggcctctgagtggccgccaggataggatgtagctggatgccctggacactggagtccaggccaaagtcaccgagtcgatcgaggtgtccaccacacgtagttcaatgcttggaacacgaggtgactctgaaggaggaatgaaagatcgaggatcagaggctgagtcctgagaacccagaagggagagatctgagatcctgggtccggtttgtcttattgaagcatcatgggaggtcatgctggggtcacccagggtcagagggtgaggggtaggggtacaggaggagtcactcagagtcggggtgcaggaagtcagggtgggtcatcagcaggggaggagcacgccaaggtgaggcaggcttaccagtgcgcgcagtcacctctgcagagggcccttctccagctggccctaggacactcagcctcacgcggtactgtgtcgctggctccagcccgtccaggtgatagctgctgagctcgggccccaggacccgggactgttcctggccacctggggcaggcgtgagggtgggggccaagagcatgtgggatagtgacacctgggggcattaaagggcctgcccacttcactggctctgttaactgggttcaccctcctgactgatcttcctcatcctcactgaccctgcccactttacggaccctgccagactgaccctccatgaactcattgatcccacccacttcattgattgatcttacctactgtcacggatcccgcagacccccagtgacagaccccgcccaccatcactgtcctcgcctaccttgcggagtctgccacagccctgcccccaatggtccctaacttcctcctggggacacctctcaccctcaggttgccagtgcagaaggaagccctgcgctctgggcaccggctcccagcgcagcctcagcgagtgctccccgcgctgcaccacgtgaagcgtccccagggctggcggagcctcaggcgctggagagaaagctcaggaatcagggaggctctgcccccatggcccctgcaccaatcccaggcccaccctggcacacgcaccccgcccagcctctcagacccctctccctcctctcagaccctgcccccaaaggctcactaccaatcctggtcctttctccaatccagagcacaagcccggatccccaaaccatccacaccacccatccgaagctctccagcgcatgctctgcctacgcgtagtgacaacaatggagacaggtgtgccctcgcggtccccgacaagtgcagtcactcgcactgagtagctgactccaccttcgagaccccggatctctgcagagtctgtgtttcctgggagtatctggtgcctcatggggccgcctggccaggtgggcatacagcaatggttaggggtgagcagtcccagccaggaaggacaggggtggcgtcagggagccataccttcactccggccccaggccagtctgtaagctgtggctccagtgacccctacccaggtgatccgtagaacgtcgctggaagcattgaggatctgcagcctcgacacacgacccacaggctcaggggctggggacagaggcaaggtaaggggtcctggtagagaacagagaggcagtgcaggaatggttgacgcaggggtgatctgaaagtcagtgtgaggttagtgtggacaggtcactttaggcagccctgaggaggaggaggtcagtgccttggggtgggcagtgtggggccaccaggaggtcaccgtgggtggacacttaatcagtgtggggtgggtcagtgtggacaggacagtcactgagcaggggggtggaggcagctgggcaatcaggaacacacagcagggcagggtagctaatgcggtgtggctagtagctggccagggtccactcaccagtcctcacaaccacagaggcagggggcccatccacgccagccacatgggccctcacatgcaccgtatactcagtatctggctccagtccatccagctcagccaccgtggcctccccagaaaccaactgggatttctctgggcctgggaacagggatggaggcagctccagggctagcaaactctgtgccccagagccccacctggacccccaataaacccccagcccccattccaccctgacctgccccctcccaaaccccagtccccaccgtgggctgagtgccaggaaaccctgtatcctgtggcgccaggaaccctggtccaggtaatggtgacagatgagctgctggcctgagtcacatggaccgtcctcactgggcccagtgggtctagtggggagaggcaatggggagtctgctggaacaggcaggaaggagtggggctatctgataggggaagatgatgggagtctaacaggagacgggaatttgatagaggagatggtgaataggtccagtggaggagtggggaggtggaggttttaggaagcagtgagcaggtctgatggaggagaaagtgtaaatctcagaggagatttgggtccagcaaaaaagggatgggggtctgagggttgaagtggtggatatttgagggcaaaggctgtgggagtcttaggagagaagcggaggaatctgaatacggggagggcttaaggggagacagctgaaactgaagaggaagcagcgtctctgagggaggagggagtgggattctgaagggggaggcaggagttctggggagaagcaagggtctgcaagggaaggcatgggggtctgaaagagcaatggaggcagagagccaagggacgggggcagggcctgacccgttcgagccacgatgactgcagcagggccctcctctctgcctcgcagtaccgacacagccacctggtaggtggttccaggctgcagccctgtgatgtctgtggcagtagagtctgggggcagtgtctggctggactccggacctgaggtcagagggaaatgctggcatggctcctgcctgtcccctctggcacccataccctcattggtccctttggcagtccccccacacaccccacactgaccactgcctgtgctccagctaatccgaaatccactggctccagggacgggtccccaggccaccctcactcgcgttgcatctgacaccacaacccgcagccctggaacagcaagtggagtttccggctctaggagttacagacagaagtcagaagtcagaaccaggaccagagtgaggcaggcagctgtcctccacaagcctcctgcagtactcaccccggcggacagtgaggacactggcactgccctcacggggacccactcgagcagacacccgcacagtgtagctaagcccagcctgaacgtcatccaagtcgaatgctgtctgactcccaggaagcaccagggtccgctcaacccctaagagagaagtcagggtaggtgggcaggggtcagaaagagacagggatgtgggacgatggcagtgatggacagggacgcagagtgagaagggccatgggggtggggatgtggggtggtggggaccagagagctgggatatggctgaaaaaagtgagtgcaagacaaggacataggatgaaaggggccagtgatggtcagggacactggaggacaggagtctgtgggatcttagcatgtaggatgacaggagtcagtggactgcagtgagaactgatgagccattgacagacactgatgtgggatggcagaggtcagtgctggatggggacatgcaatgagaggttggtgtacagtggtcaccactagggtaacagaaagacaggtgattgagcttgtggctgtgcagaggtgaaagccgtggatggggtgtggggcagggaggagattggttggggtagggtaggggcagacacaccctgttgacagttcagggctcagtgccatcttgggaagcagatggataacgagacagggaggagactatagggacccaggtgtggaaggagagggctggaggtacactcagacccctcaggctggaacttcagtgtgtgtggtgggggtgctggctgcgtccacctcaccctgggtgctgcgcacaatgatgcggtactgggtggcaccagggactgggctccaggacactcgcacccgctgcccgggcagctcggtggcttgcaggtctgttacagggctcacaggcagctctggtcctgttggagagcacagcatagaggcagcctggggctccgacacctcccccactcactggcccagcccacagagccctcaccagtgggaaccacggttgcaggggtggccacctcgtggccctccagcagagtgtagagtgtgaggcggtactcagtgcccggctgcagcccatccaactggtagcgggtcacatcagagggcagtaccaccttctgcggtggctccaagcctgcaagataacagggtcagaccagcagaggccatgccctgacccttgcctgtccatcccttcccccgcactgaccagtctcacgccgccattccaaccggtagccacgggcctcaggcaccaagttccaggaaaggaggatggatgtggggcccaggatgaccgggcgcagggtctgctcaacagaagcgtctgcccagggcacatgggatgtcagtggcctccgggccttgccctgcctgcccgtcccagcctgaagaaagtgcccagccttctcaccagtgcgagccatcagggaagtggcgggccccacactgcggccaaatagggtgctcacggtcacctcatagtccgtgccaggctccaagtcacgcagcaacactgaaccctgcccagggcccagctcctgctgctgtgtgggcccacctgcatgggggacaccaaggggccagtgggccttgcagactcaggactctacagccttgtctgaggcgcggggactcccctcagcccacatctctcactcaccactgaggacccgccatgtcacacggtagccagtggcacctggcacactccgccaggccaccaggaggctgtgggctgtggtattctggatggtcagttccggcccttctagggcagctgggggagagtcccaccagggattcatggagtcagaagtgggagggggtactggggtcgggggttaggtgaatggggtcagaggctggcagaattgctcactggtccgagctgtcccgctcacagcctccccgatgctgttggcgtagagggcaatcacagtcacttggtactcggtcagtggccggagaccccgcagccgcacactggtctcaccagctgggacgttcacctgcccagggcaagaggtcactttatcttgcccagccaagtccccagccaccacctatcactcctgacatcctacctcctgccgctcactcggcagtggctgtcccagccccgtcagaggagtgtactggaccttgtagccagtcacagggccactggccgctgtccactgtactctcaaggattggctgcttggctcagacagcaccaggtctcgtggagcagaggtcgagtcatccgctgggaatgcgggatcaggggatcaggcaggaggattggggtgggcatgtatgatgcagagttggggtcggggtcaggagcacataggatggaatcagcactgccaagtggggattggggtccggggtctaggtcagggtacaccgtgtgggcaggaactcacgaggtcgggtcacaggcacgccaccagcagtcgtgcacactctccgggaaacgaggggcagtagtgtcctcaagatgctgaagtcattgacgaagaagaagaagtcactggtgggctgtgaggcaactcgcttcagctcctcagggtcagcattcttgatccctgaagtgacgacccatcaggactcagtcacccacatgctctctgactgcccccaccccccagctgacctgtcactcctgctcggtccttacccacagcaaatagcttgaccccctgccccttcagcctttgggcagctgtgtccaccaggtcctgggacttcccgtctgtgatcaggatgcagacctgggacaggtgcaggggtcaaatcacggttcccctggacacttcatttggggtcatcttgggaggcatggtaggggtagggatcaccttggggacaccaggtcgggccagctggggcaggaagacatggtcagccacatggagaattgcagcccctgtgcgagtgttgccccccttgtagctaagctcacggatggcgcggatcacatcacccccagagccaagtgcatccaggccgaactctgtcctgttggagggtaggggtggcaacaggctaggactcaggatctcttctggccctggccttgaggaggcctctagggtgagggttacgggtatcaggctctcttgaggggtcccttcgttctgtcattctccacacccacttgcctctggaacccccaggttaacaaactccccaggggctcctttgtgcaccatctgcaggtgggcctgggcagacctgaaggagcccttaggggctcacagtctgtggggaacaagatgctgcttaattaaataattgcaggaggaggggtccagatgtaggaaagtggatgctggccagatggagcacctctggtgaacggctgcaagggttagagggctagaacgtggagaatccaacaggcgtgggggccccctcctgggctccccatctccagatcagaaaacacagcctcactgtcttgcaccttcctgtcttgcagtagcctggaggtgcctcagggcacgaaggttctacctagggaatccttacctctgtctccaaaggaggtcctggctagggggtctctaggttccccaaaacttgtttctgcaaagacctggcctggggtttccagggtctcctccctctctggggaaggagtcttggtggggatctcgtggtccccagcccccagggcccctactcaccgtgggtcatcgctgtactgcactgtggcaaagcgcacaccctgtgcactggctgctccagagaaaggcagcaccagcccttcgagaaagctgcggacctcgcggaaattgctgcggccaatggatgaggagccatccagtaagaacacaatgtcagcggcgtaaaggcgcgtgcaggtcactggggcgggcaggagagatcagggcctcttctgggaggccaaccacccgcctacccgcacggtggcctcactgggacttgggatggtggggagagtaggcctcatcttatgcaaaccagggccgaatcggcctgagcctgagggccttggagggagttgagctcggtgggtcccagagcagactcccgcggagggttgggggtgtgcgggggagggagagtcgccagcacgggtgtggacttgggactgaggtcagcctctaggggccggcgtggattggcataaggcaggggaccccgcacgcatccagggagccagaatttgggtaggaacaggataggaggcggtttagggaacccagcaccgatcgcggagggttcggggagtcccagaattaggaggaatccgcggggcgtcgtggagttggctgggttgtgggcggggggtgttggggatgaaggccgagtggagcggagggtggcacggtgcagtgccccgggccgggtcctcccttgcggtgcccacctctctccctgtgctgggctcgcactcggggcgcctctgccaggatcccggcgcagagcgcggccaccagaagccgcagcgtcatcctaggcagtaaaagccgtcagctaggacccccgcctctgtcccttgctcccccgtggccttggcaggtccgagcccagcgcccctccagcccgagtcctggtcttgcctgcgcgtccgcccgctcccgccgccgccgctgcagtctctcgggcagagcagagaaaagtccctgatctcggggggcggagcggcaggcgggaacccaggcacccgccctcacccatatccctgagaggtcgccgccccccccacccctcccccagacaaacgatatgacgcacttaactataaaccccccgaccccccgtggcttctgggaatttcccagaaggttctgcatgggcagatgctgagggagtacccctaactccatctaaggtcacaggtcttggctgctttaggtcaatcacagtgaccaggctgaggagtggacaggttcctgcagagccacaaggcagcagcgccgtggggggtggggctgcagttggggatgactcacccccaatccagtgggggtgcccagacaagccctcaggccatgggtcccgccggccactcctgtgattcagccatctgtctggtgggcctcctgggccccacccggatctccttgacaggcaagaagccctggcaaatgagtgactctgggccggtcttagggaaaccaaggtccccttggcctggatccaagtaactcaccccctctttgtaggggataagccggaaggaggagagaacctgtgtcatgcttatgcatacatcccagtgtcccacatcccctaccatgtcacaggcagatgcaatccagctgtgcctgcagggagggggccgcccatctgtggagggcgggaccacccacagtgacagctcatctctcaggaatcgagccctccatgccccaggccaggtccccctacctacatgtcctcacccacaggcatcctctccttccatctacttttcttgtaggtccctgccacccatctcccctaccaggccgaggtccccttgggccccttcctcctttcctcactgccctcatggtacctgtagcttccagcttcataactgccccctaccttactcctgtccccttacccaggctgacttcacaccctcccccagcttcgcttctgaggctgtggacagtcctccaacacacaccacgccagggccactgtccgaaggaggtggggctctgtatatgcatatctctccattagatgggtgacactaaggcagagaggcactgctaagaagggcaggcccccatctgggtcctgctccccctttttttcctgctaatcctgaataactctgggcagcccagaaagcacatctatactcaccaaggctgctgggccccttctaatatgcccggccccacagcctcccctgggatccacagggagatatggggacagcactggctggactcctccacagcccgaggactctggtgtggccagagctggaggcagtgaagaccatccatgctgcctgctttcctattgcccaaggaaggctggggctctatcccttattactgaccccccaaactatcctggggcatagtgctatgaccttattccaaggtcagggtctcctcagccatgtcccaggaccccccatccctgcaaggtgtgctccaggtggggggctgcagagaaccaggtatgttatcacacaggcagccccttccccctaagactgtcacctcctcccgtgcagccagggcgggcaagagcaggccagtggcatggacagtacggtacagacatatgtgcacacgtgggccagtcttaggggagacaggaggcccagctgggagggtgggtgctcaggcaaacctcatcagaattgaggtgcctccaaaagaaaggacaggctgctgtgagagggtctctcaaagggtgctgggagaggctgttgagaaggtaggagtaaggttggaatgactccacgtctggagcttctatgagactcacgagcaggagtgtggccctctgaagccccagctctggcctcctgggaggaacacagcctagggcacagcccgaggccagtgcctacctgcaaccccatcagggcggtggagcccccagagcacatccttctccctcccaagctttccctgaacatttccttccctggcctcagtcactacctcaccccatctgtttccaaccagggcctctttatcaggtcccagccccacacatcccactgtaccctggacaccaccaaactcctcactggactatggaagattaccctcctccaacccactcgtgcctccgcgtctcccagccctgctgggaatgtagtcctctttgtgtcccctacagctggctccagttcgtgtggccatgacctctgttctgccacagcacagctcaccaagactgatacagaaatatggcctgagagtccccatgctgaatctcaactctgaccaagtcacttctcttcacagtaacctccaacacacctccccagcatggctccagggtaaagaccagagtccctggcttggtacgcaaggtcccttagaaccagaccactcccagcaactcaagctctcgtgtccagcacacctgtagcctctaagggccaggctgggcttagaaatgaagccccatcctccaggagctcaaacttgacaacagacttggcacttgttcccctgcctgggtgttgcacctccatgagcacccagggttgggcctgtcagggttctgcgctgcccagcatcttctctccagccgttcacaaagtagaatgatctgcgcaatgccccagtcccgggccgtagaaggtgcttaacaaatgtctccgaattggcaacgtatggcaaccaatggtgagggaaaggcagtggggcagggtgatagtgatacaagggttccttgggctacttccaagctacgatgctggggggacttctgaacagccatcttctaaaagaccttgtcccagcaccctgcttgtgactgccaggcagcgacttcctcaaaggaaaattgggcccctcgctttcaacttccccctgggatcccagagaacctgactgtggaagcactggggggtgcaggaggagcagcctacctgcgcacccaccatggggaccagagccaaaagagataacagagggactaggtagctaagagctgtaccaggtcctggctgcctcaggaaaatggggaggggattgtcaggccagcagctctggacttgcctgggacaaatgtagtagagggagggggctcgggccccactgagctcagggctattcttggagcctgagtcagcggaggcaaaggattcctgccctgcttgtccaggcagcagttagaaaccaaatgagaacactatgccccaggctatcctcctcccagaatgcagagtaaacacacacaagaggcatccttggagacaccccttggccccttctggtccaccagggaccaccagggggtgacttggcacaaggtccacagtgaggggtttcccacctgagcctgcagggattccaggctgggactcctacaggggcaaaggctgggtttacacttcctatggactcccacagcccaatcttgggaccagctggctgaggaactcccctaagtggctgagtggaaacatctgggctcagctccctgtaggcatcaaagacttccggcctcagctgcaacccccacgcttgcccctggctgaggacacatcagcctgtgggaaggcaggaggatccaggagccacagaactagagggaagtccttgctccccatctactgccccatggactccatgccaatgccaaaagagggatgacacacttctcagcagaggattttattggtggtcacctgtggcacaggttagaggagccgaagtgctgtgtttgtggtgggggggggaccacaaaccccggccctgccctcttgcttacataggcttcccgcctagaagcgcagccagaacatgccgctacggatccggttgtagtctgggagctgctcaatggggcctgtggggatagggtggagcgtcagggtggggtacctggcctgcacagggacacctggccctgtgccgcacccagctcggagatgctgcccagagcagcacaagacaggctttgagtggaaagagaggagagaacattcccccaggggtgctgagcctgtcccttcatgttctggcccttgaagccccaccccacatggaggtgcccgttacctgacgggtgcagggtattgatgaaggcaccttggcaggcagtcaaggaactgctgggacaggttttctgagcaagaactccctggcagccaggggactggggagagctgcttggggccttaactggctgctctgtaagctgagcagcagtgcgggagcagaggtggaaggggaggccaagagaacggcctgaggaaataaacaaagagcagaccccctaggccacttaccatatccagccactgctgggcactggtcatagatgtacttggagcagatctcacgtaccacactggcatccacctcctgcagggtgaggcagagggcatactggctaacgggcacctggccaccacctcagccagtcagcatcatccaactagcagagatctcccacaggcagcatgcagctgtccccagcccaaaagaggaaaggcagaagggatccctgctatagacctccatgggccccgcccatctccacagccatcagcacctatgccctgccctcccactatgctacccctgcaggtgacagctgcctaggacaccagggatgcctataggagcaggctgcgctatgccaggccccaaccctacacctcccaggtgtctgccaggccaagactccagaacctctcccaggggtccatgttaccgcaatccggctttcccattcagccagggggatgcggcggccataggtcaggaggctgcgtccgatgtcctcacacacaggagtagtgcctttaagggtgagagaaggctcagaggtccacccagcccaatcctggacccacaggtacacaaacaatctccagcctcaggttgacaaggacctccctgacctcatgctgactcagatcacagccctctcttctatggtcacctattatggcagtgatgggctgtggacctgtctcacacctgcctgcatctccaagggtggggtgatggggcatggcgtggtcttcaaagttttcctttctaaccttggttagttaggagcagtggccaccttggtgctgtcgctggcaagatgtactctacccctccccgctgagctgtaggactcaccatctagatgagataccagggcatttctgaggatgtttttgccccgggccacctcactctccgtggcactggtacacaggcgcatcctaaagtgggggggtgggtggtattcattctgagccagtgtgtcatctctcagcctcccactgtgctggttaaagccgccatcccacctaggaataccaggctgccacttaccactgcccttgcaggacgaacatcatgtcatcgattttcattcggtcacagacaaagtgtgcacccagcaagcccgtctctgcatagcagatgctgaaggtctggaaactctggcatagcttgttggccacagcacctgaagccagtgggctggacaggtgctgccagggggataggtggtcagcacccaccctcttgtcttcaacgcacactgtgacccccacgcacaggagcacacagccccagcaccctctcttccctgaaggcgaggtcccatgctcgcgctggcactcaccacgccaccaccataagtgcagtcatagtggccgatgatggcattggccacttgcaaggccacattgtccgggctggcccagccaggaccctctactgcaatggccacgtgggcaaaaggtagagcatcatcacggtggcggatctgaaacagtacatgacaaggctgaggaacagccagactgccaggggaacagaaaaggtggcaggtgtgggtagagggtgtatgtgtgtgaacatgtgtgcctgtgatgcagcagccacagaaccccttcccaactgctgaggtatctctggagtcaccaggataaccatgcacatgggggtcctcccacaggcccccagctgagcactactcctgcccaaaaggcagcatacctcactgccagtgaagcggcatggagtaagagtgggcacagcgtcctctgcatatgtccatgggatgccaccgaggtgcttctgggcgaggtctaacagttgctggtgctccactcctgctgagacagacagtggcattactgaccagccagggcccaaggcacagggtggggcgattcacagacaggcagaggacccccatgtcctgtcttagtgggagaaaccaggagtatgtgacattagaacagggtgaggaaagaaggtcctcctcagacagaccctgccttgtggacaggacaggcacctcagggccaaatagctcccatggcctcagtcccaggagagcaaaagcgttcagagtttcaaaatgggctgccatgtgatccaagtgtgggttctcacttgagaagatgcattccacctacatcaaggacaagactggtactcctgggcacaaagccacctggcctgccttttccctctagctctccctcaagtatttctggctgctggccctgcagggggtggcaagtgagggggcagaaagaggagctattacagggctgtgattagctcttgggtcccctgagagctggggacatttgcaaataatgttacaaacgtataccctaggactccttggatcttgcctcctcacctccacaagaggagggctctgtggtgccaccagttgcattggcctttttttttttttttgagacggagtctcgctctgttgcccaggctggagcacagtggtgcaatctcagctaactgcaagctccacctcccgggtccacgccattctcctgcctcagcctcccgagtagctgggactataggcgcccgccaccacgcctggctaatttttttgtattttcagtagagacggggtttcactgtgttagccaggatggtctcgagctcctgatcttgtgatccgcccgcctcggcctcccaaagtgctgggattacaggcgtgagccaccgcgcccggcctgcgttggcctttcattccttccttccatgagctcaagccctgctagtctgacacacacgtcagattgctcttgcccccaggttccccagctccaaagcccctggtcatgctcttcctattggtcttttctgcacactcagccgccaaggtcataagctgggaagcatgtttgtttttttttttttttttgagatggagtttcactctgttgtgcaggccggagtgcagtggtacaatctcagctcgctgcaacctccgtcccccgggttcaagggattctcctgcctcagccttccaagtagctgggattataggcaactgccaccaagcctggctaatttttgtatttttaccagagacggggttttgtcacgttggctgggctggtctcgaactccttacctcaggtgattcacccacctcggccttccaaagtgctaggattacaggcgtgagccaccacgaccagccaagatgggaagcaccttgacctcagttccttacccatgtccagaccccaaccaggttccatctataaaaccacctggagtccatctactgctcccccttgctcctgccatctcctgcccagtccctgccacagcccctctctagccagcctacctgcactgtgaccccacacagcagcagagcaaaccttagaccatgacactgctcttcccctgcgctcagctccccacaccccacctaaataacactcaccacctttcaggcttctgttcaaactacaggtgctttaaaaagcccctcccccaaactccaactctgagtccccagtgaaatcttccccacccttctgtgccttcctttcaaggcacttcttggtttgttatcaggcatgcatcaacacacaactaatggctggctctcccaagggcaaggccacaaggaacaaggccaggagcttacatcccctaccagcccatgaactcagtatcctagaaccaggtggggctaagacagacctgtaccagagggacagcatcctgtgtaaccagtcccagtggtggcggcagggtagaatcctatcccacctcagagagcacaggaggaaggtcattcccctcaaggttagggtgggagcagagtcccctggggtgaaaggtcccctatggtgggaaccaggacctcggctttgataaccaaggctgggaccccactacccaggacttcagtgattccatcactcacctccagctgctgccagcaccattcgaggggccttgtaatgtgtgctgaggtactcggtcaagtctgcacgagacagcttcctacaagacatatggtcagtgtgtcaacacctctaccacactggagtgagttggggtacatgcatgaatgggactgaggaggcagactaggagaggcatggtttctccgaagagtgggccctagcacactccccaacccccttcccctgtctctgccacccacccctccagggcccagagggcaacccttgtctgcccttgcctcatgcctgacttcaggacaggctcatagtcttctctgagaaggcgtgagccaacactgtgggactctcaaaagggcagcatcaaagctcccggagccatccacaaaggagacaagagaccacatggaggggacacccagacacttcgcccttggactgtcaggacatgcaccaaaacataccttaaaacaaagcccaaaattcaagtgaagcccacaaagccattaaaaaagactcactggaccacatggatacagaaactgtctccagttgcataactcaggaaaataaccccgacagctagccaactaaaaatgtgacctggaaagggtctggccaggccagaatggagcaagcatccccccacaaggccagccaactctcacctgacattctcactgggcccctccacagcctgggctagaggtgtgccctggaatgctgtggcatgcaggtagttaaagaccacatctcgcatagatgcatcattctcctgcatctcccgcaggatcacatcacgttccttctcaatctgtgagtcttccagactacagttctgcacaatgtcacccaggagctccacagctagatgcaaggaggacatgtttaggtgccaggtggaccactgcagaccaacgacagcacaaaatccccaggcctggcatctcctgctgcccacccctagttgcccagctgcaaagccatacgctaagggtaatatgattctgtggtcagccaggggctcctaggtagctgtcctctgcttccctgccctctgtccccgcctcttcctccaggtgttacctttcggcagatccttggacagcgccttgatgtagtaagctgtgtgctcccgggtgctgtaggcattaagatgggcccccatgctctccacctccttctccagggcactgccaggccgattctttgttccctggaaccagatatcaaccagaacaatcaggagctacacaggaacccaagaaccctgtcctcagaggctaaacacccagcaggaccactggtccacaggtacctccctcagcatagactctggggacacagatcccagagtctgtttaccaagcactaagcaggccttgaggtgaccaaaaccatggcatcatgcgccaacagaacagagatagccagggccaggactgaagggcatggccagagcaagtgttgcctaaagctcctgtaacagcttaccaacaagctgtggggatcattaccagtacacctcccccctccttattgacagccatggtcaggtaagcccacacctgtgttcaagtgatagaacccactcctcccatgccattcccatgactgtatgtttgtgaatacatgctagtggcctctgtgggacccaatcctagtcctgtgtgtggagaacagtggtgctatctcttggtgtgcacacacacgttaattctgcacacatacctgtgacattgcagctggctaggttgcctactatggctccatggccctgcccaccccataatccttctccatgtttttcattcctttaaaaaacatgggtctttacaaccaagggatgcctagatattccaccagagaagaacatttcataagcaagcatgcatgcccatgtctgtgggtttgttaaaatgcatgtgcatatctacgtgtgttccacaggcctggcttctctggtgaaaagtggggctcctatggttccttgggtcctcttggctctgagggcctcaggcaggggctcatcagatacgtgcccactcaggagaggttaagctcatgtggctccttttaggaaagccagccagacatcagccccgcaactgaggcccataatcaggctaatttttctgaccttcatcctcaggagggacaacaggcagccctaagcccagaggagacagactttaagagcctcaccttgaaagccagatgctccaaaaagtagcctgccccattattcttctcagtctcaaaacggctgccaacatcaatccacactcccacctggtcaagaagccaccagaaaaggttacaaacaaaccactccccagccccctactcacaccccacctgagtgactcagtacaagccccaggcagggacttatgaatcctggagtcagggagagctgccccagcaggacccctgtgcttggggacacagtcatgcttggaaaacaggggcagccgaatgactcgtcacaccacatcattgctctcctgattggctatcaaggacccacagggacacttctaactgtgcacatttacctggtctcaccagcatacaaatccttaaattcactctcaattttcagttaattatttgtttttgtctaagcatacaacatatcatttgcaaataacaacttattttttcctttctaaaaattacacgctgcctttgttctggcaatgattttatcctttcatcattaaggaagggactattggtttagactgtatattttatcacactaaatattgttcctataatatcttttttgttgttgtttttaatcagctctgaacaccaaacagtgttgccttggcacccaataaggtaatattaattttcttgacagcctcctggttgctgtgaaacacgcaccacaggctgggcgcggtggcttatacctgtaatcccagcactttgggaggccaaggcaggtggattacgaggtcagcagttcgagaccagcctggccaatatagtgaaaccctgtctctactaaaaatacaaaaattagccaggtgtggtggcacgtgcctgtagtcctagctacttgggaggctgaggcagaattgcttgaacccaagaggcagaggatgtagtgagccaagatcgtgccactgcactccagcctgggtgacagagagactccatctcaaaaaaaaaaaaaaaatgtaaaagaaacacgtaccactcaccccacttggtcacacggtctagtcttttaatttactatttgttcacagctgatttaagtttttcacatctactttcctaagtacttttttttttttttgacatggagtctcactctgtcacgagacgagtgcagtggtgtgatgtcggctcactcaacctctgcttcctgggttcaagtgattctcccgcctcagcctcccgagtagctggaactacaggcgtgcaccaccacgcccagctaatttttgtttttttgtgtgtgtgtgttttttttttgagacggagtctcgctctgtcacccaggctggagtgcagtggtgcgatcttggctcactgcaagctctgcctcccaggttcatggcattctcctgcctcagcctcccgagtagctggaactacaggcgcccgccaccacgcccggctaattttttgtatttttagtagagacggggtttcaccgtgttagccaggatggtctcaatctcctgaccttgtgattcgcccgcctcggcctcccaaagtgctgggattacaggcgtgagccaccgcgtctagcctaatttttgtatttttagtagaggcggggtttcaccatgttggccaggatggtctcaatctcttgacctcgtgatccgcctgcctcggtctcccaaagtgctgggattataggcatgagccactgcgcccagccaagacttttttttattgtataaatttatggggtacaagcacaatttttagaaatttctatccacacctgaaactccatttttttctttttttttttttttaagacagagggccttgctctgtcacccaggccagagtacagtgacataatcatggctcactgcaacctcttattcctgggctcaatcgatcctcctgctttggcctctcaaagccctggaattactggtgtaagccactgtgccccgcccacaagtgtgatgtcattacaggcacagaatgcacaagtagtcaaatcagggattctgaattatccatcaccagaataacaaaccttgtacccattaagtaatttctttttttttttttgagatggactctcgctctctcacccaggctggagtgcagtggctccatctcggctcactgcaatctctgcctcccgggttcaagcgattctcttgcctcagtctccccaggagctgggattacaggcgtgtgccatgcatggctaatttttgtatttttagtagagatggggcttcactatgtttgccaggctggtcttgaactcctggcctcagctgatccgcctgccttggtctcccaaagtgctgagattacaggtgtgagcctccaggcctggacccattaagtagtttctcatcatccaccccttcatccttccaagtcttcactgtccatcattccactctctacatctgtatgtacgtattttttagctcccactgataagtgagaacatgtgatatttgctttcctaagagatgtcaatgcatataccatatatcacacaatcttagatgaacatgtatttcacatctaacatcttggaatgcaagaggcattttacaatctatagtatcctttgattaaaattggcaagattcttgagattctttctctggcactggagcacagacagctccttacaatctagcacattttagagttcatgtaatatagcattctttactataacaagtgacatataacaaggaagttgcaggccaccttttcctatgcttagtaacaatttaaatcgcaggacattgtttctggaaaactaaaaggatgtgtcaataaaaacatctggccctggggctgggggctgaaaggaggaggagataattatttcttgggaatcttctcacctattcatatatctatctgtgactcaagatttcttgtgtcaatttagagaatttgtattttttggaaaatcacacatttcattgtactgttaaaatgcatttgcttcctaaaatgtatttctggtctagcctggagattatgaccttgggcagtgaggctgacagacctggacccctgcaagtcacctaaggtgtctgaatcccattttccgcattataagaggagacatgatcacttcccttatatgggctccttaacaaaaggctggaaaagaatttggccgcctacttaacgggcattatatgctaaataatgttggcttatagtgaagattgtcccgtgaagccaaggcgtggctagggtagggaatggggccattctcggggtgagtggtcctgggtccgaacccaaaccacaaacgggaagactcgagcccaaggtcacaccccaaccagggaaaagacggcaggcccaacctggaggccctctccccaaaagcgtccccaactcaccgtgcaagtgggctgagaggactgctcggaggccacacgcaggccgttgtccagcaggctaacctgcgtctccggcacgaactggagcgcctgagcgaaggttgccgtactccgcaaggctggcgtccgcagcagggccggctgtggaagggaacagccgcgagtgaggactcggtcaggggatcgctccccacctcccaggtcctcaggaggacccccgaaccccgcccctaggcaagcggcgagatacctttccccgccctccgccgtgaccttcccacggccctgaccccgcgtcctccccacctcgacctgccactgctaacagcccacacctgtccgcttcccgaagccctgtcccgaagccccgcgctctcgccaccacctcaccgagcggcgggcgcgcaatagcacttgtgccccggcggtagcggcccgacagaccacggacgccgccatcttccagctgcagtcggccctgttgcgccgcgcaagcgtagactgggcgcgttggcggtcgcggcgcaggcgcagtaccgtacagttggtgctcggccgcctcctggcgggaaccgggacagtctattgtgctggcctggctttggctgactggctctgaccgcgctgccgccagtccctgcgcacatcagtccacctgccgtccatcagcccgagcaggtccgcccgccgtgcagtccatctccccattccacgcgtggaagtcagagtgcattatgtttctcaccagccgcgctgcgtactgaggtctggcgggcggggagttgcagccacagcgtgtccgcaggttcgagcccagggctaaagtaccagcgtggaaacttacctgggaccacaagttggtgctgaaagtcagtatttttttctctttatttattttttattttctgagacagggtctcgctctgtcgcccaggctggagtgcaatggcgcgatctcggctcactgcaacctccgcctcccggcttcaagcgattctcctgcctcagcctcccgagtagctgggattatgcccggtaatttttgtttctttagaagagacaaggtttctccatgttggccagttttgcgccctgccagttttctctttaaaagaactaagtacaggccgggagcggtggctcactcctgtaatcccaacactttgggaggccgaggcaggtggatcacttgaggcgaggagtccaagaccagcctggccaacatggtgaaacctttccttttctgtaagaggaaaaagaattctggctgggtgcagtggctcatgcctgtaatcccagcactttggaaggccgaggtgggcggatcacctgaggtcgggaatttgagaccagcctgaccgacatggagaaaccccgtctctactaaaaatacaaaagtagacgggcgtggtggcgcatgcctgtaatcctagctactccagaggctgaggcaggagaatcacttgaacccgggaggcggaggttgcggtgagccgagatcgcgccatttccagcctgggcaacaagagcgaaactccgtctcaaaaaaaaaaaaaaaaaaaaaaaaagacttctaaggtatgctttgttatgtcaactaaagaaaaaaaaaaacaagcttttaaatatttaaagttagttctattcagaagtcttaccaagaattgcaacccgggagagcctttcagggagtttctgctagactgctccaaagcagtgtttccgacagtttatacactggtggtggcggctctccatgtgctcagaaattacatcaaatgtgctcagaagttacattagagcataaatctcatcaaggtttgggtgcaagagtacatctgtttataggtcacagaagcataatcattaatcctgtcagacagtatcttaagtacaggaagaggcaagggctaggatcattgcattttttaccatgttggccaggctgatatcaaactcctggcctcaagcaatccacccacctcagcctcccaaagtgctaggattacaggggtgagccaccacaccttacccaaaaactactcttatacttaaaataaaactatctttataaaaatcatgccagatgccatgaccacaggctctcacaccacacccagctaatttttttttattttttgtggagacgggggtctcattatgttgcccaggctgatcttaaactcctgagctcaagtgatcctcctacctcagcctcccaaagtgctgggattacagtcatgagccaccgtgccaggctgactttatttcttataaagggttacaacctgcaggctgggaggtgggcttctggtcaaaaccagagacagacccttaaaaagaggcaggagctttatgtcgaatggcttggctaaacatacatattcggccgggcacggtggctcacacctgtaatcccaaactttgggaggccgaggtgggcggatcacaaggtcaggagattgagaccatcctggctaacatggtgaaaccccgtctctactaaaaatacaaaaaatctgccaggcatgatggcatgtgcctataatcccagctactcgggaagctgaggcagaagaatcgcttgaacctgggaggcggaggttgcagtgagccgagatcgcgccactgcactccagcctgggtgacagagcgagactctgtctcaaaaaagaaaaaacaaaaacaaaaaataccatattcaacaggttacaggaagagctatagatactcatgaagggggtcctaatgcaagtatactgaataaacatgtgtgttgtatatgacccatgttcactttggggtggagacttaacattgaaatacattacaggccgggtgcggtggctcacgcctataatctcagcactttgggaagccgaggtgggtggctcacgaggtcagaagatcaagaccatcctggccaacacagtaaaaccccgtctctactaaaaatacaaaaattagctgggcgtggtggcgtatgcctgtagtcccagctactcaggagggtgaggaaggagaatcacttgaaaccgggaagcggaggttgcagtgagccaagatcgcaccactgcactccagcctgggctacagagggagactccatctcaaaaaaaaaaaaaaaaaagaaaagaaatacaattagcaccatatgtcaaaatgaaggatacaaaagcactcagtgcacaggttccataaaccaactgaagccagtccctggtcagtggtctcttattaggaaaaagtcaccaaaatccatctcttgtgcaatcaaagctatagttatggcttgtggggtcagtgtctggtgatggatgaactgcaattgtttctatattgcttatctcaaggccagtgcttgtttagctgctggagaaaaagaaaaaccttgcagcagttagaacatagtttattctttggtgaacggcttaactcttgcctggcatggccttaatgtcttgtttatactttggtatcttattgctacaaagggttcattctctcagtcttatgatctctatttttttctttcttttttgagacagagtctcattctgtcacccaggctggagtgcagtggcaggatctctgctcactgcaacctccatctcccaggttcaagcaattctcctgcctcggcctcccgagtagctggaactgcaggcacatgccaacatcgctaatttttgacagagtctcattctgtcacccaggctgaagtgcagtggcgtgatcttggctcactgcaacctcagcctcctggattcaagcaattctcctgcctcagccttccaagtagctgggacgccacacgccaccatgccctggctcaagtgatccttctacctcaggctcctgagtagctgggaacacaggtgcacaccatcatacccagctaacttttatattttttgtagagacaggatttcactatgtggcccaggctggtctcaaactccaggctcaagtgagcctcctgccttggcctcccaaagtgctgggactacagatgtgagccaccgcccctggacgtgatctcttttttttttttttttgagatggagtctcgctctgttgccaggctggagtgcagtggcatgatcttggctcactgcaacatccgcctcctgggttcaagcgattctcctgcctcaggctcccaagtagctgggactaaggcatgtgccaccacacccagctaatttttgtagttttagtagagatgggatttcaccatgttggccaggatggtctcgatctcttgacctcgtgatctgccaaagtgctgggattacaggcatgagctaccacgcccgaccttttttatttttgagaccgagtttcgctcttgttgcccaggttggagtgcaatggcgcaatcttatcagcaacctctgcctcccgggttcaagcgatgctcatgcctcagtctcccgagtagctgggactacaggcatgtgccatcacgcctagctaattttgtatttttagtagagatggggtttctccatgttagtcaggctggtctcaaactcccaacctcaggtgatccacccaccttggcctcccaaagtgctgggattacaggtgtgagccaccgcacccggcctgcctgcttcctttccttccttccttccttccctccctccttcctttccttccttccttcctcccttcctttctctctctttcttttttttttttgagagggtctggctttctgtcactcaggctggaatgcagtggtgtgatcatggctcactgcagcctcaaccttccagctcaagccatcttcccactccagcctcctgagtagctggaactatataggcatgcaccatcacacccagctaatttttaaaaacatttttctagagatggggtctcactatattccccagtctggtcttgaactcctaggctcaagtgatcctcccacctcagcctcccaaatgaaatattcctaaacccagtcacctagcctccctacctatacccactgctaccctgggctaagaagggaaggccattgaagtaggagacaactaggaagtctgatgctggttgggaacgatgcgtttcaaggggttggtcaaaacaggaaatattactaaaaggttaagtgcaagcagtgatcattgcaataattttgcaacagtgtttggtgactcattgattctctggaatttacttggtatatagagtgaggtaaggtcaaaatatcctctctccccctaaaaggcaaactaaattttgtaacaccgtttcttgatgaggccctgtttccctacccatctctgttgttccctctatcatcccatagattctcaaacttgtaccaggtccatgcaggctgtgttctgtagggagggctctggcactcaacttacccttcttactctgtttgatacattcacctatttattcttctagatgtttctttttattttttaaatttacttttaatttttttaaatagagatgggattttgccacattacccagcttggtctcgaactcctgggctcaagtgattctcctgccttggtctcacaaagtgctgggattacaggcatgagccactgcacgcagctttttttttttttttttttttgagacggagtttgctcttgttgctcaggttggatggagtgcagtggtgtgatctaggctcactgcaacctccacctcctggttcaagcaagtctcatgcctcagcctcccaagtagctgggattacaggggcctgtctccatgcacagatagtttttgtatttttagtagagacaaggtttcaccatcttgaccaggctggtctcgaactcctgacctcaggtgatccgcccacctcagcctcccaaagtcctgggattacaggcgtgagccaccacgcctgcctgttctattcattattgaaagtggggggttgaaatatgaactataattgtagagctgactactttcaattctgataatttttgtttcattatttttggggctccgttaggcacataaatgtttctaattgtcatattgccttgttttgaaacttttattaggtgggtggatcacctcaggtcaggagttcaagaccagcctgaccaacatggataaaccccgtctctactaaaaatacaaaattagtagggcatggtggcgcatgcctgtaatcccagctactcaggaggctgaggcaggagaattgcttgaacccgggaggcagaggctgtggtgagccaagatcatgccattgcactccagcctgggcaacaagagcgaaactctgtctcaaaaaaaaaaaaaggctgggcgcagtggcttacgcctgtaatcccagcactttgggaggccaaggcaggaagatcacgaggtcaggagacagagaccatcctggctaacacagtgaaaccccgtctctactaaaaatacaaaaaaaatgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaagtacaaaaaaaattagctgggtatggtggcagacacctgtagtcccggctactcaggaagccgaggctggagaatggcatgaacccaggaggcagaggttgcagtgagccgagattgcgccactgcactcctgcctaggcgacaaagtgagactccgtctcaaaaaaaaaaagcaatttttatcaatagataacgtccttctttgtctcttgtaatctttttgatttagaggctactatacctgacaataataaagccaccttgactctcttctggttgctatttgcatgaagtatttttttttctttttctttttctttttttctttcttgaaacagagtctcactctgttgccccaggctagagtgcagtggtgtgatcatgactcactgcagctttgaccttcctgagatcaggtgatcctcccacctcagcctccggggtagctgggactaaaggtgcacaccaccatgcccagctaattttttgtgttttttgtagaaatggggttttgccttgttgcccaggctggtctcaaactctttaagcaatccacctgcctcagcctcccaaagtgctgggattacaggtgtaagccaccatgccaggccataaaatatttcttccatccttttacttctggtgtttttatgttcttatatctgaagtgagtctctgatagacaacatatagattaaccttttttaaaaaaccaatctgaaaattcatttattaataggagagtttaatctatttatatttaatgagattactgacaaatgatttgctttcaggttcagaatttgtttggtccctttaaaatttttctctgtattaattttttttttttttttttttttgagacagagtcttgctctttcacccaggccacagtgcagtggcactcttggctcgctgcaagctctgcctccccagttcatgccattctcctgcctcagcctcccgagtagctgggactacaggtgcccaccactgtgcccggctaattttttgtatttttagtagagatggggtttcactgtgttagccaggatggtcttgatctcctgacctcgtgatccacccacctaggcctcccaaagtgctgggattacaggcatgagccaccgcgcccggccctctttattagtattctttatgttcagacataattttcctaatttcctttagttctttgtccatggcttcccttagttcattgaacatactaagacagttgatttattgtttttgattaataattccaatgcctgggcttcctgagggatacttcccatcacaatctctttttcagccaggtgcagtggctcatgcctatgatctcagaactttgggaggctgaggtgggagagtcatttgagttcaggagtttgagaccagggcaacatagtgagaccctgtctctcttttgactccagcccacttcccctcacttggaggacatcagagaggctgtggcattttcggggtccagccaaagggaaggtgggttgaagatggtcccaggttgggttctctaggaatccaactccaagaggaagatcagagcacaagatatttacaagagtcccttgagatgagcacctcagggaaggagggaaagggttgggcaaggaagaagtctggctataggggctctgccacagccagagtggacctgtctgctggccgtcccctgagtggctggcagcagctggcctttgtgtggcatatctctgagtctaccacagggacacactgggtgttataagtaaaatgtttattcagaaacagaatgctgttcttcagtaccgcaaggaaaaattagcattgagacaaaaagttttctcagcaaggcaaatttactttctgcagaaagggtgctccttgcagatgaaacaatggtgagagcacacttgaacaaaggagggaagcaatttttattctttatgcagcttgtccttgctactgtgtcctgcctccattggctggagacggactgcacaatctaagctaaacttgaccggctaataacttaaaattttcttaaataggtaaaggcaagggagaacaaaggaaaagaggaaattgcttacgaaaggacttagaaggacttagaaaagtaataacatttctttttttcttttttttcttttttgagatggagtcttgctctgtcgcccaggctggagtgcaatggcatgatctcggctcactgcaagctctgccatgggttcacgccattcttctgcctcagcttccggagtagctgggactacaggcacccaccaccatgcctggctaatcttttttgcatttttggtagaggcggggtttcactgtgttaaccaggatggtcttgatctcctgacctcatgatctgcccgcctcagcctcccaaagtgctgggataacaggcgtgagtcactgcacccagccaaaagtaataacatttcgaaataaggaaggcacataggctgcaagctggaatgtgcctgtgagcatgtccagcacaaatattttggttaaagtacaaggacacagaatgtacttatttctttatatctaacagctacataagatagggcttaacaaagagttattagcacaaagtgaggaggcttaaaggaagttagtctttaaaagaaactattatttgtaacacttataatttattctttaacaagaagggaaactttgaagaggaacttttttttttttactttctacaccaggttaagagggacatatttatgtggtttgctccacccttgtgtaaagttagtttattggtcttgttctagaataaactaggaatgtggctcgtaggaaaatcctgctgggtaaggacagaagtgcaaagtcctattgccttaaggacatgccccacggcacccagtgctgggaaaactgtgagccatggaaggaaaacaaggtttgaaatgcgtggagccagaacctcgtctgtggaaaattcttccaaatttcatagttcctatatgaaagaaggctgatgacagtttctcaaattttacaacaatccagaacatttgtatggcaccgtcaacaacagattaggaagtttaactttcctaaactaccaataattaaaacacaaatttcaaccatgttaggaggaagactgaagtatcttttctctgtatggaaaatatctcccccaaaaatcacaaaatccttgtcctctgtagaggccttcagagtaagaagccagaccatgtaggggaccaaggtattagaaatatgtcaggaagttgccacaagttatgttatttttctggatttagtattgtagtatttgtcaatttaaaaaaaaagttttcaaaaaaaagtatcatcatttcttttctcattattttaattcacttccatttttgaattcataacgttgttgcctttttctaaagcaggaacctgggacaggcactgtggctcatacctgtcatcccagcactttgagaggcagaggcaagaggatcagttgaagccagcctgggcaagatagactccatctctacaaatatatatatattttttaattagctgggtatggtgatgtatgcctatagtctcagctacttgggaggccaaggcaggaggattgcttgagttcgtcaaaaaaacaaaaagaaacaatttttaaaaaggggaaaaagaaagagaaagggattaaagtgagggtcccttcttttccagggtccttagagcaagggcggctgaggcactagagcatgtttgagactgccatagaaacaaaggcagctagggcggcctgcctgaccccaggttggggctgctggagccaagaatctggggaggggctgttattggagacagagcagtggcctctcaagggagggccttgcagggcctgggaagaaggaagccagagccagctgctgtttgatggcaggactaaagtcacctccctgaggtggtgacaaggatgggtgaagccaaagggtgtgcgactccacagtgatgggggcttggggctctcagtcccccatcagagatcctcagcatctggttccagcttcaccactgcccccacccctcttctcagctgaccaggtccctcctcagctcaccctgtgcactggagaggcccagtaccctcactcagcacttgaggccctttatcatgtgcactgcccaccttgcccatgtgcagagagtaccaaacacagcacgtggcttttgctcagaaccagaccgccacctggatttcccttcctcacacccatttcccctcagggctcagccaggttgttggctcctctgggcaacccttcctgagccacccaagcctgtcccgttggtaagtcctctcccatcacacagggagtccccaggtactggtcaggccagaggagcagtttttgtttgttttgagacaagttcttgctctgtcacccaggctggagtacagtggcacaatcttggctcactgcaaccactgcctgccaggctcaagccatcctcccacctcagcttcctgagtagttggtactacaggcacacaccactatgtgtgtgctcagctaatttttgtttgtttgtttgtatttttcgtagggatggggttgccatgttgcccaggctggtctcgaactcttgagctcaaatgatcctcccacctcggcctctcaaagcgctgggattacgggtgtgagccaccacgcccagcccagaggagcagttgtgtctccaggagggatccttagggaggaaaggtcagttggtgggggcaatggagcagtgtgagccagcctatgccccacctgcccgcccgtcctggacaccaagtcagctgactctaaaagctgaaaagggacacacggtccagacaggcctggaaagagcagacctggcccaggacctcaggctgtcaggcaaagagaggcacatgttcggtcacccactctgggtggaagtcccctttatttggatttgccgctgggtggctagatgacgtaggtggccttcgatgtggaccaggagggcatccagcatgtgcaggaccccacggagcagggtgtggtctgagattggggcccgccgtttccagggtccgcagggctcagtggtcacctgcggatgctgagaccaggaccaagaggcaggagtgagaatggtgggcagagagggagatgtgacaaggggcagtgatggagctggggagcagggagtagggtgtggggcagtgcccagatgggatgggagggagactcagggtgatagaggatcaccgagggtctgttgtgggctacagtggtcatggggcccacaggggctggatgagagcaggggtactaaaggggagagttgggggcagggtgctggctgtgggtggtggacatgggttccacgaaggtgtgtggacacagggacaatgggctgtgagctgggggtgggggtgtgggaggtccacaggccagtgtggacccatggggcagggttgggtggaagacgggctcactgagcgtacgtatattgaggcaggggctgtgggggagaaagaagagctgtgctcacctcacccttggtggcctgtgagcgccgccgcccctgcagtatcttgcggcagatcatcagcatcgtggtggtgatcatgaccgcagccacggggtagatgcggcttgctccagggcccagccagtagccaggacagctcaggccacccctacagccctccacactctttggctgacacccccagggctgcaagtccagccccacctggtaccagaggggtctcgaccaggcgtgggtggaggcagacgtcaccagcaggagcagcaaaggcagcgaggccagcacatgcagcatggccgtcgctagtgccagggccggaacccgggcacctggcaacgggcaaacgcccctcccccgggaagaggcctggctctaaggcagcaggttccagccaggcccatggcctttcatgagcagcctggccagaaactggctgtggtcagggggctggagtccagggcttgaggacaacggcagacctgggttctgggtcctgctgtcccagcgggcctagctggccccaaactgagggagcacctccttttgaagctgggccctaggctgggtgtagtggcacacacctggaatcccagcactttgggaggttgaggcaggtggatggcttgagcccagaagtttgagaccagcctgggcatcacggcaaaaccccatctccataaaaaatacaaataattagctgggtatagtggcacatgcctgttgtcccagctacccaggaggctgaagtgggaggatcacctaagcctgggaggtcaagactgcaatgagctgtgattgcaccactgcactccagcctgggcaacagagtgagattttttctcaaaaaagataaaaaaagaaactaagtcccaaacagttaaagaaaccagtaactaacagaaattctttttttttttttgagacagagtcttgctctgtcgcccaggctggagtgcagtggcacgatctccgctcaccgcaagctctgcctcccgggttcacgccattctcctgcctcagcctcctgagtagctgggactacaggcgcccgccacctcgcccggctaattttttgtatttttagtagagacggggtttcaccgtgttagccaggatggtctcaatcttctgacctcgtgatccacctgcctcggcctcccaaagtgctgggattacaggcgtgagccaccgcacccgaccttacaaactttttttttttttttaactaggctgggcaccatggctcaggcctgtaatcccagcactttgggaggccaaggcagatggatcacccgaggtcgggggctcgagaccagcctgaccaacatggagacctgcctctactaaaatagccaggcgtggtggttcatgcctgtaatcccagctactcagcaggccgaggcaggggaatcacttgaacctggaaggtggaggttgtggtgagccgagatcgcgccattgcattccagcctgggcaacaacagcaaaactccatctcaaaaaaaagaaaaaggccggctgtggtggctcacacttgtaatcccagcacttcaggaagctgaggtgggtggatcacgacatcaggaaattgagaccatcctggctaacatggtgaaaccccgtctctactaaaaatacaaaaaaaaaaaaaaattagctgggcgtgctggcacacccctgtagtcccagctacttgggaagctgaggcaggagaatcacttaaacccgggaggcagagtttgcagtgagttgagatcatgtcactgcactctggcctgggcgacagagcgagactccatctcaaaatacaaacaaacaaaaactagctggggctgggtgcggtggctcacccctgtaatcccaacactttgggaggccaaggcaggaggatcacttgaggtcaggagttcaaaaccagcctggccaatatggtgaaacttcgtctctacaaaaatacaaaaattagctggacatgatggtgggtgcctgtaatcccagctattcaggaggctgaggtgggagaatcacttggacccaggaggtggaggttgcagtgagccaagatcgtaccattgcactccagcctgggcgacagagcgagactccgtcttgggtggggggaggtgggggaactagctgggtgtggtggcatgtacctgtagtcccagctacttaggaggctgaggcaggaagatcgcttgagcccaggaggtcaatgctgtagtgagtggtgatcacagcactgcactccagcccggggaacagagcaagagccgatttaaaaagaaaaaaaaaaaaaatccacacggcccctaaaaccttttgctttccaccaggggcatcacctctctaggctgaccaaactcgcaggtcccccacacccaaccgcagccccacagtccacatcgcagttgggtgagtgctcaaagatgtgggatcaaaatccacaggcagctcccccgctgtcagaacaaagcccaaagtctccccctggactgtgaggtccccccaccctctcacctcagctcatgctgcccctgcctcccacaggcctgcctcaatacccccactgccagcaccacagctccccaggcctagaaagtcaccttctttcttatggctggaatttcagttccagggtcacctgctgagtccccctcccatgagcatcttgggtaacatatgacctcttctatcacgtgaccctgctttattttcttcaaagcatttctaactacctgcaatttcctgtttgaggtctaaactgccctctccaacatataagcttcattcaaacaatatttactgagcagctgccaggcaccatttctgatgctaggacgtggtgtgacagagtaaataaaagctcttatttcctggggctgaacttctaggccatgagttggggggtggggggtgatggtgccaggcaccaatacagaccatgataaaacagagccaggcaagggtacctctgcgatttgaagggcagggtggcctctgtccatgctcaggatggtgcccagacccctgcacagagcctggcacctgctcagcacctgatgaacagcagtgctcgcatgtttggaggagaggacctgagcccagcattgttttcgcatttcctggcatttcctcatttatttttgagacagggtcttgctctgtcacacgagctggagtgcagctccctccagcatgatttcagctcactgcaacctccgcctcttgggttcaattgatcctcccacctcagccttcccagtagctgggattacaggcgtccagcaccatgcccagctcatttttgtatttttagtagagatggggtttcacctgcctcgggcctcccaaagtgctgggattataggcccggcatctactcatttaatattcactgagcaacccctgaagcaagaattgtagccactcacgctctaccgatgaacagcacactgaggcccagacagatcctaagacccggtccctcccctgccatcactgtcagctgacccaacgccccactgcctgctgggtcacatgcccagatgtcggcatttaatggcagaaatcaacacacactccttggctgacagtgttctaccatgcccaggtgatctgtcacccatgcggggcatgatctgggctcattgcaacctctgcctcccaagttcaagcgattctcatgcctcagcttcccgagtagctgggattacaggcatgtatcaccacgcccgactaacttttgtatttttagtagaggtgggatttcaccatgttggccaggatgttcttgaactcctgatgtcaagtgatccacctgcctctgcttcccaaagtgctgggattacaggtgtgaaccaccgtgcccggcccggtcatgcttattcttaagcatagagcagcagtgtgggggaacagctgctcctaggtgttcactctgtatcctccagggactgcccattggcacccacgctgccctgtaccttctcgggtattcctgagagcaaattattcctgagaagcagctctggttccaactgtttcacatctgaggagacagcgagtgagggctatgcatggctggggagagaccttaacaggggatgcctccacagctcccctgctctgtaccctaacctcccgagtccttcctacaccttctgccccgtctcaccttcagggcacaggaagggtcagcagccacagctgtggaccacccaccaccagggccccaccaagccacagcagagactggagttgagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcacctccagaggtgcagtcttgggcaggatgtagcatgttcagagtctggtgacctgagcaggcagaggaggggaggctctagtcagtttccaaaggacacagaccaacccccgcccctagaacagctttatccaaagacagcggagaaagcactgggcccactggggacagagccatggccaccaggaaagactccctggagctggggccagggtggggacaagcaatagattaacaaaaaagagcttggcaggccagaggtaggctcaccgaaacagggctgtcggggacaggcctcgggtgttggagggcaaaggtgacagcatcatggacagaggcaaagagatgcttcttggtgatggatgcatcgaagaagtgcccagcctcaagctggctgaccacagggcctgtgggcaagaagtaggcctcccctgactctcagaacctctaggaactcaactcccgggagccaacagaatgccctgacctcatcacccctgacctccacccctgaggctacagctgaatccacatcacttgtaaccctggactcctgtctcccaggacacctctgacctccagttccagagaaagactttttccttgtgctacttggaaaaccccttggccaaaagtatcctaccctcttcccaggtccctcctgctgttcccaccctactcactgtggcaggccgccatgtacacctccacctcaatctcccggaagtcatggaaaatctgtagcggaaaagggggccagcctcagagggaggctcagggactcagaggggggctcgggcaggcttggggagggagtttagaaggggagctttgagggtttggggagtcagaggctgggagtgctctcagggcaaattacagggtcagtgtggaagctcgaggggccttggcctgcccccgtccttacattcttcaggctcttgaggcacacagtgtccacaaaggagagggcacccaggtccaggatgaggctgtggaagtctggctgaggcaggcccagggccttcagtgtggacccatctggggccttggagtcttcttgaccattggctgttgcatcttccatcttatctcctgagctcacctgctggggagccagacatgctgccagggccacccatgagagagtgaaggcaggactggccgcacacagacacgcgagaacacgcaaggtcagatggggagcatgcatgggacacataaggacacaaacatgcgggagtcacataggtgtgcaaagacaggaatgacagatgtgtggggacatgcaggagggcacacccagatgtgcatatactgctctgctacctcctgggccgacgctgcacagggacacgagaagggagtccctgtcccattctcatcagccagggctgagtggggagggggcccaggagcaggccagaatagacacgggcatccacatgaaacgcatgcagacacctcggcaccctgccctgtctcagtctctaattaagtttggcatcctctttgacccctcaattttttttttagagacggggtctcgcttcattgcccaggctgaatgcagtggttattcacaggcaccattagagcgcactgcagccccgagctcctgggctcaaatgattttcccgccttagcctcccgaagagctgggactacaggcgcgtaccaccacgcctgcctttgaccccttgattttctcccatataccccatccctttcctctacccatgagcagactctgggggaagtcttgtgggatctacaaattcaaggtcttcatctaggcctgagaatctaagcctagattctgtggcatatcacgacgctccctgaagaatatctgacccagcctccccactcctcctgccatcggcgcaacaccctcgagcccacagctgctgggtccatggcattcctcatgagacatgtggatcctgcatctctgcagctcacagctgtcacctcctttcccacctccagtctcaccatcatcttgcagtcctcaacgttgttgctcctcatgtcttcaaggctggtgttgacattaatggaaactgaggcgcccttgggggaggcagcctacaccagggaagacagggaatgggaaacagctagcccggctgccatgacagccatgtcacataggcctggtgatgccccctggtgctgggcaggtgggtgggccaggaccagaagctgtgggacctgcagcagccaggctgaagctcctggaacagccgtgaaagggaagaggactgtgacggttctcactgtcactggttcagatgatgggagagaaaatgctgcctagagcccggacctgctaggggagtgaagcagggtccctgggagcatgagggagaaaggggaagggatgaggagtgaggacgagggaggagtcgggggccaggagaaaggctggggcagggaacagggggcaggagatgggggtcaccagacaaaaggggccctgcctgtttccgaagcttctcctctttctgcagttgcttcagcttcagctgctcctgcttcttgagcagtttcttcttctgggagatgaggaagtcgacatccacaccacactggaggcaaacatcagagaagggttggtgagctctctgggagctggggcctgacacccatcctggggactccgtctcaccctctgcttcagcgcatcactgtagaactcagcattggcaaagtacacggtggccgaggagcggaagaccttcaccccccggacttccttggcctggggatgaggcagaactggtggtggctgaatctcctctctcctggctgcatcctgttctcctgcctttccttccctagtgtgcccagtgcctgccaccgcccagccctctgctccccaggctgcagtccaggccctcccaggggcttaggccacaagcccgacggtgtcatccccatccccccacagtgcctctccctccccacctctcctgccaccacccaggcaggcttcacaggctcttaacctttctcttgggtttccaacccctgccttgtgttctgttttctgcacccagacagaggtcctcctaggctgtcatatcaatcagaccttccccgctcccaccccattcgggtcacagcccgggtctctgctgggctccaggcatgcatggtaagggctgggctgccccctcatcctctcccatgtctcagaccccttaattcctccccgcactgcctaattgcactgtgcccatgttgcaggcaacagccttgttttattccagagccccccacctatgttcctagcacttggcccaagacctctcaggagataaatggatgactgaggacttagtaaccccactgatcagatcaggaaatgcctcccttccaacctggcgccccagggagctgccattccggctctctgacccacggctgctctgcaggtggagcttgtgctgttgactccacgacagacccctccccagccccagacccatctctgtccactctccctctgtcccttcatacctctagagggggtcatagacctaaactcctcccttgaaatcccaaagaccaaagccaaagtatcctcagcccccagttccctggccaagtgtggaacgaatccacaaaggctcattcttcctccgtctccccatccacaccatctcactcagcccctgacactcacctctgagtactctgccacatctctgtaaatatccgtgtctggcacctgccccaggacagagtagtggggcctgtgaaggagagagagaatgcacgaagagggggcagaaaaaggggataacagaggggtccgaaggagcctgaagtccccagagatgtggggaaagctgcggggagccctgtggtactctctcactagctggaatgaggggaccaacatggcggactcacatctgtgtccggaccaccacgagcagcagggagaagatgaccgcaaccaccaagccaaggtccaggttcagcaagatggtggccgtgaaggtcaccagccagataagctgagaacagagggcagcggttggagggcggcgaggagccatggggctgcccagtccctgccctgggctcccagtgcactcaccagatccgcccgattggccttccagagggagcgcatgtcgctgagctgcctcagcatgcccttcaggttcacaatgatgatggctgccaggaccgcctggggtggggacagtgccaccaggggccattgagggcacccgatgctgacaaccctcctcaccgaggcaaagccagactaagcccaagcactcaggcagtaccccagacacaaacccccacccagcccctgacccttgtctccaaatctcaccttgaagatctcagccttgaaaaacagaacctaaccttgtgtccccacccctcgcctgaacctagactggctgatttgagagccctggcctggccaagacctgaaacctggctgggtgggggctcaccttgggcaggtcatggaagagttccccaagtttgacaatgatgaggaggatgaaaagggaagagatggctccagcaacctgttcggggagggagtgagcaggggagagacctccttccccaggcaaagcaatgtgcatgcccacacccatgcccacacccaaagcccacctgcgagttgcccccggtgctctcctgtaccaggctccgagacatagagcaactcacggggaagcactggaagatgcctccgataaggttactgaggcccagggccaccagctcctgacgggggacagtacgggtgtgagaagacttcctagaagtggctggtcactgttccactgtatctaggcctgtgcatccccaatctccatccccaccaagtggcccccagagactggatgctgtcccacacgtcctgctctcccaccctcagtcccccacgtggcctcagcacatctgctgtctccctgtgtcccaccggttcctcccccacccgttgctggcgcctccatacacttggatgcctcctacacatcccgcatcacccagacctggttgctgtccacccggtagccgtgcctcagggcgaagatcttccccagtgagatggcaatggcaaacccaaccacagcgatggtgaaggcgctgcccacgagctttgagaacagctgggtgttgggggccactgggggcaccagcctgtgagaggtatctgtgaggccaaagcaaggtcctgtcctggctgcccaaccctccctgacctgatggaggccagagctcaccctgcagggatgttgcccacgacatctacctcaaatctgtgctttagacccatgccataggagatgcctgtggccccgatgagctgtgggagaggacagagtcagggaggcaggtgctggcaccatggtcagggggacacataaaccactgtgaggtgaggagggagatactgggcaaaaccttcttcgagggtgggaaaaagtcacgtagggtgagagacaggcaacaccatttcggctatggggagatgctgtcaggggcaggaagaaaccaacataggggctttctgctgtgccccccacaatacccaagaaccctcccagcccccctccagctggccctcaaatacaggaggctgcccacgtggcaaggacccagcctgacctgcccttctcccctgccctccactccctggccctcgaaccgtgagcagctccccgggtatcggcatgggcagctgctgctgcagcttgtcattcaacagcttcaccaccacgagcaccaccccagccacagctgcagtgaccacggtgccaaccttgctctggggcagcttccagcagacctccagcactgtctgaggagaggccaggtcacagctagcactcaaggccatggggcacacctacccctccctccccctaccctcactcacatagatgagggacagtggcccagagtggctgctcagatggaggccaaacacatacttgagctgtgagacgaagacctgcacagctgcagctgtggtatagcctcggacaagaggttctgacaggtaggtgaccacgaagccgaagtggatcaggcccagccccacctgtggggcggccaggggcagtcaggagaggcaggggtcctggggttgctaatgaggagcgcagggcaagtgggatgggagggggatgagtagacggcaagaggaggacgacgatggtcagacactcaggggagtacagacaggacagtggcgggagcagaagtggtggtggggggcacatactcctgactgttccacacctggaagaggccaaccaggacactgagtgtggaggccacctgtacccgggcagcatctctggctgtctcattgatcatggagtcgttcaaggcctgcggggccagggattctgtcacactgcccaccatcacagacatgacagcaaaggtccctgtaaggacggcacggggcaggtctgaagaggagaggacactgccctgccctggagccctggtcttaagagagaggccaggagacttccagttctggataaatgtactcagattatggctgcatgaacagggacagtgctggcggttcaggtttggccaggccaggagtaaaccctgagctcacaggcccttaagcatggctagaaatgctggccctgtctcatctaccctgtcccacctgtgtctactggtcccgggacacagaggctctctgtggagtagggaaggggtcagggctggccttaggctgctcaggcctctgccaagttccaggccccttgggctgcctcacccactctcatcttcctggagccagggctttgaggtcacctgcctctgtggtcctacagtcaggggtctagtcctgcctggggatgactcgtgggctagcccagggatgcagcaccaatgctgccctcttccccagccgctcctgccctgctcagtgccccctcaccctgccctccatgatggatgtgggcatcctcctggaaggctaggcctgcctccacttacccacggagatgtgccgggaagtgccaaacaggaagtagatgaagacagggtagaaggagctatagaggccaaacacggggggcaatccagccaggagggcgtaggccaagcctaggggtagaatggtagcagtgcaggcctggagagcagatcttgaaacgataagggaatcccagccctgggttaggtgccatagttccaaggtagaggtcatggccccagttttgggcatcacagaccacagggtttccaggccgacgcactgaaggtggctcaccctgcggaagctgcatgatggccacactcaggccggataacaggtcacccaggagccagtcacgcacaggataccggggtaaccagaccaaaaccgggaggtgttggagcagaagggcataggcccgagcacgggagcacctagggacatgatatgaggggtaggtgtcaggaacaggggctacctgggccccgccagcgcccccaggccccaatcttggccttactgcaaccaggtccgccactggtgggtcctaggtgctgagccccagcgccccagctcctccaaatgctcctggttcagcagcggccgttccatgtggtagtctcgcctccgcaggtccattgcttgtgttgcagacagcagtgcctgtgtgtccctcggtctggggtggcaagaccagagagacacagtgaaggcatccctggcccaacctcccctacacctccacctaggaccagagagttacctacctgatttttccaggccctaagatcaaggtacagtattccagcccccagctggcatctgtgggccacatgtccaaactcagacaggggcagtacctgaactttggctggtgagaaagcctctttctaggacaaagtcccccaagtagggactgcaggatgagcactagctatacctccagccgagatgtggcagcccagtgctgagtgttctaccagtccaggtcccaggctgctccctcccccacccagtccctctccagtccccaggtcctcctccagctgccccgggagcccactgctggctgagagcacactcagggaaggggtccagcaaaccaggggtccagctcctcaagcaactcctttcccaagcctcaggcctcagatgagaccctcccctctaagggaaggaaagtgttggagccaagcttgcccctgggcctccagccccagggtccaggttgtagacggctcaggcctgttatggggaagccaaggactggctctcacctgagaaggagcttgctcttggagtggcaatctctcacctagagggagaggctcccacatggaaagggaagtacccacttgaagtgggggaaagagctcacctgggaatagaagctttcaaggggaatctcacctagagggatctctgacctaccagggaatctttatcagcctggcaagttctgatacagggggaatcttccctctgcccagaggcacctacttgaagtcagagaaagatctcacatgggaagaaaagacctagagggagagggttctcacctggggggtactctcccatagagaaagctctgacctcgggcgaggctcccacgtggaatggggaaaagctgtcacctgggaatagatctcacagaaggatcttacctgggggaaaactctagcctgttggggaagctttcaccagtcaggaaagttctgatctaggaaaagccctgacctggggagaggatcccatttgagggacaggaactcacctgggaagcgcctctaacctggctgtactgttggaggagtgtggagtgggtgcaaggaagatcctcagagactcttgggaccgctatctcaaggagatcgtagagccccctctcctttcctacgtgagtcactcaggtcttcttaaagggctccctcccccgacaacttgggacccgcgtttggagggcggagccttgatcattggcccctccctgtaggaaggcaactggggccagaaaggccggagcgctcactccgggatcagtggagctgggtggactcgggactcagctgaaagcagctagtccacgggccgctgccagggactcccgtgccccacgcacccccgccggcacatctcctggccgggctcctccgcacgcagctgcctccctgtggcccgggatggccctcgggcgtcacaccagcggctttccgcacagcccaagggactggggtcgcgccggctcccgcccccaccccttgctgcagaggggcagccgcctgcagaaaatcagcagaggtaaaccgaggcgtcgcaagcggagaatgcctgctccagcgaggcgtcgcaagcggagaatgcctgctccagcgaggcgctcgcgcggggccaccgggaatgtgcgctgaactcaccccgacgcatccgccagccccatggctcgcaagttgtccggtgcgggctgctcctgctgctcgagctagaggccgctacgctccggaaggcggcgccgggaccgggtgaggccagctgcgctctcccgggggctaatcccggggcaggacggggaggcttgggccaatcagcgcgctggggcggggcctaagtggcgcgcgccgggcggggagagactggagaaggaggatttaaccgcttcctccccggcgacctggcctatgaggcctctcgctgctcgcccggccctctgcccggagctggatgggactgcagaactggaactaagcacccgcgccgggctggccgcagtcgcgcccccaggccctgagtaggttggagctgatcccaggtcctggctcggcggaaggtgctcacggagtgggaaaaggaaactccactggccggtgaccccagccttaactcgtaggggatccaggtctgtggggcctctcttgccttcagctgagagcgccacccgcaggctttctgcgactacgcatctctttgagacccggagccaacggtccccaagtcctcccctttaactctggccacccaggccagaaatggttggaggatcccctccgctgcactaagcacagcccggacgtagctcccagaaggttactgcgcgggccgccgaggagaatggtgggggtcagtgctgttgggtgggcgtcagtgctgttgggtgggcaaggcaggaactgcaagagcagttcctcaggttggtttcaccgcaggtgagggcaaaaaatgccgggtcagggctgcagaccctgaagaattaggaagtcctgttgccgttgccttgaccagcggggaggttttccttagcaccttattttcagcacctgtgctccaacatcaggccccaattacaaagtgaggggccagatttcaaggtgaaagagatctgccatgaaatgggctaaaaatagctggatattcttgggaggggctcagattcctcccaaaggtcagtctggcttgaatcattcacagcttccatcctacctccccagcccccaacaggaaaaggcaacaactgttttctatagaagtttattcccaaaacagagcgcggcttcacggaacaatttacacagacaggaaagagggccgctgggctggaggaggggaaccccagagaggggcatctacgaaacctaggacatagtaaagacaccctcccacccccagcaggccactcagcccttcaagagctggggtccttctcggtaaggagagtttgggtcctggctggtgggatttagctccagtcagggaagtagaatttctaatctcccaggaagctgcttcccaagagtatgcatggggtggtgggtgaggaggtgtctgcacagaccaccccccagccctgcacagccactctcccccgtggttagaggacgcctactctcaaggtcttctggatctgctgttaaacgggactcaaggctgaccttcggcctgggagacctgggggttagaaaacccctcaagatggccaggtcagggtcctcacaggtgggtcctccaagtccctctcccactttccctacctttcacttggaaacaaaggaaaaaaaattatctactgtaaacaaagtgtaaaactcaaagttttgagttgtaaacaaagtaaaaacattttttgaatctggacttgtaaacagtaacaaaattttaaagtcttcagttctggacagcagacaaaatagcaaaagtaagagttttgtgaacagggtcgtaacagtcatttttccctttttaagggaataaaggaggagtggaacggagtcacttcctgcagcccaggtgcctagggccacggaggatcctgtaaacataggaggcagtggcacctacattctgggtcttgaattcccttgtttctgctccctttgctcaccttcccaccctacccttcggaatcaattcaagcagggggcagtgtcagggaatcaaatggcaccacagacaacttttgcttgctgcaggggcaggtgaatgacccctccaccgaccctctgcaggaatgtctgactagaggcccgagcccctccccgtgggagacagggaagccttgctctgtaaacacgacatcagctgctccaccagcaccccacagcatcagtcctaggtcataaggcagtaagtggcagggactccacataataaacacacacatccaccaggaggggcggtatgagcaagcccccatgaggaagtcagaggacccctgtttccaagaccaacccccagccccagaagtttggcctttggagcattcaataaaaagcaaagaacaattctgtactttgggcccctgacgatactcagatcaacttgggggtggaatagggggaggaaggcatgtgtcccacccatctgagtccaccccaggaaggagagagagatgagcatagggtttgctcaggacccaaatggggtcaaactgcatctctccctctatctccctccccctcccagcccagcctcaaaccccccaggagacagaaaagctgaaaaataacataagcatctctctggttacaaaggtacaaaacgtataaaagtctccctccagtcccccgtctctgcacctgtcacacgcatgctcacagatgcacatggagcctcagccctgccacaccaggtagagctggggcacccaccactggggagcaggaggctgccttgggatctgcccccactcctggagtctctcctgttagcctagatcctctgtcgccctcagctgttcctcgtccacgccgtcatcccctcaggagtgaccctcacttctgggaactctggaggcacatgaggaaatcagaggttgatgcccagaggactccgagtcaggcggctctggactcccccaccacatttggcctggctgcttcccttgcctccaccactgctctcgcctcttagcccccagccccttcatgcccactccagggttctcagagtcctccattccgcgcccctagactcagccaggctccttggctgcccaggtgttttctctaagtgcttcaagagcacctactgtttacagatgctatattgagcacttgacagatattatctcatagatttccacatctcaaagagtttgttactacagacttctttacagatgaggaaactgaggcccagaaaagcttgcctctgcctaaggtcacgcagctagtaaggtaagacacagagctcaaactcaaacctgtgcgactccagagcctggacccctgctcagtccctagtctacctcccaaacagccagaccccaaagctagactgcagggggacccaggccgtgggttagctccctctggtccccacccccagcagccctcagtgcccaagccccaggatccccaaacccctgctctttcctccttcctttgtcctctctctgccctgggtcctgctcagttctgtcgatcccctgccccacccctagggcccccttcctccccaagccatctcttaccccacaaacccccagagcctgacccagctgtttctcctccttgaaactcaactctcctcttggcttacaagagacctggaagctcctggttcctccccactcccaccagtccctctcggactcctgtgtatccagctatttcctgggtctgtccgccatccccttccccacagatgcttcacacatacccgagatgaaccaggttccaactcagttcctgtgagccccaccccaaagtgtccacagacaggaggaactcaatgttgactgaatacatcgatgaatgaatgatttatcctcaacaaagcaagcccttcagcctggtatatcctggcaccacttccagcctctccttgtcctatatgaccccctaggcgaaccttcccaagcaaggcctcctgctctcctccctgccccttgcatattccaggtcatctcccacttctaggcctcagctcctgccctcccattcgctagctcagcccatcggatggcacctatttctccttagcctgggaggtgctgggaaggctggctggctccagtcacacagccagcaagtccctgctagtcacacccccatttcttgccagattcctgtccccagcctgtggccctctggctgtgctgagcctggggtagcccacacctgtctgccagccctcatccccttctgtggcagaacacagggcagggcacacaggaggttgccctaagctgatgagggtgcaagcaggtggctggaccatacttactctgagtctggcgacagctccgagatgctgtgagacgtggcagaacgtggcgtggagggcccaagcacagaggctgtggcagaaggtgtggcagtggtgtgagggcccaagggtgtgcttgaagattgcacagaggagagggccgaggagttgaaagaggcaaggatggaggaaagaatgtccaactgttctgtggaggggccatggctggggccactgaccgagtcctccctagctctgagcagctgcgggagtggcccaagggcttctcgtgaggggtgccggctaggcacctggtccagctgctcccgagagttcgagctcctagacagagagtccagcggccgggatggcaagagggggtcccttgagagttgccgctggggagacaggggcagaggtgggggctgtgggtcaaggtcccgggtgcggcggggcggaggcagcgtgctcaaccactctcgaggtgcccctaagtcgagcgcatcccgtgacccgaagcggccagccatggcgccagggtagtcccgaggtggctgcctccgtggcagggtgctgccccgatctttgggctccagtcggcctggtgcagcatccatgcattcctgggaccctggccggctcaggggacgtagaacaggggcaggggcttcctctagtcgctcacggctcagttgccgccggaggagcaggtccagctgttctctagaagagtagcggctggctggctgtgaaaggctgcccgtgcccccgccagcatagatgcgaccgtaagaggcagctggcacagcacggtggcccaaggtggctgcacggcaccaggacagctcaggggcacctcgggtctgtggcaccagtgggtattgcaaccggttcttcaggatgcctgtgagaggaagaaaatggggggcagggtttgtgtgggagggggagggcaggcaggaattgctgagtctaggggtgtggcagcccttgggatccttccaacacagggatgggagcaggaaccccttggggagcagcagaggcaaccctggtggtcccagagaggcagcaggacaggggtcagagtggaagggcagtcatcttccagttgtggtcccggggcagggggagggcgggcaggtctcatggtgcaggggatggggcaaactccctgaggtcagaagaggggcagccctcaggtcctgacaatgcaggcctggctgaaatgcaggaaccccccgggttggacaggagcagtccccaggtccctgtgatgcaagggtgagggcagaaacctcttctccgggtccccataaaagcagagtagggggcagaaatcttccagatcagagcacgggctctgggatctgggtggggggcagggggaagcagctcctagggtctctgaaaaacagatgggctggggcaggagtggtcgcctgtggtccccctgtggtgctggccagggtagagggggacagagaattcccaggtcaggacaggagcagtccctgaggaccgtgaagcaggctagagaagcagaagcgccctaggtcagagtaagaagagctctcagtttgggatgaggaagctgcaatcccttggctcagggcatgagcagcccccagcgtgtctgcggtgtgggccagggctcagggactgtacctttcctctggcgctgggcccggcccagagaagtctcatccccactggtcagggccgggtctggctggttgttgttagctgcatccttgctggtgtccagccccaggcgcctttcagagccccaagtctgcagagcacagggggctgcctcgcactcccccagggctggccagtaggacaggaggtcattgccatccacatctgtggagccaggtcaggttacaggagcttctgggttgatcccagtgactcatgacccctgaccctaatgacccttgaaaccctggctgttctcattgagcagaggtgggaacaggagggtatctcctcagagatcaatgggtgggggtgactggtgagctccctccccttaactggaggtggacagagactaaaagttggggaacctgatgactgaggggtcagaaagaccaggatgaaccccaaccgcaggaaagatggggagctggagggataacaaatggggcatcccttggtcacccaaggggtcagagggcgcctggcacctttggggtgggtgaggagcctctcactctgggctgctcggcagagtggccgttggaagcgcccccgcgtccggccattgtcctcgctttctgaagatggaatggagagactcctctcctcctccaaggacaggtcactgtcagagtcggagtctgcgcctggagttgggaaagtcagaagtactttcagaggtaagggacttggagataagggaatttggagttgagggtctagaggtgggtacggcaagggggttagggttggggacaggaaccggggcttgaagtggaggtagcagcagaagggctgggacttatcagagggaaggacgaatcaggagtggactgggagaaccagggctggagaggtaggtgcctcctgaggcagggaccctgggggagatcgtcccaccccagtcagccactgctcccagtatggggtagaagaaaaggggatggggagagatcctctgcctccctcctccctgccccaggccccaactccaccagcatctcgatggaacatggccacgtccaggtcagtggggccagcatgagcctggaggctgtggtcagtgtggtcagcggctgagccatgtcgaaccaggacattgtccctggaaaagcaggagcccccccaccatgaaagagggatgtgatggggtgccttggaggctggagtgtctttgagtgcacagccagctgcgggtggaatggcatccctgggtgtgtgtggtgggaagcatttagggcagaggcagaagcagggccccagatggccaagatgggtggagccacccgccctaggacctggtcagccaagccctggtaaggtggggctggactaagctgagtgttccctcacaaggaggctcttcctctcacctgaggtagctgcggccccgctggctgtcctggtcctgggtccggccggagcgggcactgctcacagaggagacggtggaggcgcccagagtgatgcggatgaggccactctcctcaaagagagccgtgttgttgtaggccccaggtccctgggggtggtagggacagagtgtgagctaaccctgaagcagcctaaaactctggcttctcagggcccccatcccgactcaccagcccaggtgctggccttgcctcctcaggcgctgccttcctgcccagacaggctggcatccaggcagcccgagcatctgcatttaggacacagaagagcagcagcaccgccaggccctgtgggtcagcgagggtcaaagcagagtcggcagggatcaatcagggaccagtataagtcactgtgggtcagcaatggggtcagtcactgtaggctagtgtgggtcagtgaggagcccatgcgggactcagtaagggagttggggaaggtcagcaggggagaggatggagcagcaggagtggctggagtctgtaaggtcggtgtggatcagcaaggggtcgggagccttggtgttggtgaaggtcgatccaagatcagcactcagtctgggatcagtgcctaagttagagtcagctccaggcctgggggcagcagctagggccagtgtctggtctggggtagtacccagcctggcaaagttatccagtaagagtcagctccaggcctagggtcaacgtctgcctagggatggccccagcctactgaaggcccacctggttctggggcaagggaggggcaccagagtcacctggaggccgcagagtccagcatggaggtagtggaaggctaggatgctgtggttgactgccaggagcccaaagagccaggaggcactgaccagcagaagcagcaggaaggagctgcgaagggtcctgctgtggggacatgggaagacacaggaggacatgcaaggctcatgtaggactcatgcagggaacacgggaggacacacaggggccacacacgaaacgtgaaaaaaaggaactcacacgggaacatggaggtctctggaggacactgggggagatgggaggtcccacaaagaaacaggagagcagtcaaagagccatgaggacacgtggggaaaacacaggggtatgggagccacaagggagggcacggaagacaggtgggaacacacagggcagggggcaaagtgagccacccaggccatgggagactctggggggacccagaggacaaggagagacagcagggcagaagcacatgtggggctacagtatagcgagggcgccagagagggaccacaggtcagggcaggtgtgacttcattccttcatctagaacttggagcccaacctgcaccagggaagatctgggggccccagaccccacccaggagggacctgccatcctgagaagcccccttcctccagccagccaactcacagtgcagaggtcttcttggcctccctctgccctgtggagcaggatgtgcgggcagcgaggagaaacatggtcccgttcatctggacccacggccagacatgtggggccgggcagggcagagagagagagagagagagaggcaatgagagacagagagagactaagattcacggagagaggcagaaccagtgagaaattcacacatatacacacacaccaaaggagcttagcatcacagaaaaagaaattgggaaccagagagggactgagagagagaagcagagacagaggcagggacaggcaactgaatctctgaccccgcgcccccatctccatgccagttgaatgggggtggctactgaccagaggacagaaaaaatgaaggccgagcccaggaagcctgcagaatgccacctgaccgccctcagctgagtccactgcacctcctcccccaatgagggagggaagtacagagggggcaccaagtccagggcactcaccactatgaccaggacaacagggccagcaaagctccagatgaggggctcgtggactgagatccagcagaagtcagggttcccatagccctcagggtccaggcccacagcaaggccttgggaagagaaagggtaggactgagggtgtgtgttccagagctgctgaccagcccatgtatgggagaaagcatgggtgagggcagagcagcaaccccatgaatagatggcttggggtttgaggttgggggtcatgagcaggagtggggacagggtcaggggtcaggccatgtgatggttggaggttgggggtcacagccctcacccagcagcacagcagggacgccccagcccagggcatggtagaagcgcatggcgccgcggtccacgttgcgtggctcaacctgcatgcggtagaggtgcagcccctgcacgaagagccacgcgaaggtgctgaggaagaagtagtgcaggaggatggcgactgcagtgcacaccagctgagggcaggggggcgtgtcaggacctctcctgcctcacccacctctgacccctaccccaggcatctgcttcccacctctcacccctaaaccacaatatcttaccccagcatcctgctgaaaaccctggccccaacctgagcatccctgacctctgaccctgagttttggccccaggcctcctgggccagtagggtcatcaggacacaagttccctggccctgatcctgcacctgattgtgggtcctgtgaatccccagcaggaagaggagctctgccacccccagggcggctgccacattggcatggatcccacgcacattggacttgaggctgcgcaggctcagcaggatggctgcagtcagcaccagcgcagccacagacacagccacgaccacgtgggtgaacacagccagcagctccaggtcgccctccagcctctacagagacagggatggttgatgggttgttgggcagaatccccgtgtccctttgaccccccacttccttgggacactgaacacagccccacctcacggggagaggcatccatgaggaccccaaaggtccctgtccggctgcagcgacaccgtgcgtgggacccattcctgtgcaccagctcgcagtcccgtgctgtccacacaccatgctgctccgccctgcagccacagggcagttagacacaactgtgacccagtgtcaggcaggggtttgtgagagatcatgggaagggctgagggtgcctggagttggggtacagcattcctcatggtccgggttgcacaacagcactagtgggggccccaggggaaggctgggactattagttggcctcccaagggctaacgggaccaagggtttccagaatgggggtcctcacaggccaggtgggtcccactgcacacagatcgccttgctccgattcgctgtctgtagcaggcgaaactctaggctgatgggggactccaggattccccttaggaagttgcgtccgtggaacacagccacgctgaccaccggggagttcatgacggggttctgaggaagcctggggagacacccatctgggcttacgcactgctgacctccccatgctcagcctgcttgcctcaccccgtcttcatgccactcgccagggctgacccagggtctgggatgtccccagagtggaagctgtttctaagaatccctccagcttctgctgggctgctgaggggctgagcagctccaggggacctgcaactgtttgcctctgattgccctccctcctacccccatcagtcagcctgtccttgtctgtctctgtcagccctttggtctgtctgtacctggctcatggatccctcctgtgtgtggctctgtgtctgtcagcctgtggctctgtcactctgcacaactccagagaataagattcacacagaacccggcaaggatggggctccctggagctgtgctcctctctgtgtgttgtgaacctacgcatctacccaccaaaaaaggggctgccaggctgagaagttcgtaggaagctcaggggtgaggggcctgagtacctggcacctcggcgttctgcctggaactgggcagggagcagtccccctaaggtgcggtaaacgaggagaatgataatggagatcccaggctctggctctggcggggctggtggggggaccacacttgaggtggtggagttttctatgctgctgcttgtgggcagaactgccaggagagaaggaggagcttctgtcagtgacctttgacccaaagcacccaccaacccagctctgaacccgatcaagcatgggggtctcttccctgcaggagcagaattggggagtgcagggagcatgaacccagaaagtaacagtcaaggcctgggaggggtcatttgtgatgagggagaggctctgacaaagtgaaggtgtggcaaggtggacagtggaggggagatgtgggagggagggtggaggggagatgtgggagggtggaggggagatgtgggagggtggagggtggaggggagatgtgggagggtggagggtggaggggagatgtgggagggtcgagggtggagggtggaggggagatgtgggagggagggtggagggtggaggggagatgtgagaggcagggtggtgggtggaggggagatgtgggagggtggagggtggaagggagatgtgggagggagggtggaagggagatgtgggagggagggtggaggggagatgtgggagggtggagggtggaggggagatgtgggagggtggagggtggaggggagatgtgggagggagggtggaggggagatgtgggagggagggtggaggggagatgtgggagggagggtggaggggagatgtgggagggtggagggtggaggggagatgtgggagggagggtggaggggagatgtgggagggagggtggaggggagatgtgggagggtggaggggagatgtgggagggagggtggaggggaaatatgggagggagggtggaggggagatgtgggagggtctgacactggggaggtctagaaaggggaaaattggcaggagggcaacatagtatctggttggggggacagagagacaggacttggcccaggggtcccctaggggctctcaccttcagatggggatggccgtggggactgggaaggcagcagcacatgggtgtgaggatcccaggcatcctggcctcgaaagaggttgctatggtagcgagggtagcgacgggccccccggggagaactggggtgctccatgcggtcaatgctgagcactacccaggagaaagaaaggggaggcccatcatggacctcttccccctgccaagggttctactccctcttactcgcatcccgcacctgagtcccacaatctgttttctgtgctaccagctcggagcctgtccctacaaaacgctgagggcggtggctgagtctcctgccattaacattggcattgatagccacagcccctcagaccttcaggtacctgccctttcatggcccccctgctgtgccccgccctaccccacccacaacgcactgatattaggcgtcaccagccccatgggattcaggtatgtgagttccatattccttgcgagtgtggctgcatactcctccaggtgcctcaccagtcccgcgctgcctggggagcccccaggggcccgctgccccagcgccgcccacaagtcccctgtctctggggcaagcagtgcagagccggcccacagcagattctgggaagacagagatagaattgggttcagccaggtggtgaggatgtatgaggggatagggcaggcatgagaggtctggacaggtgctcagaggggctccaacaggcaagggggcggggctggagaggacaaggacagagggagagcccaggaccttcacttcccaagagaacagcaggagcctgagctggggatccaggggcaggaggctgggagctggggggccaaggcactgagaacatagggcacagccccacctcattgaagtgggcatcctgtgtggctgtcagcccgaagccctgctgatggctctcgaaggccagcaggtgggccagcaggcgggcagtgactcgaacatcttggctaaaatagtggtcagtgtggccagtcacctcccgtagccgctgagccagcttcttggcctccatggtatccagtgccgtcttgttcagctctaggccatccagctgccaagacaaggagatggttgctctgtggtcccttaggccttcctctaaagcttcacagggagaaagccttgccagattaaagggcaaccaggaaaggctcaggagttcaagggctagggtgtggtatctggggcccaccacaggccaaggaaggtcttaggttgcaggaaaaggtctgggcagtctcaccagcagactgagctctcgaaaggcaggggaggtacagttgaagaggtcgggctccagccaaccctgggcctcatcacacagccgcacagcagcacctggaggcaggcaacccctggtcaggcctggggcctggatacctttgctgaggagataaccgcagcaccctctcctatgctgggggaatccctgaggcagaagtcagagtcatgagcatctatagctgcacccctggaggtagcggcccaagcccaggtaggccccagctgcttgtcaggcaattcctgagagggctgtagaccattctcaaccagcaaccacacaaagcacaagggtggggctgcacacactcacccacgtgggccaggactggctcatagatgtgctggttcacacagacacacaccaatgctcaccaattacacacagatgtatggaccagaccagtacgcagacacacaatgctctctcgcacacacacagacatgccaacacagaagagggcttctaggaacatccagtgaaagtcaggtgggaggattctcacacaagttttaactgccccagtggttactttgctgtcatttctctcccttgtctctggggttgggatggaggttgaatgagaattgacttggatcttaaaaaagtttgtagctaccaacaagagagagcctaacttaatcacagaatcccctccccgcaacaggttcacagacacgtgcacaggcacagagatacacacgtgagcatgcgtacacaaacaatctctgtccagccactgcagagacctcaagcagcagggagtgttctgaggggacctcaggcagtggggaggggcccccaagcagcaggaaggagctatagggtcctcagactgaggagggatctttcgtgacctcaggcagtggggaaagttctatggggaccccaggaactgagaaggggtcagcagggtcctcaggcaatggggaggggtctctgaggatctcaggcatcagagaagggcccctggggtactcagatagccagaaggggcctgcagggactttaggcagcagggaggggtctgcagggacctcaggcagcaggaggggtctgcaaaagctctggtagtgggagggggcagtgcacctgagcaaacacgtaccccttacctgcaccccgcaatcctgcccagaagccaagagaaacagatggaggctcaatgagggtgtagggaggggcccacatggactcccaccccacttccacctctttgcaggaacaaagccacccaatttaggaaaagacatggctctagcagtcagagtacaggcccacccccaccctcagtgatgtcctttccccccacatactcacccagggccccccggggacagggcactgtggccaggacgccaaactttgtctggggccaccacacaccagatctcagggacttagggcaggcatcatagagcactagagagagaagaggtgctgagccaggcagtcagggtacagggcagttgacagccacacccactgcccctccaccaccccccacaaggcccactgcccgccactcctgctggcttctcaggagctgacctgtcagattctgtgacaggtcagcaaagtacttggggcaaaggtagggttccctgggtgtaagtggtctccctcaggagaagcttccagagtccccaaggagccatgtgtgccactgacacgtgatggtggcacactggaaccagccctctatgggtggagctgggtggagcctgctcaccccggcagccgctggctgtcacctctgcgaagggactgtcacagctgttgcactggcggccaagggctcctgggcgacaggggcactgcccgctgtggggtgcacatgagcgcgaggtggagcccacagggtagcagtcacatgggaggcaagagtcactgccccgcggtcggtagtggaactcctgtttgaggatgggccaggggcctgaagtcagaggtcagggcttggggaatgagtggaatcaaggataaagggtcaagagaacagtgctcatgggccagaggacacctgggtcatgcgtgaagccaagggaggggtcacgggtaaaggatgagagacagcaacttggtcacaggacacaggcaagaggttagggcccaagtcaggtggcggaggtcagcaagctggacaggaattgcagattgcgtccaaggaagggttaaaaggtcaggggccaggcgcaccttgcagtgacactgcccatttgtcttgttgcagttgggatcaaaacctttgtgaacatcacagttgcaggggccacaggttgggctcccccaccagccccgtgggcactgctggtccatcctgggggtgcagagccaggtaagatgcctccacggtatcccagtgaccctccctgtccctgccaggtctccccatcgcctcagccccagcctcttacctgtgctcacagtggtgcccgaaatagccacccacacagtcacaggtatagccatggggggctcctggcaggtgccggcatgatccctggttctgacaggggttcaggaggcaggcatccacacagcctgggccgtagtaacctgcagattgggtcagaaagctcaggatcctggtcgcagagcatggaaggaagcaggcacccgtcccgagtccctgcctccttcaggttccccagtcttcatcatgggcccctaacgcctgcccaggtcacccttcccccaaccctctcaaggctcacctggctggcaggtgcaagaaaaggtctgccagaggtcccggcagtctgcgtgaggtgggcagggcccagaggcacaggcgttggtcacaacacagccaggctccgcattcactcggtggctggggggtagcagggccggggagccagagggtgtggagccgagccacaccccctgtggacacacagccagcaaggggtgagaccatgttaaggcacctcagcctcaagtactgcagagccagccacccggtctgatgatccttgacatgcagtcttctgataccctcaaaaaacccaggcctcaaaaatatccccaatttggtacccctgtgggaccctaattgtgctgtttctgacacagattcctaaaggcccttgataatccaagctagactcccacctccaatgccacagaaaggcttgacctagctctcaactctgggtcattcaccccctcgcaccaacccccacttgaatactgcctttcaggtcccaaggagcccctgacttctgacccctgaccctaatgccccatatcacattcccatgctgacccccacctggatgcagccaaccagaccctgaggagcctcctctgcactgccggggggcaggcctcccacgtggagctgctttaccttcaggccctgcagctcactccccaccgccatggtgtcctggaggaagtggggcagtcagcactgagggagaggggcctgatgaacccctgtcatagcccagagtcagtcttggccttcttctagcccttctaggctgccccctccctcctggacccacagtagaccttaatattgcttgattttgaccgggggtgggtagagactggggcagagactagaaggggcttctaggaatcaggcaaagtgctggctacagaggttccccaagaccaggccccaaatctggcacaaagagggcttgagagtggaccaacttggctggtgggtgggctcagtgcaaggatatatggtggggaactaggggtagaacatcagactcagtgcagtggagggaactgagaggagctggactagaggtggggtcaaataaggcggatctggttggaaggctgagaacagactaccccggggtcagaggccagacctggaagaggctaaagtccagtgagaccataaggacatggtggccccgccggccacctggttcctcctgcaactccagccgcagatcgtgccaccggccatcactgacagtcacctggtccagaaggagatgggaagcacggcccgagcccctggtcactgtcacagacagtaacccccgatctagctgtgggcagagatgcatagccctggggttagagccccatgtgggctgggacttggaggtgagatcagagggctcagaggtcaggaatatcagaggtcagaacagtggggtcaaggttatacctggcacaaagggcactgtgccaggggacatcatgttgctgatatggggtcagggggcagaggataggaccaggtgttgtgggtgggttggtgcagcttgcataagagagagctatgctggagccctgcacctgcagaggatataatgatggaaagagaatcaagggctagggtccagagcagggtcaagtgtggttgggacacctggcagaaaagtatgctgtgtgaccaacctgaacccacaagaatgtcagtggcggcctaagagactgagaactgagggtataggggtgagcagggtggacacacctggcaaaggagcgtgctgtgtggcccagcctgcacttgcatcaggaccccctgcgttgcccgtgtccgaaatgccagccccaggtaccatggcacagacacagccatgtcacttccaaagttccagctcagtgtgccgttgccacggaaatggtggggatgggccatagctgagtggataagagaaacagggttacagcccctgccccaggaacagatctgaccctgcaggcccctctgccccatgctgcccacttactaagctgacagtctttgccgccgaagcccacagggcagtcgcagctgaagctgccccagcgctccgagcagaagccactgttcttgcaggggcctgagtcacaaaagtgtagcttggcttggcagcctgggagaggaaagcacatggcggacatgagaacaagggttggggggcacaagtgctggacaggactttagtgtccagaggggctgaaagagaccaagatctcagccccatttcccattttctttcgatgagtggggttggtaagagtcaggccctaaaatctgggctgtagcatggtgcttgccaccaaaggagactggcttgaagtcaggtatggagtcctccacttcctccctatgatggggacagggccatgggctaggctggtggaagcttcaggcctacctgccatggtgccattatttgcgacaaaagccgccatgtccactcggcggccatcaatgtgcaggtcccgcatacagccgatgaagtccttatgggatacggggaagttctcggggaggttggggacacctcccagaagaagagggcccgtcaggtccagggacctggggatcaggggtctgggtcattggtgggactggggccagagtagagttgctcctggggggccacaggaagcaggggggtaggacccagagggtagggtgattgagggaggaaaataaggccgagctgtggaaggagttaggatcttacttcagttggggtgcaaaggggcacccgtgatgggccgatggtctggggaaaggtaggtgaatgggggttgagagctatgatgaaagaatgaggcatctggctggctggggaggggatggagacgtgaagactctgggggactggacatgagatgaagggactcggaggggatgtgggacattagtgagactggggtggggaggtggaggctttggaggactgcctggggactgtgtgtgggaggagggagtatggggtggaatacaggattgggggctagggtgagtaggctttcagggtctttgagaggagaggggaatcttggtggtttgggggaaagatgggagagtttggcaggatgggatgaggaatgggatgtgaagggttggagtgggctttggtaggcaggggacaaggggactagggggcaggggcctcacttcttggagcttgtttgcacaccagcagccgcgcatgagtagttgccaatctcagcaccaaactgcagagccacggccacatcacaatcatccacgcttagcacagccaccttgtccttggaggggccctgtgcaccccctagggcatctgtccggggctgaagacgcaggcacaccagtcaacagtgcccccagtaacccctgaggagcagaagtcagcatcccaactcccctcatacccgatgccagggatggcccccacct

SEQ ID NO: 343 - DNA, 100317 bp, Homo sapiens
aggttgcttgaatataacccaatatgataaggtttttttcttttttttgcccaaaggagataagttttgtgtttttttattattattttttagtctgtaagacacaatctttattctttttttattattatactttaagttctagggtacatgtgcacaacgtgcagctttgttacatatgtatacatgtgccatgttggtgtgctgcacccattaactcatcatttacattaggtatatctcctaatgctatccctctcccctccccccaccccacaacaggccccatcctgtgtccaagtaatgtccaatgtaatgttccccaccctgtgtccaagtgttctcattgttcaattcccatctatgagtgagaacatgcggtgtttggttttctgtccttgcgatagtttgctcagaatgatggtttccagcttcatccatgtccccacaaaggacatgaactcatccttttttatggctgcatagtattccatggtgtatatgtgccacattttcttaatccagcctatcattgatggacatttgggttgattccaggtctttgctattgtgaatagtgcctcaataaacatacgtgtgcatgtggctttatagcagcatgatttataatcctttgggtatatacccagtaatgggatggctgggtcaaatggtatttctagttttagatccttgaggaatcgccacactgtcttccaaattggttgaactagtttacagtcccaccaacagtgtaaaagtgttcctatttctccacatcctctccagcacctgttgtttcctgactttttagtgattgccattctaactggtgtgagatggtgtctcattgtggttttgatttgcatttctctgacggccagtgatgatgagcattttttcatgtgtctgttggctgcataaatgtcttcttttgagaagtgtctgttcatatcctctgcccactttttgatggggttgtttgattttttcttgtaaatttgttcaagttctttgtagattctggatattagccctttgtcagatgggtagattgtaaaaattttctcccattctgtaggttgcctgttcactctgatggtagtttcttttgctgtgcagagcctctttagtttaattagatcctatttgtcaattttagcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccttctccatatggctagccagttttcccagcaccatttattaaatagggaatcctttccccatttcttgtttttgtcaggtttgtcaaagatcagatggttgtagatgtgcggtattatttctgagggctctgttctgttccattggtctatatctctgttttggtaccagtaccagtaccctgctgttttggttactgtagccttgtaatacagtttgaagtcaggtagcatgatgcctccagctttgttcttttggcttaggattgccttggcaatgcgggctcttttttggttccatatgaactttaaagtagttttttccaattctgtgaagaaagtcattggtagcttgatggggatggcattgaatctataaattatcttgggcagtatagcaattttcacgatattgattcttcctatccatgagcatggaatgctcttccaggagataagtgttaataagaacaatgattcccacagcttctggttctacacaaaatggagtagacacatttattcctattcttcccattatgtaaagctaaaaactcttgaatatcatatataataaacataagaagactctgaaaggttgaggggaaaggagactggctggggaacttgggacccagggaaagacacagcgggagttctctgagttttctttttcttttctttttttgaggcagggtctcattcttttgtccaggctggagtgcagtggtgtaatcatggctcgctatagcctcaactttctggactcaagcaattctcccacctcagcctacccaggagctgggaccacaggcatgtgccaccataaccagctaatacattttaatttttatgtatgtatgtatttctttattttttgagatgtagtttcgctcttgttgcccaggctagagtgcaatggcacatgatcttggctcattgcagcctctgcctcctgggttcaagcaattatcctgcctcagcctcctgagtggctgagatcacaggggcctgccaccacgcctggctaattttttatatagttttttagagatacagggtttcaccatgttgcccaggctggtctcaaactcttgacctcaggtgatccacctgcctcggcttcccaaagtgctgggacttcaggcgcgagccacggtgcccattttttttgtagtgatgaggtctcactatgttgcctaggatggtctcgaacttctgggctcaagcgctcctcccacctcagcctcccaaagtgctgagattcaggtgtgagccatgacacccagcctctgggttttaattttgccttaattgtatcttaactggatcctggagaagctgacaacttaatacaacaatggacacagacaagagaagccccaagaagggctgctctctagtcaagcgaccaggaaaggagcagcctagcaagacagaaacttttagccaataatcactctagtgcagccaaactccacagagtaaacaaatggtggaaaagctgagtgggagcctggacttccaccctcgcacagctgtaaagaggcggccccttcttctgccagggtggtgtcagagaagcctaagtggaaggctggcacttttatctccattcagtggcaatgaggcccagcccctgcaaagtcagtggaggccacttggggaaccacatccatccaaaggttaggatgctctctccctccctgctgggacagtggcagaggaggcctggtggagagccaggactttcaccaaaaccaagtgagaacgaggcacccctcttcctccctgcctggaggtggtcagagaaggccgagtgggaagctggaactccctccatctctctgtggtaaggaggttcccctacccatggtgtcagtggaagccccatggggccaggcagaagtggcacaatattttcgaatattgttttgagaactgttttgtgtctagaagttttatgtgaagaattctacatccagtgaaaatatccttcaggaataaaggaaaaattaagacattctctactgaaggaaagctaagagagttcatcacccccagatacctacttcctaaaagaatggttaaaagggccgagcgcggtgcctcatgcctgtaatcccagcactttgggaggcagtgacgggtggatcacttgaggtcaggagttcaaaaatagcctgaccaacatggtgaaaccccgtctctactaaaaatacagaaataagcttggcgtggtggcacacgcctgtaatcccagctactcaggaggctgaggcaggagaatcgcttgaacacgggaagcggaggttacggtgagcccagattgcaccattgctctctagcctgggcaacaagagcgaaactccatctcaaaagaaaagaaaaagaaaaagaatggttaaaagaagactttacaacagaaaggaaataatgaaagaaggaatcttagaacatcaggaaagaagaaagaacaatggggagagtaaaactatagtcaatacaataagctttcattctcttcttgagtattctaaatgtttgatggttgaagcaaaaattgcaatattgcctaatgtggttatcaatattcgtaaaggaaatatttaagacaattataagtgggagaggataaagagacttaaaaggaagcaagcattctttctttctttctttctctctctctttgttttctcttgagacagagtcttgctctgttgcccaggctggagtacagtggtgtgatctcagctcactgcaagctccgcctcccgggctcaagtgattctcctgtctcagcctcctgagtagttgagactacaggcatgcaccaccacacccggctaatttttatatttttagtaaagataggggtttcaccatgttggccaagctggtttccaactcctgacctcaaatgctccacctgcctcagcctcccaaagtgctaggattacagacatgagccaccgcacctggccaaaaggaggcacgctttctatactttactatacttcaccaggagaccatggtaagttatatgtacataatgaatacttagataaaatactaaaagaaaactatacaaaagaaatacgtttaaaaacacaattgataaatcaaaatggattttttttttaaagttcaagtaacctggaggtaagcaagtggtaaaaaaagagaaaaaaaatcagaaaaacaaacaataaaatggcagacttaagccctaatgaatcaataattaccttaaatgtaaatagtttaaatatatcagaagacagattgggagaaaggatttaaaaaaaatatatgacacaatatgtcatttacaagaaactcatctcagatataataatatatgtaagttgacagtaaaaagatgaaaaaagactcaaacatcttaattaattctaagttaacaaagtatagctacgttaataacagataaagtacttcaaagcaaatcaccaggtctagaaatggatactgcagaatgataaagggtcaatctaccaagaatacaaagatacacacaattctaaattcgtatgcaccaaacaacagagctgtacaaatatatgaagcaaaactgatagagctgaaaggagaaacagacaaatccacaattatagttggagacttcaacatttctctcaacaattgatagaacagctatatagaaaatcaaaatataggccgggagtggtggctcatgcctgtaatcccagcactttgggagaccgaggcaggcagattatttgaggtcaggagttggagaccagcctggccaacatggtgaaaccccatctctactaaaaatacaaaatttagccaggtgtggtggcaggcacctgtaatcccagctactcgggaggctgaggtgggagaattgcttgaacctaggaggcggaggttgcagtgagccgagactgcgccactgcactccagcctgggtgacagagcaagactccatctcaaaaaaaaaaaaaaaaaaaactcaaaatcaaaatatagaagaactcaaaaacaccagtaaccaacaggatctaattgacatttatagaagaacactccacctcacagcagcagaatacacgttcttttcaagcacccatggaacattataccaagatacaccatatcctgggccataaaatgaacctcgataaatttttaaaaaactgaaatcatacagcatatattcaccaaccacaatggaataaaaccagaaatcattaacagaaagataacagggaaatctccaaacacttgaaaactaaatacacttctaaacaatcctagggtcaaaagaggaactctcaagggaaattttttaaatggaactgcatgaaaatgaaaatataatgtgtgaaaatttgtgagacacaactaaagcagtgctaagaagaaaatgcatggcactaaactcatacattagacaggaggaaaaatcgggggctaggcgtggtggctgacacctgtaatcctagcactttgggaggctgaggtgggcagatcacttgagctcagagatttgagaccagcctgggcaacataatgaaaccccatctctacaaaaaaatagaaaaaaattagctgagcgtggtggcacaagcctgtaatttcagctattcaggaggctgaagcacaagaatcgcctgagcccggaaggcagaggttgcagagagcagagatcacaccactacactccagcctaggcaacagagccagaacctgtctcaaaaataagataaaataaaataaataaaaagaaaggaggaaaatatatatacatatgtgtatgtgtgtatatatatatatacattttcctcctttatatgtgtgtgtgtgtatatatatttataaaatatatatatatataaaatactatatacgattgttttaaaaaagaaatattttgtaaccccagcactttgggaggccgaggtgggaggatcacgaggtcaggagattgagaccatcctggctaacatggtgaaacccagtctctactaaaaaatacaaaaaattagccaggcttggtggcgtgcacctgtagtcccagctactcaggaggctgaggcaggagaatcgcttgaacccaggaggtgaaggttgcagtgagccaagatcacaccactgcactccagcctgggcaccagagcgagactctgtctcaaaaaaaaaaaaagtattttagatataaatctagcaaaacatgtacgtaacttgtatgttgaaaactacaaaacactgaaaaaatatccaagaagacctaactaagtgaagagatacacatgttctcatactgggaggatcatagcaaagatgtgaattctccccagattgatttgtaagtttcaagcacttccagcaagattctttctagatatagataagcttattctaaaatttatatagaaagacaaaggaactaggatagctaaaacaattttgaacaacaacaaagtaataaagtgctaggaatcatactacctgcttttaagatttattatgcagctacagtaatcaagactgtgtggtactaacagagaaacagacacataggttagtgaactaacattaaaaacctagaaatagaccatacaaatatgctcaattgatttttttctagcttgaagattttttattataataaatacagataatataaagctgaccattttagccattgtatttctttttattttattatatatacatattttttcctttttttacacataggaatattttaaccattttacttatttttatttttattattattattatttttcgagacagagtctcactcttgttgcccaggctagagtgcagtggcgcgatgttggctcactgcaacctccacctcccgggttcaagcaattcgcctgcctcagcctcctgagtagctgggattacaggcgcccaacaccatgcctggctaatttttgtagttttagtagagacggggtttctccatgttggctaggctggtctcaacctcctgacctcaggtaatccgcccgcctttgcctcccaaagtgctgggattataggcatgagccactgtgcctggtctatcttttatttttattttttttgagatggagtcttgctctgttgcccaggctgaagtgcagcggcatgatctcggctcactgcaacctccgcctcccgggttcaagcaattctcctgcctcagccttctgagtagctgggactgcaggtgtgtgccaccatatccggctaatttttgtatttttagtagaaatggggttacaccatgttgtccaggcgggtctcaaactcctgacctcaggtgatctgcccacctcagcctcccaaagtgctgggattacaggcatcagccaccacgcctggtctgattttttttttttttttttgagatggagttttgctcttgttgcccaggttggagtgcaatggcacgatctcgggtaactacaacctccacctcctgggttcaagtgattctcgtgcctcagcctccctagtagctgggattacaagcatgagccaccatgcccagctaattatgtatttttagtagagacagggtttctccatgttggtcaggctggtcttgaactccctacctcaggtgatccgcccacctcagcctcccaaagtgctgggattacaggtgtgagccaccgggtatccataacaaaaagagagagagagagagagaaacttgatctataattaaaattcaaaagttaaaaagaaaaacaacgaactcatgttgtcagccagcccatatctatctcacatagttggaacaaggactggacatgtgcaataaacactatcatttatagggtggaagaagaggaagaacactacactcactgggccacagcataccaagatcctggcagggagatattttgagctcccttgatctaagggtagtttttacccctgaagaggccggtttctgctctctgaccatagctatccatgccagatcctcagtttttccttatcttgtctgacttcatttgtagggccattaggggttatggctttctgggggtcttaccatctattacaccctacgtgggattctggtggtccaagttcattatttttatgcaaacaaagactcttttcctcagttcaagcttttatagttctttttttgtgtgtgagttttctagtgtacacacacactcacacacagaccatttaaaaatctatttgattgcatttagctccaagcgtaattaaacctctcctcaactcattctggctattctttcttttttttttttttttttttttttttttttttgaaaaggggtcttgctctgttgcccaggctggaatgcagtggcgctatctcggctcactgcaagctccgcctcctgggttcatgccattctcctgcctcagcctcccaatgggactacaggcgcccgccaccacgcccggctaattttttgtatttttagtagagacggggtttcaccgtgttagccaggatagtctcaatctcctgacctcgtgatccgcccgcctcggcctcccaaagtgctgggattacaggcatgagccaccgtgcccggcccattctcgctattctttctttttctcatcttaattaaaatatcttgagtttactagttggctgggacacaacactcgccacctcgccacacttgttttttgtttttttttttctggagcagtttagccaactgaaaacaatttcaatccaatcactgatgtaaaccgaaggtatgagagccataacccaggttcgatttttgcttttttacaaatatgcttttcaggggtagaaattccatgctattaggctgttcttaaacttttccattagaaaaatgccataggaatgcagaaaagggtgtggtaattccgcctggggaattcaggaagagcgagagagaagctacagccaggcccctcaacacagccagggcctttctcatggctgcctggccaactcgccttccactctccggagaagctgctttaaccttctcctctttcccccaactcctactcctccaactccccgctcactcagtcttgcctccttcctcagagaaagttaaaactatcagatgggacaccctcaagctcaggtcatcctcctcatgtagatttttaaccccttacagctctgcatagccataagctgaccccatctcccacccttcctcagccttcctagtgtgtcttctggaatttgcagtgcacccctacacaaacccactgtgccctccgccttcactctgaatattcccttcaccttcttgccttgcaggaaaactggctgatgcctgcaggcaacccttcccctatggcctcctcaaatgagggctattttccctctcatgatcctcattccagttggcctgagataggggtagctgtcctcccttccggtcctccataaacccccagcctttttgaaacaattgacattaggccacaccctgcctctttgtcacagtcctcttcaggtctcttcctcattcactaagtattctggtcacggctaactgtgtctctctgccactgccccatcatcattcttcataccttcctagcaccctgggatctgtgcaaacgatccatccaacacctcaactcccagcatgacaatctcccccaatgtcccagcctcccttgcagctaggagtagccatgtgacccatttcagtcaaatgggatggaagtcaaaatctgaaaggagggctggtttctatgaaagcattgccttccagggtgtatgcagcttccctgggttaatgagcctgtgtaaacgggagaacagcacagtcattggccctgacacaactgaaccaatgaccctacaccagcagccacctatcttcaatctacttcagccactctggtccaatttcctgccttcacagctgaaagaattcctaataatttctcatcaatactgcctgtccctgggtcccatcctcaagccactcaccctcctcttttcacccctgttcctgcccaaatcctagtgtgtctaaggctgctagttattcctcaatatccattctccccttctctcttttgtaacagaaccctaaaattgtcacagagccgaccccggacccagctactgcactgccacagtcctctttctccccaacgctgtttttctatcagcagcttttcatttaatctctgtcatttccaaccaagtacaaacacactgcaacatctcctgcaatattctgatgttaacaaaacatcaaacaccctttcctaaactcctcatgtcccctagctaccacctcatttctcagctctcctttttatattaaaaaaaaaaaaaaagctctgctcaagagagtggcctgtcctcattgccttcctctcctcataccccctctgccagtgccctgatccctggatgcccgccattccagcagaactcctcttgtcaaagcaatctagtgcccgtcaccttgcccaacccaacagtccattctcagccttcattttatcccacctcacagcagcctgtggcagagggaatcatgccctgtgttcctccgctgctgcctcctttaatcacggagaattttaacatgtacagaaggagagagcatgaggttgggcgtggtggctcacacctgtaatcccagcactttgggaagctgaggccggtggatcacctgaggtcaggagttcgagaccagcctagccaacatggcgaaaccctgtctccactaaaaatacaaaagttagctgggcctggtggcagcgcctgtaatctcagctacctactcaggagtctaaggcaggaaaattgctccaacccaggaggtggaggttgcagtgagccgagatctcgccacggcacttcagcctgggtgacaagagcaaaactctgtctcaaaaaaaaaaaaaaaaaaaggcaggcacggtggctcacgcctgtaatcccagcaccttgggaggcagagacgggcggatcatgaagtcaggagatcaagacgatccttgctaacatggtaaaacctcttctctactaaaaatacaaaaaaattcgccaggcatggtggcgcgcacctgtaatcccagctactcgggaggctgaggcaggagaatcacttgaatccaggaggcagaggttgcggtgagccgagatcgcaccactgcactccagcctggtgcctgagggagactctgtctcaaaaaaaaaaaaaaaaaaaaaaaaaaaaggaaggagagggcatgaaacaatgagactcacatacacaccactcagcctaaccacctccaacccacggccagggaagtcctgcccagactcacctctgcatcttcccctccctattatttggaagcaaatcctacacattatatcattttgttggtaaaatatttcggcatctctaaaagataacttttaaaaatgtaaacaactctctcattctttttttcccagcttcatttttaattttttctatctattacttatttatagtttcaacttttattttagattcacagggtacatgtgcaggtttgttacctggctatattgtgtgatgctgacgtttggggtacaattgatcccatcacccagatagtgagcacagtacccaacagtttttcaacccttgctcccctcattccttccctgctttagtagttcccactgtctggtattgtcatctttatgtccataagtatccagtgtttagcttcacttataagcgagagcctgcggtatttgagtttctgttcctgcattaatcgacttaagataatggcctccagctgcatccatgttgctataaaggacgtgatttcatgctttttatggctgcatagtattccactccctcattcttgaaacccatttttcactggatttacattcaccaaattctcctgattttactgttttagtccttttgggttgctttaacaagataccataaactgagtggcttatcaacaacaacattttttttttctcacaatccagaaactggaagtccaggatcaaggcaccagcagacttgttgtctggagagggcccactttccagtttatagacagaggtttctagctgtgtccttacatagtgggtggagcaaacgagctcccttaggtctattttttttttttttgaggcagggtcttgctctgttgcccaggctggaatgaggtggtgcaatcatgactcactgccgtgacttcccgtgctcaagtgatccatttacctcagcctccaaagtagctgggaccacaggcatgtgccaccacttccagctagtttttttttttttttaatttttgcataaatagggtcttgctctgttgtctaggctggcctccaagtcctaggctcaagcaatcctcccaccttggcctcccaaagtgctaggattacaggtgtgagccaccacacctagggcctattgtaagggtactagtcccattcatgagggctctgcccttcagaccctatcacctcccacctcctaataccattaccttggtgattaggtttcaacatatgaattctaggggactacaaacattcagaccatagcatcctcctatccaagtggccactcctctttccaacctctcatccaggcttgggactttcaatgacagctaagtactcatccctttcaaattacctctgtgcctcaatttctccccagagctccaggttcattatcttttttttttttttttagatggactcttgctctgtcacccaggctggtgtgcagtggtgcagtcttggctcactgcaacctccgctgcccaggttcaagcgattctcatgcctcagccacccaagcagctgggattacaggcatgagccaccatgcctggctaatttttatatttttagtaaagacagggtttcaccatgttggccaggctggtctcaaactcctggcctcaagtgatccactggcctcagcctcccaaagtgttgggattacagacatgagccactgtgcctggcccagttcatatatctaactgcatacacacctggcatctccgcttggaggtccattaggtatcttcaagctaacatgggttaactagaacctttgatattctgcaccctccttcccatcacttcctcactgagtcttctccacccttcattccattttcagccctaagcctagaagtcattattctgttccacaatctgtttgcaagttatgtcacctccacattcaaaatattatatatccagaattcaacaacggttcaccatatccatcacttgtaccaaggccaccatcataagcagaccagcggtttccacatttatttggtattttccctgatgaagacagaattatactttatgtaatttgaaatatatagaaatagaagctgaccctgcacccctaatatatgtatatttactaactggcaaattatatgcagatacctactaatatgtattataaaacataaaatagaaatttataaaggatgacataaagagaaaataggcagtttttaaatgtcttactaattgtgatagcttcatatgatcattttacctaacatctcaaggcacaatatacacttaggtaaggtttgtgattaactataataaaaacacgcatttcaagtaggctttttatttattccacatttcacttggacacaagtgtaagatttgatcaaattgtcttttttaatctcaaagtgtggctaaaaaagatctcatactaggaaaacaagaatgtcagatccaccattttcatgtgatttgcttgtgattgtattgttaatattaataatacaacttccaacatacgacttcttagcaggaatcttgtaaagccactttttctttttctttttttttttcttcttcttcttttttttttttttttgagatggagtttcgctcttgttgcccaggctggagtgtaatggtgcgatcttggctcaccacaacctccgcctcgcaagttcaagcaattctcctgcctcagtctcctgagtagctgggattacaggcatgcgccaccacgcccagctaattttgtatttttagtagagatggagtttctccatgttggtcaggctggtctcgaactcccaacctcaggtgatccgcctgcctcagcctcccaaagtgctggaattacaggcgtgagccaccgcacccggccacacttgttcattttttgagactcgttttagttaaaactcaattggataatccttcaatccatttaatcagattaatgaaaaatgcagtagtcacaaaacactggtacccaatgaatgagtgcattgtcagataaaaaataagagaaacggaagttcaatattttcttcctgcacccagtgggttgattgccttgggcacttctttgtgtgttagctcttccctttggaaaacagtccccaacatggtctgcagcatgtcctcacaggtctcactgcttcattcttgcccctacatattcaattttccacctagtagccagagcgctcttctccaaacacaaatcatatcaagtccctcccgtcctcaaaaccttcccctggcttcctaacattctcagtagaatatccaagctacctctgtggtctccagagcctctcactggccccactgcctccctggcctttctctcatcccaccacctgctcaccaccacccagccccactgccccactgccctccttccattcctcaaactctctatgttccttcctgtctgggtgtttcaaagatgccccaatcacttttcctccctgctctttcctgtccctatctcacccgccattgttaaactcctgcttacccctaaaatctcagtttaaatctcactgcgttaggttgttgcttatcccttaacacctcaaggcacaatatacatttcagtaaggtttgtgatgcaatatgtcacaaaatgcaatatgtgaatacattaaagtttaaacaaaaatcttaaccagctcacccattgtagtcccttatcctatgcttcactttccccttaaaattcttttcagaccgggtggtggctcatgcctgtaatcccagcactttgggaggctgaggtgggtggatcacctgaggccaggagttccagaccagcctggccaacatggcgaaaccccatctctaccaaaagtacaaaaaattagtggggtatggtggtgggcacctgtattcccagctactcgggagactgaggcaagagaattgcttgaacccgggaggtggaggctgcagtgagccaagatcacgctgttgcactccagcctgggcaacaagagcaaaactccgtctcaaaaaacaaaacaaaacaaaacaaaaaaacctcttttcggaaaaaaaatttttttcatattatgttcatctgtattattatctgtctaatgtctgatcccctacctattagactggaaattccattagggcaggaatggtgcctggtatatagtaagtgttgttggatgagtgaaatgaatgactggcataaggatgaaaggtgttatgagctgagctgtgtcctcccaaaaagatatgttgaggtcctggctgggtgcagtggctcacttctgtaatcctagcactttgggaggccgaggcaggtggatcacgaggtcaggagatcgagaccatcctggctaacatggtgaaaccctgtctctactaaaaatacaaaaaaaaaaaaatagtcgggtgtggtggctggcgcctgtagtcccagctacttgggaggctgaggcaggagaatggcgggaacccaggaggtggagcttgcagtgagccaagatcgcgccaccgcactccagcctggacgacagagcgagactccatctcaaaaaaaaaaaaaaaaaagatatgttaaggtcctcctatcccccagcatcccccagaatgtgatcttatttgaaaatagggtcttgtagaagtaagcaagttaaaataaagtcattagggtgggccctaatccaacatgactggtgtccttataaaagggaagtttggacacagagacagccatgcacagagggaagatgacgggaagacacacaggaagaacaccaagaattgccagcaaacatcagaaactagaagagtcaaaggatgattctcccctagagccatgggggctggaggggagcaagtgcatgccaacactttgattttggacatcaagccttcagaactgtgaggcaatttttgggtttgatcctttgttatggcaggcagccctagaaaactcaaccaaaagagaaaattgttgtacatgaggcagtaattgctgaggactttgattggagaagccaaggcacataaaggaagttgtagccaaagcatataaaggaagttgttctgtttccaggtggaaacagaattacttagcaagcagaattcaatggtgtggagtattggatcaatctccctaaacacatattcaggtaaccgaccttcattttttgtccccttcttctttccaaataccatattccactgatcctagaggcacatctcacatctctgaaatcagcctgttcactggtgtccagcaagaggaagtgtaaaaaagtttcaaaaaaaatcacatggagagaccatcacagacaacttccggtacacaatattatattaacagtttaaaaatatgcatataaatgcatttctatctatatataacttctatctatgattatctatctatatataattccttttttttttgttttgtttttttttttttagtagagacagggtttcactgtgttagccaggatggtctcgatctcctgacctggtgattcgcccgcctcggcctcccaaagtgctgggattacaggcgtgagccaccgtgcccggcctatctatatataattctatgtattctatctatatagcgatatataatttctatctgtaatgcaaatctacatgtgatttctatctatatatacatgtagatagaaaatttagggaattcactgcaggtgctgcttgcagtccacttttaaaacctaacattacataataaaacactattttaagaagctgcactaggccgggcttggtggctcacgcctgtaatcccagcactttgggaggccaagtcgggtggatcacaaggtcaggagtttgagaccagcctggccaacatggtgaaactccgtctttactaaaaatacaaaaattagtctggggtggtggcgtgcgcctgtagtcctattcaggaggctgaggcaggaggatcgcttgaacccgggaggtggaggttgcagtgagccaagatcgtgtcaatgcactccagcctaggagacagagcgagactccgtttcaaaaaaaaaaaaaaaaaaaaaaaaaaaaaaaaaggagctgcacgatgctccccttgggcgtgtaccataccttatttaaccattcccaaactgtttccattttttctgatgttaaataaactctaagatgtacagacgtcttttatctggctctccgattaccttctgcagataaactcctagaagttactggggcaaagggagtgaacctttaatttttaataaaattttttaaattacagaaaaagccgtagtcgtcagattctacttcctaggcggtccacagggatttcaacaagttcgattcaaaccatcccaaattccctcccggcactaagttttcctcggtcttgggaaacgtggccccgcagtccgcactcacgactgcgcacaaacgctggcctctttccaatggcgaaacttctcgacacgcccccgaggcaccacctctttaaaatttaaaacgaaggcccaggccaatgaatgctaagcttctctcggaccacagagacccgcccaccgtcactccctccaccaatcagactgaagttttctccactgcccctccaatcaccgccaaaaatggaagttgctctcgtaacttacgtaaggcaagcagccaataggagcaaaccttggaaactagctcccccaatagcagcagttcctggagagcgcgggagcctttcgaccagggtcccaaaggaaagcagtgagtggtgctgtttccctgaaggaagggactaagggacggtggcgcgggcccggaccggggccccggggcggcggcacggccgatatggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaaggtaaggaaggttactgtcgtctcagatggcgtgcacggtgctttccttgctaaccagaacttggcagcgtccttagaacagccacagaccccgaatgagactaatatgactatgcgtcccttcggaaggaaacaaataaataggaacagttttcacaacaaaatgggtagttcctcactacctactgtttaagacccctcacaatttgggccctacctgccttcccagacttgattttcctacacactacatctactctagcatattgaagtccagtccagaaaatcaacaggtctggactgcttgttttgtgttatgtgtgttgttcaatctgcctggaatgccagttctcactcttccaggccagtcttaacttcacttaccctttaaggcttcttctcccagtgacaactgctcagtccagcgtctgaattgccatacacattttgtgtggcacttaaccatttctccatatgttttgattatgcacatctctcaccctccatctagtctaaaaatacctcagaggcaagcagcaggttttaacacaatacccaggggtgtgtgtgtatgtgtgtgtgtatatatatatatatatatatatatatatatatatatatacacacacacacatatatatacacatttatttatatacatatatatatttatttattattattttttgagacagtgtatgtcgcccaggctggaatgcagtggctcactgcaacctccacccctccgggttcaagcgattctcatgcctcagcctcccaagtagctgagactacaggcccacgccaccatgcctggctaatttttttgtattttcagtggagaccaggttccatgctgcccaggctggtctcaaactctggcctcaggcaatccgcctgccttggcctcccgaagtgccaggattataggtgtgagccaccacgcccagccacccagatgtgtattaaacgttgtaggtgttcagtcagtattggctgactaaatgagtacattcttgcgtacattcttgcaaacttaaagtcttaaatggctaatttggatttttgctgaggcggtgaggccccctgctcctgttaagtgctaggataagtatatacttttgccttcatccttctcattgcacttcatttagtcaacaaatgttcattgagaagccagtaacatctgagtgcctaccacactgtttgagctgctggggacatggtaaccaaagcagggaacagattaaacagataagcaagtgacaatttcaaatcatgctctggagaaaataaaatggggtgagaggatgggagtagaaggtggttattgtatacagagtggtagtgagggaaggcctttttttttttttttttttttttttttgagacagagtctcgctttgtcacccaggctggagtgcagtggcgtgatctcggctcactgcaaccttcacctcctgggttcaagcaattctcctgcctcagcctcccaagtagctgggattataagcgggcgccaccaggcctggctaatttttttgtatttttagtagagacggagtttcaccatgctacccaccctggtctcaaactcctgagctcaggcagtccgccaacctcagcctcccaaagtgctaggattacaggcatgagccaccgtgcctggcagggaaggcctttttgagcagagaattgaatggtgaaggaggaggaactcaaaggtaggtaaagaacattccaggtgaggagacaagcaggtgtaaggatttcagctggaaatgaacttagtttgtttcagaaacaaaaaggcaaggagtgctgagacctagtaggcaaggggagcagtgtgagagaaagtcagaaagcaggagaggccgatctgtagggccaaggtcaaaaatgtggattttgttctaattaattaatgggaaggctttggaatgtggtttaaccaagtgaaagatgtgattccacttaatggaaatacatgtcactaacccaggagtgagttaaattgcaagattacagatggaaaatgagcaagcatttaaataataatatggtatgttaaaattttcaaagtgctttcacatgcgaagcccaaaaaaggcgtggcaaatgcaaaataaggcagcagtggtttgtcaagaaaaggaagggacaaaaagtgtttaaggggatggtaaacatttgatggggaaaatgaaatcctagatatattaaaatttaaggcagccagtcaagccttagacacagtatacaacacattgctcagctggaaacaattgatatcacatcaaagactttcttctggaattttattatgttaaatactggctagaaataagttagatggggcttgatggatcttggagattctttgtctctctttttttctctttaatctctctctctctttttttttttgaatagcattgaaataagtgggttgactggatctttttaaagatcccttccaggtctgatgtaccgtcgactgaggggatgggtcatctctgaggcttcccttcttacatcggctgtatcccctaagaaaatgcccatcagatactcaagtttttctggaattttcttctgctgaagatctatcattttctattcaaaaacctgcccagccatgctgggcaaaaggaaggtttgggctgtgtccttggggagtgctctgtccaggagcagggagaagggaggaagagaaaatccaggtcctgccttggggagcgtgcagtctgggaagtagaactgggagaaacagaacctgcacttacattggaggcagagggatccaagcgcataaaacaggatatcatatttgcaaagatataggacagaatggaggataagagacctctgacacattttcaactttatgccttagatttattcaatacatatttgttccatacctgccaggtatgctaaggaatcaaatagatgtggtccctgccctcttggagcttatagtctagtggacatttacagatccccaaatttgaaactaccactaggacatgtctgtcacttatcctataatacgcatacgagtgaaaaatgtgaccatactctatagtatactgtttgtatttttgtttttgttttgtttgagacagagtcttgctctgtcgcccaggctggagtgcagtggcgcaatctcggctcactgcaacctccgcctcctgggttcaagtgattctcctgcctcagcctcccgagtagctgggattacaggcgcttgccaccacgcctggctaatttttgtatttttagtagagacagggtttcaccatgtttgctaggctcgtctcgaactcctggcctcaagtgatccacccacctcggcctcccaaagtgctgggattacaggctgttatttttttttaatcacatgttttgctatggtttgaatatttgtcccctccaaaactcatggagtaatgggtgtcatgggagtgggattggtggctttataaaaagaggaagaaagtgttgagctcacttgctgagcctcatcgccctgctttgccctgtgctgccttgggactctgcagagtccccaccagcaagaaggcctttgcaaagtacaaccccctggccttggacttctcagcctccataactgtaagaaatacattccttttctttataaattacccagtttcagctattctgttgtaagcaacattaagcagactacgccatgcacacattacctttaatagaaacttaaggtccttttcaacacttattaaagttacatcttcccacccacctcccgagacagagtttcactcttttcacctacgctggagtgcagtggtacaatctgggctcaatgcaacctccacctcccaggttcaagtgattctcctgcatcagcctccctggtagctgggattacaggcacccaccaccacacccagctaatttttgtatttttagtagagatgggttttcaccatgttggccaggctggtcttgaactcctgacctcaggtgatccacctgccttgtggatcaaagtgaggggtgttgggattacaggcgtcagccaccacaaccggccataaagttacatcttaacctttcattttattaacagggtttttttgtttgttttcctggctggtcttctggctgaaacaatttcaacaaaatttttgtgtccatttggcagaaaatcctaatcaggatctatggcgtctgaactaggttaccattctctccatagcagtgaacacagatatagatacatgggtggtaacatcacatactaattaattggttaatctaatacagcattttccagattgatattcatgactgaaaagtttagatagattagaagataatgtgctccaatacattgtttatcttcattacatgggatcttttttttgtttgtttttaatgctgatcataaaccactcaatccatcagagaatctatcaaagtccgtcagatggtcatgatccgaattttaaaagcagtctaggccaggcctagtggcttatacctgtaaccccagctttggaaggctgagacaggaggatctcttgcacccaggagtttgagaccaacctgggcaacatggtgagaccccatctctacaaaaaatacaaaagttagccaggtgtggtggcacatgcctgtactcccagctacttactcaggaggctggggcgagaggattgcttgagtccagaaagttaaggctgcagtgagccatgttcataccactgcactccagcctgggcaacagagcaagatcctgtctcaaaaaataaaaataaatgaaagcagtctattcagaacagtcctgggttcttggacttgtctatcattgccttgctgggaccatggacgattccctgcttgtctttgaacttgactacaatgggaagtttgggaatgacctagttgactttcgagacccttctagttctgattcctaacattcacatagcaattataatttataattgttacccggcatgatgagcatattctaaggggtgtgctccttcatattcccatagtagctgaatattgttgttatactgtgatgccacgttaaacattttatgttggtactgttttattcacaccccccgccccacttcgagatcctagacatggcacatagaagttactcaataaaagtttgttgacagaaggttgactgaagagtcagctgtgtgtgaaggagtgaagcagggcttttacaaagaaagcaggatttgagccagatacagaagcgtaataaccattcagttggtgaagaaagaaggggaggcccaggaaatagaaatcagcaaaaacagggaagccttaaaatatggcatgttcaggaaatagcaaatggttcaatatgcctagaaggagtgggggtggatgaggggtagaagataatgtgttccaaaaggtggtttagggttggcttgtgaagggctttgtgattatgctgaagagttactttattctggaggcagtgggaagcctttcagaatttcagagaagtagcgtgaccagagaagtgatttggaagaatacttagagcaccatggaggaacgattagaggcagagcacagactttacaggctatggtaacagttagggcaaaagatgccacgaggcctcggtttgtctcgtctctgcacaggcctgtgggtgggcaagtcagagtgatggtcaccgtctgggggaggtgctcctgcctcactcccatgacacctggccattattgtgttgtgctgtataggacataattatttttattaataggccaggcacagtggctgttgcctgtagtcctagaactttgggaggctgaggcaggcagatcacttgaggtcaggagtttgagaccagcctggccaacatggtgaaacctcgtctctactaaaaatacaacaattaggcgggcatggtggcgcatttctgtaatcccagctacttgtgaggctgaggcaagagaatcgcttgaacctgagaggtggaggttcctgtgagccgagatcatgccactgccctccagcctgggtgacagatcaagactctgactcaaaaaaaaaaaaaaaaaggttatttttattaatgtataatggttctatgttccttctaacattttatgatctatacccagtgatttgtgtcacttctttctgttccttgacaaaaaatataaatgaggtactatttttactaaatgaatgctttctcaaagggatataaggtagtaatttgttctggggctgcacagtagcttgatgctgaccattatttctatttagctcagcaaatacattggttgtgtaattcgatcctttaatattggtatcaactttactttctcctgatttcctttacttttatttgtgaatgcctaatttatagtaacctaaggttgtttgtcgttttattttagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaaggtaagcaaataatattttaaggtttttttttttttaaatctcagttacattaatttcttcaaagaagcttttaacttctttggcatttctcacagcccaggcactcaacgaatgcttgtcatgaaagaattaaaagacatcaaggcaaaatcagagatactgtaggaaagagttgaactcttaattcagtacaactgccagcctttgtacaaaaaaacaagtgaatgattgattttaaagtttaccagctgttcccaaagaagggtaatattattcaggtgcccaagcacatgggtatacgatttcattgcctcatagagtagattgataaattgaagaccatagagaaacaatggtcgactaaaagaagaaataaattagtctacagaaacccagaatgatgcttgttaccaggaaaagcaaacatgttggaatcttcattacattagtttcaccatatgatttgctatatggtaaatctcatttctgaatatattgtatattcacagaaataatactttatagagatatgtacataaaactgttgtacattatgtgcagtttaaggaattttcaagagtagttttgtttatataatttcattacacagtctttagaatttaacctcctcataagatatgatgcactgtactttatggatttaagaagtggtgtcttctttcttataagtagtaaacattgcttgaatacttacttcttttttttttgagacaaggtcttgctttgtcacccaggctggagtgcagtggtacgatcatagctcagatcgcagctcactgagcctcgacttcctgggctcaagggatcctcccacctcagtctcccaagtagctgggactaaaggcatgagccaccacacctggctcatttttgtattttttgtagagatggggttttgccttgatgcccaggctggtcttcaactcatggacctcaagtgatcctctggccttggcctcccaaagtgctgagattgcaggcatgagccaccgtgcctggccttcaatacttatacttatttctaagtcataatttctgagaagttctgccatcacatattgcctttgtaactccatttgtttatagctttttctatagagctaaatgaacttgctatgatgacttggcagtagaataagtgttgaagtgttcaactaagtgacagtatctcaattgacaacttgattattttcttattgttattaaatctctttttagtatctattccttatattggaattttaatctttttttaaaattttaatttggcatcctggtctaattaatctttatttctagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggtaggtatcctccacacgggaagttattcttgtctaacaacacactggtaaagtgaaataagtgtgtttataaatgccctacacaatatagtcttagtaaaactgattatgcttttgcaaataatattgttgacattatagtatcatgacagcaatgcttattagagaagaaatcacttataaaattgcatgtaccaagaatccaattaagttaaattatattcacatagggaagaaggcagttggccagatgaagtgcttatgttagggtagtaatgtgatgagtgatttctcattgttttttaaatattctgttacatatttactacttttatataagtatttaagaaaaagctgctacacagtaaaattagatgtaatagtataatagttgtgtaactatatacaatgtaatataattgtctgtgtaactcagcagttggacagtagttacacaaatgtagaaatgtcttctgaaaaggaacatatacatacccagatttgatttaacggtgagaattatttttaaactaccagcaaattccttaccttactttgtcttttgccttcatactctcaggaggggtctctattctggttcccattgtaaaatattctagagaaaaatacggtagtcattggacagatgctgttctgagagttgtgtgctctgaggaaaagggcactgggtttgggagtcagtgatctggattaggtctcagctctgctgcctactgtatgttctggataaatcactcaagtggtatttctgcctcatggttaagtacatgggtttcaaagtcacatatgcttggcatcttctcttactaagtaggtggctttaacaggttacttctgcctcagcctcaatccctcctttataaaatggggataataattatttttacctcagggcgattgtgaggattcagtaagcacatagtaaatacctagtaaatattcctggtaatgtcaggttttacttatttgtaagtagaaatatgaggactctgtgattaataaattcccttctacctctattaatgatcaaatctatctttttcatagttttcacgttaataataattgggaaaatggttattctgtcttttagtacactacattcttctttaggcatattgacaataatattctcaactaattagggcttctcacgtaggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctggtaagctcctaaactagtaactaacagagtctagggtggtttgcagtcttttcaagcatcgggactttttcactgtgcagttagtagaaccccaatatgttataacacagatgaaagaaagctataatacttcaggcagtttaaatcattattatttatagaattccttaagtacttctgaggaggctgcaggttccatgaaaccagtctgaaatcgaagtcatggtttttaatatatttaagaaatactgcatataaaactgtagtgattctgtctaccctgcattgcattgttactactagcattgcaactaaatgcattgttactactaaatctacctagcataaataaggtttgtatcatgttagtattacaaaccttatgtaagctaggtagatttaaatatacgtatacatatatatatatataaaatcaacttgatatttctttaattcattcattcattcaacagatttgagtacctgctgtatggcaggcactgtttgaagtactgggactatattagagaacaaaatggacaaagatgtcttcccatggagctgaccatctagtccagggagacaaaacaataagtcaggaaaattacggtttagtctaaagagacaaaaattgtagtagtaaagcagaaacaaaggaatggggtgtgttagggtagggagggttgcaattttaagtagggtggtcagggaaggccttgctgaaaaaatgatatttgagcaaaggcatgaaggaagtgatggcagggagttgctggtagaggcgacagcgagtgccaaggctcagaagggtgttagaggaatggcagggaagcctgtggctgcagtgaaaggagcaaggagagagtaggagggggtgaggtcagagagccagcagcagaccaaactgggcagggctttacaggcactgaaaagactttggcttttactgtgagtgagagaggaagcctttgggtgattttctgcagtgacaccatctgacttatgttttaacagcattactctggcttccatattgagatttgactatagaaaggcaaggatagaaccagtcagacatattacaataatccaggcaagagatggtgggaaatgtagggagttggaagtagttggagctcttggatatattttgaaggtaaagccaacaaaatttgctgttagattaaatgtgtagagtgagctgtagggaaattgaaagtgactccagagacttttgccctaagctactggtagaaagcagtttctttctgagatagggaaggctgtgggagaaccaggggctggggtggtgaggactggagggtttgttttgggcatggtaagtctgagttgttcattagacatccacacatggtattgagtaggcatcaactatgcatgtttgagtttgggagatttgtctggactagagatgatgggagtcatcagtgatgttttaaagccatgagatgggttaagatcaccatgggggtgggcgtagatgggaaagagaaggggactaaggactaacccctgcaccctaatgttaagcagtctggggaatgaggagagagaaaccagcaaaggagacaaaagggggacagtcgctgagttaaagaaaacccagattgtggtaccctggaagccaagtgaagacaggaaatgcttggctgggttatttactactgacaggccaaggaagatgaaggctgggagctgacattcaactgagcaatgtggatgctcgggataccatcacaacgtgatggttgtgatactagttttggtggaattgtgagggtagaagtgtgagtgggaatacgttcaggagggactgtgaaaagaggaaaacagcaagtgtggacaattttttggagtagttttgatctaaaagatattagagtaatgaaaacagtggctagagagggaagaagagtcaaggtttttggttttgatttttagaaataataatagcctgcttgcatgttgatgagataatatggtaaaaattaatgcaggggatggagagaattgctagttagagggctttgaggaagtgcaagtggaggggttggtcttgggaacaagcacagttcatctgtgacaactgggggaaggcaaaaatgtaagggctgggatgccaaggtgagtgatgttggtgtgagtgtacggggttctcttccgattgcttcagtttttttagtgagttaggaagtgacatcatcagctgaaaatgaagacttaaggagatgctggaggctgaggagagaggggaggaggaagtggctcttgagagggtgaagatagcaggaaggtggaggaagtttgccgggatagtcgtgaaggtaaagtgagatccctctgtgggcttgcctgcctccagccacattcaccagctggcacagctgcagagtaggcagggagctggattaaccagggttgggattttcccaaatgagggtggtaaagctagagaggggtcagggattcaaaagtgtgaacaggaagagattacaggatttgtccatggaacgaggcagggtaaggagggaagtgaggacaacggaaggacaggcgatcagatcaatgggttataggggtctcaggatttctggagccaatctgctcaaaggagagagctaaaaaataggtggaggtggtcagaatggggtgcttgagatcatagagggtggtgaccagggggagagagtgactgaaggagggcaacacgctggggcaccagaggtgaggaattcaaggggacaaaggccagagtgttggtagcatcaaatgtgtgtatggaagttatccagagttaagactgagtagtactggagagactgacggtggtgagtcgggagctaacagtctttgaggagtaagggggaatgatccaggcttgttagatgactatgagcgtgtagcctttgatgtgagactcaaagctggatttttgtcgttattttcagcaggtagagggaaaatgatctggaagaggcaaggaggataccagcccacctcagggccaagtggaaaaagagcatggcgggggaacagcaagctctctccagcgctgcaggggaagcagtgtgttcagggcaggaggagatggaattgaggacataggggattttgctgatgagggtcagtgagttccagagggcagggtgggaggattttacgtgtggaagggctaggctgtggtgccaggatgggagacggaaggagcagtgaggagattccagtgggcagactggagtgacctgggggtctagggcttcgcctgacgggaaaaagcagctatgaaggggagcatgagattgattcctgatggtttcaacgcagctaatggtgctgaacctgtgagtttggggggtaagaagggtgggtgtttggcccacccccactcctgcccatgtcggcgtggagactagaaggagggcatctaactccgagggcctagggctccctccaaagccctgcccaggcggccagtggagggtggccttgtttttagcatggggctcctgcttgacatttgctggaagaggtgcaggtaactctgaggggcactctctttccatgcagagggaggcttgagacttggaggcctgaggcaggtatttttggcctttctcccctaatccagcatacaacgacttgagaagaaatcatgtcatgtttattctcatagacctttactgcacttgtctgaattttgtaatataacagcaaatgcaattataggcatttatgctgtcctgtgatgtgaagtttcttttgcttgtttaaaaaattctacaaaatcttacactaaaaataatagctttgggaaaactacagttggggcagacttctcaaaatctttggtagtgataaaaactaagacaatcctgggtgtggggacacatgcctgtaatcccagctcctcaggatgctgaggcaggaagatcgcttgagcccaggagtccaagaccaacatagcaagaccctgtctcaattaaaaacaacaaaaaaaagtgcaatcctaataaaaattctagtttgattaaaagacacattaaatccataataagtaaagtccataataaatataccttgtcctttaaaagaaaggtgaagatggcatgatggaagggttgaggctgtggtattatggagacaggggccaatgacaaagatagggaactatatcataagcactttcaagaaagtgcacgtggccaaacagccaaggagaagaaaaggagaagaatacgggttgaaaggacgtagtgtacagcactgcgctcctctggcttgttgtatttagttatgtttgtgcactttgaattcagctgctacttggtggtataaaatattagcacattaggaatgatcacataaccaaagcaacgtaatattttgtactactgtcactaccttacttaccaattgtgtgtaggctatttgtagaaaattttgtattgtagaacagactgtatcttgactatttatatagtcttggaagcagctcagaaaactgtattttggaatctggtaaaggaagaactgcagtattttaccagtactctctgctgtagcatggcccacagtttcttccaggttataaatcagtgtgccggcttattgtccagtctccccaccatgctccatctgggtgaggtcctattcatgcattggtacctagcccaaatactgcattctccatgagaccttccttgcccatctagacggagttagcatgtgctaacatttatacgtatctccatgacttcacaagagtggatctactcttcctatactgggagctcctttcgaagtatgcattgtatttatctctgaattctttcactgatagaaagcctagaacttggttgtctcaataagtttgaatacattttaagtatttgggtttttttccccaagacttcattaatgtctaacatttcatttgtctggggtcttagatggatctctcagaattacagagttcactgaaatttctgttactgttcccccaaccacctcctccatcaggcttattttaagagagccttctaccctcacactccccaatacagagccacatcttcttatttccaattttcctactcagtgcagcagaactgtgatattctgcagttttgttactgtatatttattcttgtacaaagccaatttttgtgtgtgtgtgtgtgagacggagtctcgctcttgtcacccaggctggagtgcagtggcgtgatctcggctcactgcaacctcagcctcccgggttcaagcttctcctgcctgaacctcccgaatagctaggaatacaggcacctgccaccacgcccagctaatttttgtacttttagtagagacggggttttgccatgttggccaggctggtctcaaactcctgacctcaggtgatccacccacctcggcctcccaaaatgctgggattacaggcgtgagccaccgtacccaaccatacaaagccatttttaagaacaggaccaggcacggtggctcacacctgtaattccagcactttgggaggccaaggcaggcggatcacctgaagtcaggagttcgagaccagcctgaccaacatggagaaaccccgtctttactaaaaataaaaaatgagctgggtgtggtggcacgtgtctgtaatcccagctactcaggaggctgaggaaggaaaattgcttgaacccgggaggcggaggttgcggctcatgagccaagatcgtgctgttgcactccagcctgggcaagagcgaaactctgtctcaaaaaaataaataaataaaaagaagaacaatatatatttttaacctgtttagaggaacatttcagaaatgagaggatttatagccagtaataagaacaaaagactttaaattgtgtctgtatgtttttcagtagcattttttatttaccacataggcctgtagcagtttgtggtgccggagaacaaatgttaactgtgcactttgtatgtcctttggagggatgcagtcagtccaggggaggagcaagtgcttagaattctctgctttggttctcatgctgtttcctctcctgccgctgctcctttgctccaatagcttctcctgttccagagtgggcccagcaggagcttggccacaccactccctggagtccagctgttgtggaaaagtggtttcctttctgtaacatcagtggtgccagttccgatttgatggagtcatttgggtaaaacgtttttatatctcttgaatattgattattaaaatcaacgttcagttatctgcatttttttcttaacagaccacattctctgagtatagtctaataatattaaaaagtagttacaaaaataaaatactctcatacttaatatatattgtgagagtatgttagctagataatatgttaacaatatataaatatatacctgccaaaaattctttaaaatttaccaaagtaattcgtcaagttaaatataaataaatactcccttaaagtgagaaaatatttataactaagtatcaatgcaaatagaaaacagcaaacttgaataatgcagctgaatttatacttaaagaagtatttgcagaccgtttttgtaaggaaaaaagttaacaaccgattactaagaatccaacatgagaagtaaataagaaagtaacctccaccctacaaaagataacaacagaaataaatagaaaacaaataaatgtaagtgatcaagagaaacaaaagatggttctttgaaaagccaaataaaataatctatagcaagatcaagcaattaaaagacgaacaatattagaaatgtaaacgatatggcagaaattcaaactattattaagaggtatggttgacgtttattttctccacacatatatccattcagttgttccaacaccatttgctaaaagactatcttttcccactaataactgtggtaccttgtcaaaaatcaactggccacctttgtgcagattgatttctagacagaatacagtccagaaactatgttaataccacattatcttcaatattgcattatagcaataccatatactgtagctttatagcaccagtcactaaatcaggtagtgtaagtcctctaaactttggtttcgtttttttaaaatttttttggttattttagatacttcgcattttcatataaacttcagaaccagcttgtcagtttccacgcacacaaacatctgttgaaactctaggagtgcattgaatcatagataaatttgggaagaactgacatcttaacaatgttgagtcatccgatccatgaacatggtgcagctatccatttatttaggtctctctttaatctccctcagtgttttgtagtttttaatgtacaaatgtggcccatgttattttttaaaattatctctaagtatttttatgagatgtaaatattgaagagtttgaagatagtatgattgtctttatagaaaatccaggcccggcatggtggctcacacccgtaaccccagtactttgggaagccaagccagtgaatctcttgaggcctggggttcaagaccagcctgaccaacatggtgaaaccccgtctctactaaaaatacaaaaaaattagcccggcgtggtggcacatgtctgcagtcccagctacttgggaggctgaggcacaagattcacttgaatccaggacgcggaggttgcagccagccaagatcgcgccactgcactccaggatgggcgacagagcaccacacacttagggaggattaatctgcttcatattggctatatgaatgaagctgatagacccaacacatattccaccctgtgatatctgttcaactaatatcaccgtaactttcttgcactttttaatcagttatatcagataatggaaaatattaaaatacaaataacacattttgaatgttgtgccattttcataatttccttaatgacagatatttagctctaggtggaaaaggatttaataactaatcacccctcctgcctgccctacttcctcctcttctcatcaatcccaaattagtttattacaatgtgaaagaattattcgaagtcattgcaatacttactacaatgtgttaacatcattttgtactttgatatatggaaactgagtaaaaaataactatggaagcttgaagtgaaatagttgccataattagacttgcatcctaattcatgaagaatcctattaataaaagtcaatattatatgtaatggttaatggttttgtgaacaagacagctttggttcctgcattcgttcaaatcgaaaatgagaggagggacattttctctcctaagaaaatatatttttgaaggcatcttgtggggacatctttttggttagctttttagaggatagtgggtattttggtgttatttctaaagcattttgcaaaattagaatgttggttttattctagacatcttgacttcacaggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgtatgtacctagaaaggctgtttcttaaggcattcttttttgagactgtatgttttaaaagatgggcatttcctgaaatgaggttgaaatggtaactaaataaagaagggcaaatttttatatttaaattttaaaataattacattagttcaatagtgatttttaaaaaatcaaccagtcttatctgtctaatgaataagccatcttcatttttaattatgatagaaattcaaatacaactttgtgttctgcttattagtattttttcttttgctaccttgcctttttagatattattccatctcattgcttaactaaatttacaaaattctcatgttgttgaacatttagattgctttcagttttcatcattataaataatactgtagtatacattatgcgtataatttgttttttaagtaattaccttagcagaagtttccaggaaccagttactgtgtcagggtatgaaaactggctctttatgtagattgctaaattgtcattcagaaattttcatcaccatttttcgtggccattgggtaacaccaaaataagtctgtttggcatttgccttatgggaaaaccatccattgagatgtttagttccaatccaatcacattgagatgtttagttcctaaacttcggttaaaagaaaggttctctttctaccctgtgtgtgggcagaaagagatgcaagaacttcctaattcaaatcattctggagggatatgcttcattttgatattctttcacagtaatctgaattaaagtagttcttctttccacagaagtggaaggcaatttactttccctcctctgatgttgttttggtaggaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaaggtattcctcttagtctataatttactcttttataccccgcttttttaaaaataaaatttaatcgtacccttagtttattgactatctgctacatgcacaaaaaggtgttatggtgaatacagtaaataataagataatgtgctattcttagatttatgatctagctacaaagataagggaggcggaggttgtggtgagccgagattgcaccactgcactccagcctgggagacagagcgagactctgtctcaaaagaaaaagaaaaaaagaaagaaaattctgaggtgtaaattttatgctgctttacagatttttttttttcctgtggaatgtgagagccatagatgataatcagtttgaatgggacagaacacctttagtgggctagtaaaggtgtgtgaaatgtgcttgatacatgcaagggaaggctgaaacaacagtactgaagacagtgtggcaggaacataatttctggactagattctgtctagcagtagacctgcacaatagtgggcaaatgatttttgacaaagatgccccaataattccgtgagaaagacataatcttttcaataaatgatgctggaacaactagatacctttatggaaacaaaattagaccttacttttaatagtattttgtattcctgctatttttaatatttatgccttccatctctctctctttaattgctcaatcttgctatagagttttctgttttattcctcttttctttttttgttgttttttgagactgagttttgctctttttgcccaggctggagtgcactggcatgatcttggctcactgcaacctctgcctcccgggttcaagcgattctcctgtctcagcctcccgagtagctgggattacaggcgcatgccaccacacccggctaatttttgtatttttagtagagacagggttttatcatattggtcaggctggtttcgaactcctaacctcaggtgatcagcctgcttcggcctcctaaagtgctgggattacaagtgtgagccaccgcgcctggccttatttggcttttcaaagaaccgtcttttgtttctgttgattgctgttgttgctttgttttcaattcatttctgttctttatgattaccttcctacctttatttttggggtttactctctcatattacttcacgtgttggacccttagatagttaatagtttttaatttgtctgctttacaaaaataatcacttgtctaaagtctgtacattttctctttaagtataactaactgcattatgtatttactgttttctattttcattgatacttatttataaatattttctgacatccataatataagggagtgttttataattagcttttaatatttttgaactgtgctcaatgtggtctgtaagattgattctttaatatttgctgaaactgacctaatgtgcacttgaaaataatgggtattctctaattgttgaatatctggttttatacgtgtctgtacatcaagtttattaatgtttgaatattcaacatttttagtaatttttttctgctgcttttatctattgctaagatgattgtattagtcttccactattgtattgtctttgctcctttgtcaaagatcagtggaggccaggtgcagtgactcatgcctgtaatcctagcactttgggaggctgaggcgggcagatcacccgaggtcagtagttcgagatcagcctggccagcatggtgaaaccctgtctctactaaaaatacaaaaattagccaggcgtggtggcaggcgcctgtagtcccagctacttggggttactgagtcatgagaatcgcttgatcccgggagacagaggttgcagtgagccgagattgcgcccctgcactccagcctgggtgacggagcaagactctgtctcaaaaaaaaaaaaaaaaatccgtttactatatttatgtaggtctatttccaggctctcctgttacattgatctctctattcttttgctaatatcacacaaactgtcttgattactgtagctttatagtaagtcctgaaggttggtactatcagtcctcaaactttgtttttctcattcaatattgagttagttattctgggtctttcgcctcttcatataaactttagaatcagtttgtcaatatgcagaaaataacttatttgatagggatcacatagaatctatagatcaaattgggaatctgaaatcttgacagtattgagtctttcttgctgtgaacatggaatatctctccacttatttagttctttgattttgttcacagaattttgtagttttccgcatatagatcttatacaaattttgttagatttaatacctgggtatttcatatttagggggggtgctaatttaaatggtaatgtgtttttaattttaaattttgcttgtacattactggcatatgggaaagcaatggacttttatgtattaatcttgtatcctgcaaatttgctataatcacttgttagttccaggagttttttgtttgtttgtttgtttgttttttttagtagagatggggtttcaccgtgttagccaggatggtctcgatctcctgacctcgtgatctgcccacctcagcctcccaaagtgctgggattacaggcgtgagccaccacacccggcccagttccaggagttttgttgtttgttctttcagattttctaatcatgtcatatcaccaaagacagttttatttcttcctacctttaaattgtttgtttgtttgttttgagacggagtttcactcttattgcccagactggagtgcaatggtgcggtcttggctcactgcaacctccgcctcccaggttcaagtgattctcctgtctcagcctcctgagtagctgggattagaggcgcccgccactacgcccgggtaatttttggtatttttagtagagaagaggtttcaccatgttggccaggctggtcttgaactcctgacctcaggtgatccacccacctcggcctcccaaactgttaggattacagacgtgagccaccacgcctggcctcctacctttaaatttttaacacttaaacttggtatacagagccttaaaattaatcacttggctgggcatggtggctcatgccagtaatcctagcactttgggaggccagggcggatagatggcttgagttcaggagttcaagaccagcctgggcaacatggtgaaaccctgtctttaccaaaaatacagaaaataagctaggtgtggtggcacatgcttgtggtcccagctactccagaggctgaggtgggaagatcacttgagcctgcctgggaggtggaggttgtggtgagccgagattgtgccactgcactccagcctgattgtcagagtaagaccttgtctcaaataaaatgaaataaaattaatcacttatctctgtagtttctcagtctctggactattgacattttagaccagataattcttcgttgtagggctgtcctatgtattgtaggatgtttaacagcatccctggctcctacatactagatggccagcagccacccccgcccccaccaccatcagtcatgacaatccagacaaggccaaatgttccctgcaaggaaatattttccccagtggacaacaactggcctaagtaatacaaggacttgagcaagatatgattaatccattttattttatttttttctcagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtaagagggtccagatattgttgtttgtcatggatgtagtggttggttggttggttggtggtggatttggttagtgtcttggaaaatgtctgttatgtcatatgtgattcaaaaatggtaagataagtaagggagtaagtacagttccagatctcagaaggtggatatggtgaactggtaaggcagaaatcaaagagatggggtgagcggggataattacatataattctctcctaatgaaaagcctttcctcatgtgagctatatgttagctgcatgattaagccagtggtttttaaccctggctatactttagaatcacttacagcatttaaaaaatatatatatgccaactaaccgtggtggctcacgcctgtaataccagcactttgggaggccagggtgggtggatcacgaggtcaggagtttgagaccagcctggccaacatggtgaaaccccgtctctactaaaaatacaaaaatcagctggatgtggtggtaggtgcctgtaatcccagctactcgggaggctgaggcaggagaatcgttttaacctgggaggtggaggttgcagtgaggcaagatcgtaccattgcacttcagcctgggcaacggagcgagactccatctccaaagaatatatatatatgccttgctctctccagatgaactgaaacagatctctggggttggcgcttttaaaaagccccctggataatccttttgcactgggagtgttgcaaaccactgttttagaccgtgttgttgttttattcatgttcagtggccatcacggagctccttctctaaagcaaacaggaggatttgtttatgatacttaggtttcttaagcactgctttatggaacgtttcttttaagacactttatttagggcaggcttgttttatccatgcccactagctctcaaaataacttttaccatgttctttttaaagatataaaagaagaatattcacgtcactttttcattcaaatgaaagaatagagaagtttataagggaatatatttccctttagtcaactgtgaaagaaattagaaataatgacaagtaacactattctcctatgtaataattttgtatttttaggtgaactgcctgaatcaagtaaaaagtagtctcttaaaaactagtaaaagtcttcgacagaatctaggaaaaaaactggataaggaagacaaagttagagagtaagtaactaccattttttaaaaaatcatcactctaaaagctgtgagattagctcgtatcagtttaaaatagattgttcgtgacatggtggctcatgcctgtaatcctagtaccttgggaagccaaagcaggaggattgcttgcagccaggaatttgaggccatcctgggcaatatagtgagaccgtgtctaccaaaaaattttttttaattaggtgagcatggtggtgtacacctgtagccctagctacttgggatgctgaagctggaggattgtttgagcccaggagctcaagactactgtgagctatgatcccagtactgcactctagcctgggcaacagagcaagaccctgtctcaggaaaaaaaaaaaaaaaaaaaaaaagattaccaactgcatgaagatgcttttgtagccaattcttttttatgttataatatgcagcttgaatcacctatttatctaataactacatcagtttttagaaaaggcactggctctcctcctttttggttgttgtgtcttatataaatagatctatgcttacggaaggagctttttgtttagtgacatccaaagtagatatgaccaagtatttttttctctcaaggtgccagcttcaggtatttcttcgtttggagatgtgtctgcaatgcccttcaataaatgaaagtacagatgatatggaacaagtagtggaggaggcaagtatatagtttcgtgccattgaaatacgccctagatgctttcagcttccctgcagagggcatctatatagtaacgttctaaaatctccttcaggtgacagatttgctgcgcatggtgtgtttaactgaggattcagcgtacctagcagagtttctggaggaaattttgagattgtaagtttgatggttactaacttaactttaaaattgttttgtcaaaacctatgtatggtgttgtctctgaattttggagttgtaaggactactttttaggctgggtgagggagggaatagagagggtaagatggtaactgttccgtattcgatcaatctgttccacaggtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggtaagaggtcaaagaatcaaaggaattatttgcactgttatagttctgataaaagatgtgtttaaactacagtccagtcatctttgtccatataatttgttgaactaatagctgcccttatgtctgaatcagagaagccaactattagagctcctaataggagcatctgacaatctttatattatctaggaaatatatagtcatgttttgcttaacaacagggatacatcctgagaaatgcattgttaggcaatttttgttgtactaacatcagagtgtgcctaccaaaacctagatagtatatattttttcatttatgtatattttttcatatggaaaagctaatgttccagcattgttactgaatagcagtcatttcccctacttgatctgtaatgccaatatcaagtgtcatttattaggtttctatataggctccattataacctatgggaccattgtcatatatgcagttcgtcattgaaggaaacattgcatgactgtatagtgtttatttcctatttcacaaagtcttctttactgtccacatgaggtctccagaaactaggccttctatgaaataagcttagagtttcagctttttaaatttcccttgatgcttttcgttgttcataactggttgaatttgttacttttgaaaattctggggtgacttgttttattataaacccagaacaaccttaagataactggcttttatttaaatcatattttattttacttagactccagttccatttgaatttaactatatataacctctatctagtatgtattaactatttctatttttaaaaggaaaaatgcattaataagacataaaagcattgctgaggtttcacagaatcttcgacaaattgaaattcctaaagtgtcaaagagagctacgaaaaaagtaagtaaaccttccagcttgagatgacacagtaaataagaacaaaaaggcagtgtccctacttttaggaaaatgaactttggaggatacagaaataatattaaatatttttatgaatgtgtataaaactataatccaaggaataaagaaatataaacttgtcaagagattaacaattttactcaagagtgtgatagttagaggtaatgtgaagaaaaatggcaagtaaaagttaggaatgaattaattcaaaatctttaatgtagataggaaaactcataaaacaataactaaaataagcaaagcagtcactggaagagaatatacaattgtaagtggactttggttgcataccagaaggtgcttttcaatatgttatattttactttaataacaaatttaggccaggcacagcggctcacacctataatcccagcactttgggagtcagaggagggaggatagtttgacaccaacagtctgagaccagcctggacaacatagcgagaccctgtctctacaaaaaataaaattaagaaaaaattagccaggcatggtggcacatgcctgtaggcccagctattcaggagtctaaggcagggagattgcttgagcccagtaggtcaaagctgcaatgagctatggtcgtgccactgcactccagcctgggtgacaaagcaagacttcatctcttaagtgaattaatgaatgaataaatgaatgaataacaagttttttgaaaaagatgatgaccatcatggagccaggaggtggagtagtcgccccttatctgcagaagatatgttccaagacccccagtggatgcctgaaaccacagatagtactgaaccctatatatagtactgttttttcctatgcatgcataagttcaatttgtaaattaggcacagtaagagattaacaacaatagtaaaatagaacaattatagcaatataatataataaaagttatgtgaatgtggtcttcctctcaaaatatcttattgtactatattcacccattttggggccatggttgactatgggaaactgaaaccatggaaagtgaaatcacagataatggggtactattgttgtttttttcatggcagttgatataaggacttgaggtttttattggttgaaaaaaaaataaacctagctggaatctgtttactaagtagaattaatgtctcgctgaggaaaaaagggagactaaaaacacaatgaaacttttcaactgcatgaactatctgagaagagttaaaattcaataagaactatctttagaagcattaattattataatagtggtttgttctgtttctagatatttgtagcagtcctttggaattggaggtgggatttcttttaaatggttaatggtgttcactttcttatactttgtgaataaaatgcatatcttatatatctcacaatcctgattgaagattggaaaatccgaaagtgaatggccaaaagttgccaggcctttattctcactagattttacaatgatttgcagatctttctagcacactttgaaactttggttttagattggacaagacagttttcttctctaagatcagaattaacgcctgggcgcagtggttcatgcctataatgccagaactttgggaggccaaggcaggaggaatcacttgagcccaggagttggagaccagcctaagcaacatagtgagaccttggctctacaaaaaatttaaaaattaggtatggtggtgcactcctgtagtcccagctactcgggaggctgaggtaggaggatcgcttgagcctgggagtttgaggctgcaatgaactatgatgaagccactgcactccagcctgggttacagagagagactctgtcaaaaaaaaaaaaaaaaaaaaattgaggtcaggatttgattgtggttagtaatgttttttcatgtcaaagttggtaccatagataagtgacaattgtttaactgaaaggaccagatgttacatttttaaaagaataaatctcagttctctgaaggaccaatatagttaactcgggaagcagtgaacttacaacttaagcgtagacatatagtattaattacattaatgtatattaatttcttttacgtatcttaactccagaagatcacaaggattaaaaaaaaaatatttgatcctgccttaataccttcaggacatactctcctagtttttcattcaattacatggattaacaagggttgacaaactttttctgtaaagggccagatagtagatgttttagcctttgcaggccatacgtctctgcaacatctattcagttctgctatagtggaaaagcagctacaggcattatggaaagaaacgagcatgactatgtttcagtaaaaactttattttcaaaaacaagaggtggcccagatttggtctgtacactgtagtttactgaaccctggataggaaattggatgtatgacttttatttttatttttattttttgagatggagtctccctctgtcgcccaggctggagtgcagtggcacgatctcgactcactgcaagctccacctcccgggttcacgccattctcctgcctcagcctcccgagtagctggcgtgcaccaccacgcctggctactttttgtattttttagtaaagatggagtttcaccatgttagccaggatggtctcaatctcctgacctcgtgatccgcccactcgacctcccaaagtgctaggattacaggcgtgagcctctgcgcccagccggatgtgtgacatatttttacaattatagtttatctctttataagagttattaatcaatataagtaagaatgatcacatctcatgtcttatcagcaagaccttggttatatcactgagaccatttgttaagtttctgcccatatgtggtggcttcttcaattattatgatgaattgaaaaaacaaaaaatctttaaaaaaacagtttccttgttttgatgcatctggggtttagactcttgaatcttctattgtaatagcaagtacatagcagtctgataaagaaatgtttctgagagtatagcctccctctaattaatgtatatggcttttcccttattaggtataaaaggtatgcatgattatcgttaaaaagttaaaacatataaagttaaaagttagggtgttccttctccatccattcatcagaagtaatcactgatgatagtttgttgtgtatatttccaggcccttttctatatgcaccaataacaccaaagatttatgcagatccgttatatacatatatataaatgatataacttagaatacttaatattttcctttttcctccctatcacagatctctatgttagtacaagttgagtatctcttacccaaaatgcttaggagcagaagtgtttccattcttagatgtttttggattttggaacatttgcattacatgtacttactggttagcaccccacatccagaagtccaaaatgctccactgagtgtttcctttgagtgttgtgttggcactcatgaagttttggattttggagcatattggattttcagattagggatgctcaaccatatatagagaggtcttccttccttactcttgtaatgtctgcattggatgggtatgtaatttatttaactgtttcactctttatgggcatttatagtgttttttattttgtgttattactatagtgcagcattgagtgtttttggaacatttctgttgtacattttattatttctattatggatccctataaatgaattacaagagtcaaagagttcatgtgaaatctttattcttttatttcaatgaatgcctatttaaattttctttctggattttctcatgtttcaggagaactctcaccctgctcctcagcagccttcccagccagtgaaagatacagtgcaaggtatactgttttctcagtgtatgtatttattcactagcatgacaactttatttttattgtatgtatttaagcagctgcttacaggtgtaaattaaggctttgtatgattgttggctaataaaatatgtccaaataccatggacatagtcccctaggaatagtctcaaaatattgtattttacaaaataactggtctgaaatctttaaaaacaaaaacaaaattaaaaaaaacatcatgaaagctggaagaaaggaaaaagaaaagaggcagtgggactgtttcagatgaatggagtttaagcatgatagctaaatgcattccatgatccctgcttggatcttaaatttagggaaaaaaatactagaaaggatattactgagacaactagagaaatttgaagaagcggtgtatgctagataatattgtatcaatgctaaagatattttgagtgtaataatggcgttggggttatggaggagaatgtccttgtttttaggagatacatgctgacctttaggaagtgaacagttgtttgcaatttactctccagtgtttaggggaataacgtacatacagagagaaggaaggagaaaacaaatattgtcagttggtgaactttagtgatgggcgtatgtttaattttattattatttgaaacttgctatagaaattaagcttttcaaaacattgggaaaatagagaataacaaaccaaatttggctttcaggtcataaatcaatttcaccaacagcctaagttaggtaacaggaactcttataatggagataaggaaacaatttttaaaactttggtgtgtgttattgatgtccttaataaccttaatgtgaacctttatgtcattgatgggtaaacacaagggttgctcccagtttgtggatcctagattatttggtttgggtttaaatgattaatctttgaagaattcacccttggtgaatttttggatcacttccaccagactatcttaagattaaggtattgtcttgctggctttgccacgtacttcttgacttttcagctatttttttctaactttgagtctagatgatgagaactttcatgctttggagtcaagaataaaatttaaaatgtcccagcagcttagtaaagtagtcagaagaagaagaaagaaattatagaattgaacaattctttgctcaatgctgagctgaatacacagcagcaaaaatgtccaaagtgagaaaaataatcataacatgggatatattaaaaggacgatgacctatgttagccatcctcttacttaagaattatgtccatcttacattgagtagcttctaactcaataagtggtgggggccttccttgtgttcctgaaaagttagatttaaattgaattcgtaatggaatactacaaaccactgtataccaacaaattgtataacctagatgaaatggacagactcctagaaagatacaaactactaaaaacagactcaagaagaaatagaaaatcagaatagatctataacaagtaaaaagtttgaattagttatcaaaaaactactcacaaagaaatgcccaggactagaagttttcactgctgaattctatctagcctttaaaaaagaaattagcactagcatttattatggtcaactgatattcagggtaccaagacaatttgatggagaatgaatagtcttttgcacaaatgatgctgagacaactggatatccacatgcaaaagaatgacattggacccctacctcatgcaaaataacatataaaattttttttaatttgcaaaagtaaatatttttaatgcattatgggaatatgctatttaaggaaaccttattagcatatgtgacaatagcaatctgtagtttcctcaaggagcttctctgttttggttatcttttctcagatacggcatttattgatgataatctttgggtttttctttttcttttaatttttgatgctttcagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggtaccacatttcagaatagctaggaaaaaggaaagggagattctgtaagattagtagtaatgtaccgtctttctttcctgatttagtaatttgagtcttcttccctcttttttccttcagtctagctaaaggtttgtcaattttgttaatcttttttttttttttttttttttttttttgagacaggttcttgctctatcacccaggttggagtgcagtggcgcaatctcagctcactgcagcctccacctcccaggctcaagtgattctcccacctcagcctcctgagtagctgggactacagatgtacactaccacacccagctaatttttaaaatttttttgtggagacatggtcttatcatgctgcccaggctagtctcaaactcctgagctcaagcgatctgccctcctcggcctcccacagttgctgggattataggcatgagccaccacacccagtcaattttgttaatcttttcaaagaatttactttggtttattgttttttctctattggttttctttgtcttttttttgagtcagagtctcactcactctgtctcctgggctggagtgcagtgccgtgatcttggctcactgcaacctctgcctcccaggttcaagcgcttctcctacctcagcctccccagtagctgggattataggtgtgcaccaccacacccggctaatttttgtatttttagtagagacggggtttcaccatgttggccaggctgctttccaactcctgacctcaagtgatctgcccgcctcagcctcccaaagtgctgagataggtgtgagctaccgcgtctggcctctattggttttctaatctcagtttcattttttttttttccctctattggctttggtttttgtttgctctttttctacttttttaaggtgaagtttaagctattgatttgagatcttttttaataaagcactgctttaggcatatcctataaattttgatatgatttgtttttgttttcatcatctcaaaatattttctaatttcccttgtgatttcttctttgatccattggttatttcggagcgcattaatttccacatatatgtatttcctaaattctcttctctgcttattctagtttcattctattgttgtaaaacatacattgtatgatttcagtcttttgaaacttgagacttattttgtggcttaacatttggtctatcctggagaatgtttaatgtgtgcttgagaagaatgtgaagcattctatagatgtgtgttgggtctagtggatttatggtattattcaagtcttctgtttccttgttgagcttctgttttattgtttatttattattcaaagtggcatattaaagtctccagctattattgttgaattatttatttctcccttcagttctgtcaatttctgcttcatgtattttgagactctgtacttaagtatatatgtcaataattattatgtcttcttgatcaattaaacttcttaccaataggtaatgtactttgtgttttgtaatctttcttggcttacagtctgttttgtctgacaataatacagctccccacccaccagctcttttgcataggatatctttcattgtccttttactttcaaccttagtgtctttgtatctaaattaaatatcttatagacctcatagagttggatcatgtttttttaatccattcttcttatctctgcttttcaattgcagtgcttaatccacttctatgaatgtaattactaataaggaacaactgtcattttctatgttttatgcttttttgtttctcaattcctgtttttttgtatttagctgattttttgtagtatactagtttaattccattctttctttttctgtgtatttttaagttgttttctcagtggttaccttggttaacccagctactggttacctcagttagcatcttaagcttaaaagaacctggctttatgaataaagccaacctcttttcaataatatacactctgctactatgtatttctgtctcttcttctttatattgttgtagactgcatctttatacattgtgtacctgttaatacagacttaaattatatagggtttaaaaaaaaaacaaaattaccataatgctggcttttatatttatctgtctagttacctttaccgttgttttttatttcttctcatggctttgagttattgtctactacctttcattttagcttttcttacagggtaagtctactgattatgaactccctcagcttttatctatttggaaatgtcttactttctactttatttgtgaaggacatagaatttttggttgacaatttttttttcccccttcaggacttcaaatgtgacatccactgccttctggtctcccaaatttctgatgagaaatcaactattaatcttattaagctgcttctctattgctgctttccagattctctctttgtccttgggtttcaacactttgactacaacgtgtctcagtgtgaatctcttagagtttattcagcttggagttcgtggaacttcttggatgtatatgttcatgtctttcatcagatttttggaaggttttaaccattatttcttcaaaaaattttctgccacttttggtctcatttcctccttagactcccatgatatatgtgttggtacacttgatggtgtcctacaggtccctcagactttgttcattttttttttaattattttttctttctgctcaggctggataatttcaattaccttatcttcacgttcactgattcttctgccagctcaaatctgtggttgacccttctagttagttttttcatttcagctccagaatttctactggattcttttttatcatttctattgctttattgatattctcattttgttcatatattattttcctgatttccattagtttcttatatatggtttaagtgagctcattgtgcatatttagagaagttgatttaacatctttgactagtaattccaatgtcttggcttccttagtgacggtttttgccaaatttctcttttctggtaaataggccatactttcttgtttctttgtatacttcgtagttttttgttgaggactagttattagggatattataatgtggtaactgcatggaggtcagatcctgtcacccctcagggattcctgttctttgcttattaaggatctcagctattcatttgtgccttttctgaactatttgtgtaaagtatgtataccttgttgtgtgtggtcactgaagtttctgtctattatctctgtggtcagccaatgacctaagaaggatttccttaaatgtctgattcaagaaacgaggagggggaaggtgtgtctgtcccttaaacttctgataattgggagaaacccactgtagcctaagagagctgaaaccaaggcagtgtctgcactgctcctacaggaatctgcctggttgaccaaagcatgcaacccccaatttttggaggacgaggtcttcactgtctgccctagcaccagccagctgctcctggaatgtgggctgctatcccaatagctacagcagggatgagaaaagggaaatggtagccagttcatgcacatcattcccttcctaaagatcatcagtctctcccatcatcaagcacttcctaggttattacaggtgttcaatcaagttgccaggttccaaaatagtgaattctgatctttttttctagtttactagttatttgggttgagggactgacccctagagctttcttctccatcatgttgcataacctcactccccttggagattacaattaagatattaacttataacagcctagttctcattgataccaatttaactttgacagtttataaaaactttgctattgtatagttctactgactatcccttcttagttctatattgtcatgcaaattacatctatacattgtatgcccatcaacactgatttataatcattactttgtattttaaataacaggggggaacagttacaaataaaaaacacttttataatgtttttcttatatagttacctttaccaatgctgtttaactctttatgtggacttgagttaccctagtgccctttcctttcagcccacaggactccttttagtattatttatagtgtaggtctgctaatgacaaattctgttttattttgtttcattctgagaatgtgatgatttctcctcatttttgaagaatactttcattgggtatagaattcctggttggcagtcttttttctctcagcactttgaatatgtcatcacactgccttttgtcttttgtttctgacgagaaagcagctgctaatctcatcaaggatctgtacacgatgaatagctctctggcttctttcaagatcttctttttttcacttttgatagtttgattatgatttgtctggttttggatctctttcactttattctacttgtattgagtttcttagatgtgtagtgtctttcatcaaatatgggtcatttttagccaatatttattcaaatgttctttctgcctcttcctttctgtcctttccttctggacttccggtatgtgtgtgttgtgcttgatggtgtcacaagtatctgaagctctgttcatttttcttcattcttttgtctttatcttccttagactggatcatctcaattaaccttgtcttcaaatttgttgactctttctttgccacctcaaatttacttttcatttttgttatactttttaactctagaatttctattcgcttttttttttttttttttttttccgtctgttgatattctctgtttggcaagtcattggactcatattttagatctttaggtatgattttctttagttctttgaacatatttaaaacagctgatttaaagtcttgttctagccgggcgcggtggctcacgcctgtaatcccagcactttgggaggccaaggcgggtggatcacgaggtcaggagatccagaccatcctggctaacacagtgaaaccccgtctgtactaaaaatacaaaaaattagccgggcgtggtggcgggcgcctgtagtcctggttactccggaggctgaggcaggagaatggcgtgaacccaggaggcagaggttgcagtgagccgagatcacgccactgcactccagcctgggcaacagagcgagactctgtctcaaaaataaataaataaataaataaataaagtcttgttctagtaagtccaatgtctggactttctcagggacagattctgttggctgattttttttcccctgtgtatgggccatacttttttgttttgtttctttgcatgactcataattttgttgacaactggatttttttttttttttgagatggagtcttgctctgtcactcaggctggagtgcagtggtatgatcttggctcactgtagcctcaaactccctgacttcctggcttaagcaatcctcccacccacctcagcctcccaagtagctagctggactaaaggcatgcaccaccactcctggctaatttttgtatttttttgtaaagatgtggtttcaccacgttggccaggcttgtcttgaacttctggactcaagcagtccgcctgcctcagcctcccaaagtgctgggattacaagcatgagccactgcacccagcatggatattttaaacaatataatgaggcagctgtaacaatcagatccaccccaaccctgccaggatttgttattgtttttgtttagtcacttttctaaactatttgtttaaattttgtattctttatcatgtgtggccactaaagcctctgctcagtggtcttagtggtcaactaatgattggacagagatttccttaaatgcctggaacccataagtttcacagcccctactgaggggctctgtgtgttgggtcatgccttcaacactcagccaggcagtttagaattccacttcactttctgttttgccagagcctcaaggttagccataggtggcagcttacaggcttctcaagtctatcctcggcacatgcacagtgctacacgtgtgtggacttttggatgcctaagaatgtcatcagagatttgcaaagtcccctgtgatgtctcattccccaattttcccaattaaacttttggccagcttgttattgcaccaaatgttaccaccacctcaggcagctgtaacatttaacaattgctgctgattgttttcagtaaatgctgtcagggaaaaaggtggtttacactgtatgagttctgagtcaggtcaaagcaagacaagccttgatttgagtaggattctccagggaactgccagacaggttaatggatgacagttatctgagaatggagttttggaggagctccaaccccattctgccctgtccagaggctgctgggctgttggttttcactgtgattgtgggaaattgatttttaaagctaccgtagggctagggggaaggggcagggactaaggcaagttaaagcttcctgagattcaaccatttttcttgaacaaatactccctagattgttgcaaacctttaattaatgttcagagttctggaaaagatttttgaccatttttcccagtgatctctgttcctttatggaggagagtgttcagaggtccttacctcaccattcttactggcatcactcctctttactaatcattttaagctcactttaaatcagtcctctcataagtagcttggctgcctactctactaagaaattttatgccacctacgtttatcttaataattaacatttatgtggcatatcggcattttcacatatttcatttaatcataaatactagaaccaccaactaggtgttagtcttaacaagtgagcaattttcattttttcaggattgcttattagataaaattttatatttatattgtcttttttttttttgagatggagtctccctctgttgcccaggctggagtgcagcggcatgattttggcacactgcaacctctgcctcctgggttcaagtgattctcctgcctccgcctcccaagtagctgggcttacaggcacgcaccacctcgcccagttaatttttgtatgtttagtagagataggctttcaccgtgttggccaggctggtcttgaactcctgacctcaagtgatccgccctcattagcctcccaaagttctgggattacaggcatgagccattgtgcccagcctatatttacattgtcttatgtcattttttaatctctaatagtgctgacaaacttctatcatgttgagtcctgtaaccatagaacttagcccaaagaccattaagatcctctccagctaggtaataagccatacagaagttcaaactgctcccttggccttactgctgcttcttgatgaggttaaatgaaatttatgatttaagctgtgtttacattttaggttatcacaaactgctgactaagagtgtggccgagactccagtgcataagcagatctccaaaaggctgctgcacagacaaatcaagggcaggtgagtgacatccccatccgggcttcttcatacacccacaccacctcaaagcggccttgtgggccactacttcgcttctcttgaccttcatgacttaaatcttaactatgttgcttaaaaccaaagagcattctataagctctccatgggagcaggagaaccatataaaatatacacttgtctggcctcaattattttgagattcatccatgttgttgcatgcaatagttcatcctgttttattgctgagaagtattccatggaatagatactccacggtttttaaatccattcatctgtgaacatagagaaggtggaagtctgggatcccaactcagcctttgctgacagaggtgtgggtggggctgcagttttttctgcagcgattggttggagtagggctgttattgtctgaaagttttctgtcttgcttggctgaccctttcctagttctttggcttgagagctctccttccttggggcatctgtagtttgctcctggtatacctgggttgtcagcttttctggcacccagtctaggggtgtaggcagcaaacagaaaacccagggagctagctcactgccctcctcaggtcccaaagtccccagccaggctgccttcttctctctgcctttcagaattgtctcctgctcattgtatagataatgtcatgggtttttagcttgatttcaagggtaatagaagcacacctccttctattttgtcagaaacccatctcgacattattcgtatatggattttacacacttgtgaagtttataggttaaattgcgaaaagtgaaattggtgggtcagaggcatatatatttttaattaaattttttataacatccttgacacattggcagaaattaaggctcttaaacagaaacttgaatgttgctgctcattactgtgatagtctgatagtttggtataattttttaatatattaatggggtttataattctgatgttgtaaaattgctttccaaaaaataaaagcaaaacaaaaccacattctaaccatctcactctttttctgagtaggaatctcactctgtcactcaggctggagtgcagtggcacaatcccagctcactgcaacctctgcctcccaggttcaagtgattctcctacctcagcctccagagtagctgaactacaggtgtgtgccactgcacccagctatctttttttttttttttttttttgagacagagtctagctctgtcgccaggctggagtgcagtggcgcgatcctggctcactgcaacgtctgcctcccgggttcaagcgattctcttgcctcagcctcccaagtagctgggactacaggcgcatgccaccacgcccagctaatttttgtatttttaatagagtcggggtttcaccatattggccagactggtctcgaactcctgacctcaagtgatccgcccgccttagcctcctaaggtgctgggattacaggcgtgagacactgtggccagcctccctcttgacaataatcacgtatgagagccctttaccagcactggtgttatcagaccctgtgatctttgtgatcttgttaagtgagaagctgcctgtctccttaataagtgttaattacaagtggtatggagtaatccttgtgcatgtggttcctcgaggtcctctgatcctggtcctgatattggtgttgttgaagagtcccctgaaaaaggagatggtgagtgttatctctttttgtttttaatgcaatctacccagcttctatgaaaacctttctgtatgtattgttacttggcatatcctaagatattttacagaaattgtgatggctctgagtccacaatgcagctcagtaaatatttataagtgaatgttcttctgcatagaaggtactgagagaattctggaaaagaaatatttttgcacaacagatatgaaattcaggatgagggctaaactgtgttatacaaagtgctatgacttattttaaaagtatatataactttgttggagcttttcactacatattttttcaagaaggcagggaaattttttattggggagtgtcttttctgagacattatctttgctgctgccccttatgtatctgtgtattccgtgcccccaacacacagtgcctggcacatagcaggtgatcagtaagcacatgttgaatgagggtgagcagcaggtgtggtggttcacgcctgtaatcccagcactttgggaagccaagtggggaggatcactggccaggagtttgacaccatcttaggcaacacagtgaggtgctgtgtctataaaaaatttaaaaaatcagctggtcatgttggcatactcctatggtcccagctactcgggaggctgaggtgagaggatctcttgagctctggagttcaaggctgcagtgagctatgatcgtgcctctgcactccagcctagcgacagagcaagaccatgtctctaaaaaataaaataataaaagtatacatgatgaaggaggggttttaaaaaactaacttctaagttgctcaagtaattcacatttattgtggaaaaaacaggaaacatgaagccaaaaattttaaagcacttggtaattccacaactcagaaatactctaacattttagcatatactcttactgctattatttctatataaatgcatgtaacatatacatacgaaacctaacataaatacttgttttcgccctacaccattcttctttttttttttttttttttggtgagacagactcttgctctgtcgcccaggctggagtgcactggcatgctctccgctcactgcaacctccacctcccaggttcaagcgattctcctgccacagcctcccaagtagctggggttataggcacccaccaccatacctggctaatttttgtatttttagtagagacagggtttcaccttgttggtcaggctggctacaccattcttaaggtggcagtaaataagacttctgaaggtaatagtctagtgggtcagtgtttttttaataccttgttgggaccatgtatcaaacccctcttagtttgttaagagacacttcagaagtctcttaaagctaatagcttgctgaatttccatcttatatgtggtactatgtaaattttgcccggttttggacaacatgagaaaatgtcaagcttgtagttgtctttggttacttactgtggttctgattttacagaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaataggtatgtctagttgaggttcagggtgatggctagatggacagtccatgactttgtaatcagtcatccctaggactcctacaactggtcatccatgctatcattataggtagctcattcattcaagaggaagctacccataatttcccataaggacagaacctacacatcattatcttaggtggaaggtgatatctgtgtttacgttcttcattcttctatccatggttagcttgctaatagatttgtgtttcttattttatctttttttgagacaaggtctcactctgtcacccaggctggagtgcagtggcacgaacacagctcactgtagcctcaacctcccaggctcaggtgatcctcccaccttagcctcccagggaggtgggactacaggcatgcaccaccacgcccagctgattttttgtttttagtaaagactgggtttcaccatgttgcccaggctggtcttgaactgctgggctcaagtgatccatctgcctcggcctcccaaagtgctgggattacaagtgtgagccaccacacccagccagatatgtgtttttatatttacaaattaaagtagttcagttgtctacattttctaacataggagctggggttaatatgccgtcttactaaaattaaaaaaggcagcagttgttgtagttgctgacataaataggtgggattttcccgagttgctctcaaaaattgttgccttctttcttttatgaactggctgggtttttcttatgttttgtttgtttgtttgtttgttttttgagatggagtctcactctgttgcccaggctggagtgcagtggcgcaatcttggctcactgcaagctctgcctcccgggttcatgccattctcctgcctcagcctcctgagtagctgggactacaggcgcccgccaccacgcccagctaaattttttgtatttttagtagagacaggtttcactgtgttagccaggatagtctcgatctccgacttagtgatctgcccgcctcagcctcccaaagtgctgggattacaggcgtgagccactgcgcccggccttgtttgtttgtttttgagatggagttgtgctcttgttgcccaggctggagtgcaatggtgcaatgtcgtctcactgcaacctccacctcctgggttcaagcaattcttctgcctcagcctcctgagtagctgggattacaggcccctgccaccacgcccagctaattttttgtattttcagtagagatggtgtttcgctatgttggccaggctggtctcgaactcctgacctcagaccatccacctgtctcggcctcccaaagtgctgggattacaggcgtgagccaccatgcgtggctggctgttttaatagtattggaagaacaggaattgagaaagaattaaatattgttgctgtttttgacttgcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccaggtataatgtttctgtaatgtttgaaataatataatctcctggaacacagagacatggccaaggaactcagagtccattagggaagagaaagcaggtgacctctagataatactagagattggaggtgactgggtggagccacatgaatgattattagacacgtgggaacttcaagcagcaggtttgactgaagccacggtgggggcggtggaggaggagatagagaggatctcatctgttctcttggctttgtctactgtttatattatatactgcacagatacctttctggagtgtgtgacactcatcttttccgtttgattgcccactccatccagtcaccaacattagaaacctgggagtcatccttttccctctccccaggcatagccaatcagtcgagtcctgcccattttatttacaaactgactctttttttttttttttttttttggagacagagtcttactattttgcacaggctggagtgcagtggcacgatctcagctcactgcaacctctgcctcccagttcaagcgattctcctgcctcagcctcctaagtagctaggattacaggcacccaccacaacgcccaactaatttttgtgcttttagtagagatggggtttcaccatgttggccaggctggtctcgaactcctgacctcaagtgatccacctgcctcagccttccaaagtgctgggattacaggcatgagccactgcgcccggcctacaaactgactcttgtacccaccccctcttctcccctactgcaattcctaccctagttcaggtctacctggaacacttcaacaggcttttccctctcaaagggaaatcctccacccagaggtcagagtgatctttctgaaacattcctctcagtttgcttaaaatgttcactttgcttaaagctctatagactccccgtccgctaaagcaaggctttaagttttcctaagtggaactcttgggttcaaaaataatcacctttgtttggaaactcagtaaattgcttggaggttgggaaagacatagagctctggagaagggtctgaaaaccatagatctacacaaccaagatcagtctcctcccccaggcaggcagggtcttccgtggtctgttccctctggcctcacccctccccgctccacctccccagcaacatcaggctgggtgccatcctgcacagccactgcttttcacttccaggcctttgctagtattgttttctatgcctacaggccgccaccaccccacccacttttcctgtgtttgccttcccctgccgacacccaagcttgaagacctgatccaggctgggttaggcagcccttctttgtgttctgtgatgcccctcgcatgtccctgtcactgcaccaatcacattgtattttcacctgcgtatgccccactgaacaggaaatgccagctagactgagagtcccctgacgggatgaaggaaggctgtaggaaagataagcattgatttccttacctgttggagcttttcactacgtatttttgcaagaaggcagggaaattttttattggggagtgtcttttctgagacattatctttgctgctgcaccttatatatctgtgtattccatgcccccaacacacagtgcctggcacatagcaggtgatcagtaagcacatgttgaatgagggtgagcagcagatgaggtggctcctggaggctgctttaggcaaagatcagaaatagctgccttatctgaaaagaaggaagagctagagagtagctgcagtggtagaatgattccattagaggcaaaaagcatggtttagcaatatgtagattattaaaattatttgttctaggacaaactaaacttggatagtgtttggtcctagaaaaagtagacaagtaaaatctgagtcatgttttggagagggaaacgggtcactatttgagatttccatctttagatcattcctttggctgactataaatctcccatttggtcttagagattactaaaacacttcagagatcatgagttataatattcaaggactgaaataagcatttctcttttcagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggtgagttcgtttttgaaacccagtttcctcatggtttcttttggtcagagtgcttgacaaggaggcacttgggagttgcttcttgggaggcctgggcttcccggttgggggtctggggacgctgctcttactatgtgggatctctttaggctccaccccacctcccagctgtgccgtgcggagctgcctctctgccagtgccctccaggctctgacccagtctccgctgctgttccaggggaaaacaccttcctctcagagcaaagaccccagaggtaatgtttgttgaaggtctaggaccctttcctgtgacagactgtctgaattcaccagggttgccaggcagctcgattctagaggagccccagggagtgccaagtgtgggataggtgacttcgcgcctacagcgtcatgtgtgcccttcccagagaaactccacattagaacttgtgtgcatgtgaacagaagcccctcaaaatcctgctaaaattcctcggtcctcctgaaaatgttgacagtcgtgggcttgccgcaacatgctgctcatctgcagtctaagaatctgaacaggaaggcgttctgagcagcacgagtgataggcctgtttagagctagttccccacagcgggtttatccgcatgttctgtatattcggtgggacacagtactgactgtagttataatcagcctgcaggctctaggattccccttccccttccaaatcctattcccaaaagacaaggatttggcctgttaactgccctggttagcaatgttgccttctgctgctagaatcaaagggggagtgcaggaggagggggcctttggtggttcagttccctcaagaccatgatataaatcatgcaaaacagcataaccccagagatctgagacctagaaagaatacaggatattaacctgagggaattcaaaccacaggtactttgcattttcagagctgcttcttgctgccagcacggtgcatagctgttaagggcagggtccttctaaaaagtgtaggtaccatttctgtaggataagcgaacctccaagcagtgctgattttcttaaagtctgtttttgtgtgtaaccctctgcaatttaagccaatttttttcagttcggtcctctgtgactcctgcatgctaagcctttctaccttcttctagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcctaaagtctcccagtttcccctatatacataagaccatttaaaccacaacctggttaccaccgaccctttcgtgatgattcttggccaaacccctgaactacaagcacatccatttacgcctgaaaccagaattgtcctgagattcgagcaagacacaaggcggcaattgggtaccacagcttcatggaagtaagtggtgggaatttgcatattattttgttaaatgagggtccagttcttttgggccatggcccaaatttgttgatcccagtgagggtacagatgagggcctggatttagggtgtgcggtaaggactgcccttcacagaagcaaaacaggcagctgcccctttcagcaggctcggagtctccctccaaggcagggtctgccccgagggcttacagggggtttttccggacatcaatcatccccgggctggctcgtcgcagttcccgccggggcttggacaaaggcccaaagttccagggcaggcctgcctcacccacaggaagcacccgccccaccaggggctcagccgcctcccgctgcctcagttcctcgggggacccctgctcctcaccacacaggctcgagcgtttccaggtcaagggtaacggagcgtggaccaagtcccgcgtctcctcccgggtgcggggggccccctcagtgaggggggacagccagagaagctcgggtgccaggtggagctcatcttcatttccaggagcctgtctgccctccgagcacaggctcctcttctccccacctgtcatggagagtaacgtgtcctcatcagaaacaggtggcaacaccttcccgaagccctagctccccagtgccccagcacaataagcaacctgtgaattgagccaataaaggctcgagggagagtggtctctaagctttccccaaagaaagggaacaggtctgacttcagagcgcgacgaggagttacccctgctgtggcctacagcgttcacaccgccgagcttctgtttcagttcctggtttatccacatgtaacggcccagttccttctccagagcttgaatccgggcctcatactgcctcctgctgtctgctaacccttcaccgaggtggtctagagtggaaaggtcgaggagagggtggtgagggctgcaggcggggcaggcggccagggctgtgggggtgggggctgtgggctgggtgggggccggggttgtgagcggtgggccgggccaccagggctgtaggtgcaggggctgtgagtggcaggggcggtggggggagggaggggggtgcagggcggggaagatgggggtgggggggatggagggggccggggttgtgagccatgggccgggctgctcacctcgactctgctgcaggagcagctgcatgttctgctcgtgctccttctgctgcagggtcagctggcggtccatctccaggcgctgccgctccagggccacctccagccagtacaccagcctctgctgctcctccagctgcatctccagttccgagaaggcaatctgctgctggtgctgctcctctcggagcgtcaccacctgtcccaagacccagccaggctcagccctcatcatgacccctcttcatccagctaatcctcaatcacagacacagtattggcacacttgccaccacggcactaagaaatcaccagggtcttccctgctgagccaagactcagcctcagacacctcagcagtgctctagttatcttccaacgatcagagctggctctcaccttatctgctatctctgccacaaaccctttcctagccacacactatggagctgggcagagcgtcaagttgtgggatttcatctagaccaacctcagcactatggacatctgggaccagataattcttggttgtgggggcctgtcctgtgtgttataggatgtttagtaacatccctggcctccacccccaccactgtgacaaccaaaagtatctccagccatggccaaatgtcacaaaagggcaaaaacttcccctactgagagctactattgtggccatggaccaccctgaggttagccaatcagagcagaagtggggggcgggtaggaaactgggtcttagtttcacaagtaaaataggctttaaggtcaggcggccctgcagatgagttggtcctgattctgtcccccagtctgggaggaaacgggatatccgctggagcagctgccatgagacacctccccacacgtgccgctgaggaggagctggggggccatgggctgctggcccaccttgtcaaaatacttgcagaggagggctctggtctctgaggatgagaggtagctgagcttggccatgaggttcatctcgcactgggacagcaacgaggctgaggcccgaagcacccgctggcggcatgtgatggcctcattcttatactcaatggcagcatccagggcctcgatggcctcatccaactggaacagcgtccgctcctcctgcagagacgggcacgcgtggaggaacagcacccactgcctgaatgctgaagtcctgggcagacatgcaacagccaacacgtagccacaactgggccttaagggtcccctcgtcccaagggccaagtcagcccatcgagagaggtgccccctgctcactgtcacagccccaaccccagggtgagctgggggcactgctcagaggtggcctgctcaactgcaagcctctgtgaatgatctacattcaggaagttcagagcaccctaaccaaacaaaaggcatggttgggacagccacggaggcaccacggtgtctgctgggtaagcttctacagatggggatacgttctaagaaatgcatcattaggcgttttcgacgtcgtgcaaacatcagaatatactcacacaaacctagatggtatagcccaccacacacctaggctacaagcctggacagcatgtgactgtactgaatactgtaggcagttgttaaccatggtgagtatttgtgtatctaaacatagaaaacgcacagtaaaaatgcggtgttataattttctgggagcaccattgttgtatgagctgtcattcactgaaatgtcacacagcacatgactatagtcacataggctttctctctgctcagggaacacagatgtgtgggcatgaggtgcactgagtatgcgcctgacactccacacacgaagccgagacgtgtgggcaggtactcgaatgcagcacagaacaggagtccaggctccagccagaagagagctgagaggtcagcacagcctggcccctgtgtcccagccaatgaggccaaagcaggggcagaagggccaggccagccctccccagcccccacctccacctaacagtgaaaacttgggtctgccgacagcaaggcccagcacccgcagagggctggagcaagggctgaggagagcagacagacaggcatacaatggcaccaaggggctgagccatggggccgcagggtacctcgggggacagcagactcccctgcctcagcttgccgtcgatctccaggcgctgcttgagcagcgagtccttctcctggcgcaggctgtcgatctccccgcggatctgctgctggctctgggcgctgccctgccgcagctgcccgctcttctcggacagctccttctccaggtgctccagccggctggacactcgcacgatgtcctcgttgagggcctgggggcagaatcaccagggattagagaaggaacaggcactgtcctcacaggggggacagaaagggccggatgttaaggaggacttgcgtccttccctcaagaaaccaacactccaaatgttctgctcagcagggagaccagacttagttcacagagactccaggaggcggggctaaagggaccagagcatttgcagaggggcactcagagatggcgagaggaggataaggaccagagggacgtggccctcctggcaagaacaggcaatgggtaggggtgggaggaatgatctgtcactgagatgaccggactggacagtgataggaattggccaagccctaaaggcctttctgggagccagatgcgggaggaagtgagggctctcctggcggagggaagttacggatcattccagtaggaccctggatcctcctggacatcagagtgatgcgtgctggcaggagcaaggctcctggcctctgcgggcctaggacactgggcgtgtggcccaagcccctgtactggaacaggccctgcatcaatgacggccatccccctccagccatcatggtaacattatgatcccatctgacagaagacaacgctgtggctcagaagctgaccttcctattctagatggagtaatgatgccaggcggagaagtctctttctatttggctataccaccttcctatacctgcgcctcctcattcttcctgcacaggccctgaggagggggttaatgagtgaaatgaattggaggatggacacttaagagaggttcttctatgcatacatctgtaactgtgtcataaatatcttgaagccctacagctcatggggatgcacaggatagaacccagtaggacagagcttcctctgtctggaacttacctggcagagataccacctagaagaaactctcctgtctagacctcgcctggcagggacatcacctggcaggtttatcacttggaaggacctcactttgctagacctcacctggcagaaacttacttggcaggagctcacctggcaagatctgtcctggctggacctcacttcactggacctcacctggcaggatctctcctggcagggcctcacctggctggatctcaggcgcttgctctccagccccgtcttctcctgcatcagggcctccttcttggccaggatggcctcccgcttgtggagctcctcccccagctcctccagcgcccgccgctgctgtagcaccttctccatctcctggtccagccacttcttctgctcctcaatcttctaaggaaaagtagggagggagggagggaactcagggcccacctctggctgtgtcagccgccactcgaggttcactggggagaaaggtgcacccaccagccagcccccaggggagccctgggtgcggacacagcctggccccacctgctgctgttccaggctgaccacagagccgttgctgccactgcgcctcttcctctggaatgccgcgatctcttccgtcttaatcttcaggatcttctgctgttgctcatgcttcagctccagctcctgggtgaggagctcagtgggcagggctgtttatggtgccagcatcttaccagagcctgccaccgatcccaaagcccccaggagtgcctgcccactcccaagagggccctgcgaagtgtcccccagacccatcccacacaaatctccctggagaccggcaaatagacgcaaacacttagaaataagccccacaagatgccagtcacctcatatacctcatctcactgaagtctcaccctggccttgagtttcctataacattccacattttcagatgaaaaaacagactcaggctaagtgacctgctttctaaggtcacgtggctgtgggttgcaaaccctgcctgggctcccctggctgggccgccagctcagcctattggcctggacagaaggtccccaccctgccgtgagcctgaccttgacgcggtgctgccgcttgctcatttctgcctccaggcgccgcttctgctccgtctcctcgcgaagccgcctctgcagctgtccctgctgctgccgcatgagctgcacgttccgctcgagctcctgcagtcgcttctcactctgggccgacagtgacaccagccgctccgtagcctgcttcttctccttcagcacctgggacccacacagtcttcactgggccatgcacggggctaccgcgagcctgccatagtgctgggcactcaacaagggcaggcagatagagggcaaatgggtaggtgggtgatagaccaataataataacagaggccgggtgcggtggctcacgtctgtaatcccagcactttgagaggctgaggcgggcggattacttgaggtcaggagtttgagaccaacctggccaacatagtgaaatcctgtctctactaaaaatacaaaaattagctgggtttggtggtgggtgcctctaatcccagctactcaggaggctgaggcaggagaatcacttgaacccgggaggcagaggttgcagtgagccgggatcgtgccactgcactccagcttgggcaacacagcaagactctgactcaaaaaataataacaggacacaggagccaagatggccgaataggaacagctccagtctacagctcccagcgtgagtgacgcagaagacgggtgatttctgcatttccatctgaggtactgggttcatctcactagggagtgccagacagtgggcgcaggtcagtgggtgcgcgcaccgtgcgcgagccgaagcagggcgaggcattgcctcactcgggaagtgcaaggggtcagggagttccctttcctagtcaaacgaaggggtgacagatggcacctggaaaatcgggtcactcccaccagaatactgcgcttttccgatgggcttaaaaaaggcacaccaggagattatatcccgcacatggctcagagggtcctacgcccacagagtctggctgattgctagcacagcagtcggagatcaaactgcaaggtggcagcgaggctgggggaggggtgcccaccattgcccaggcttgcttaggtaaacaaagcagctgggaagctcgatctgggtggagcccaccacagctcaaggaggcctgcctgcctctgtaggctccacctctgggggcagggcacagacaaacaaaaagacagcagtaacctctgcagacttaaatgtccctgtctgacagctttgaagagagcaggggttctcccagcacgcagctggagacctgagaacaggcagactgcctcctcaagtgggttcctgacccctgacctccgagcagcctaactgggaggcaccccccagcaggggcagactgacacctcacacggccgggtactccaacagacctgcagctgagggtcctgtatgttagaaggaaaactaacaaacagaaaggacatccacaccaaaaacccatctgtacatcaccatcatcaaagaccaaaagtagataaaaccacaaagatggggaaaaaacagagcagaaaaaatggaaactctaaaaagcggagcgcctctcctcctttaaaggaacgcagttcctcaccagcaacggaacaaagctggatggagaatgactttgacgagctgagagaagaaggcttcagatgatcaaattattccgagctatgggaggaaattcaaaccaaaggcaaagaagttaaaaactttgaaaaaagtttagaagaatgtataactagaataaccaatacagaggagtgcttaaaggagctgatggagctgaaaaccaaggctcgagaactacgtgaagaatgcagaagcctcaggagctgatgcgatcaactggaagaaagggtatcagtgatggaatatgaagtgaatgaaatgaagcgagaagggaagtttagagaaaaaagaataaaaagaaatgagcaaagcctccaagaaatatgggactatgtgaaaagaccaaatctacatttgactggtgtacctgaaagtgacggggagaatggaaccaagttggaaaacactctgcaggatattatccaggagaacttccccaatctagcaaggcaggccaacattcagattcaggaaataacagagaacgccacaaagatactcctcaagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggtcaatattcaacattcttaaagaaaagaattttcaacccagaatttcatatccagccaaactaagcttcataagtgaaggagaaataaaatactttacagacaagcaaatgttgagagattttgtcacacccaggcctgccctaaaagagctcctgaaggaagcgctaaacatggaaaggaacaaccggtaccagccgctgcaaaatcatgccaaaatgtaaagaccatcgagactaggaagaaactgcatgaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggagcaattcaacaagaagagctaactatcctaaatatacatgcacccaatacaggagcacccagattcataaagcaagtcctgagtgacctacaaagagacttagactcccacacattaataatgggagactttaacaccccaatgtcaacattagacagatcaacaagacagaaagtcaacaaggatacccaggaattgaactcagctctgcaccaagcggacctaatagacacctacagaactctccaccccaaatcaacagaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaactaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagaaaaaaagagagaagaatcaaatagatgcaataaaaaatgataaaggggatatcaccaccgatcccacagaaatacagactaccatcagagaatactacaaacacctctacacaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaaaagtccaggaccaaatggattcacagccgaattctaccagaggtacaaggaggaactggtactattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaatcacgattatctcaatagatgcagaaaaggcctttgacaaaattcaacaactctcaataaattagatattgatgggacgtatctcaaaatcataagagctatctatgacaaacccacagccagtatcataatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacaaacagagagccaaatcatgagtggactcccattcacaattgcttcaaagagaataaaatacctaggaatccaacttacaagggatgtgaaggacctcttcaagaagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatagaaccaaaaaagagcctgcatcaccaagtcaatcctaagccaaaagaacaaagctggaagcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaactctagaagaaaacctaggcattaccatttaggacataggcatgggcaaggacttcatgtctaaaacaccaaacgcaatggcaaccaaagccaaaatcgacaaatgggatctaattaaactaaagagcttctgcacagcaaaagaaactaccatcagagtgaacaggcaacctacaaaatgggagaaaatttctgcaacctactcatctgacagagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgcagctataaagacacatgcacatgtatgtttattgtggcattattcacaatagcaaagacttggaaccaacccaaatgtccaacaatgatagactggattaagaaaatgtggcacttatacaccatggaatactgtgcagccataaaaaatgatgagttcatgtcctttgtagggacatggatgaaactggaaatcatcattctcagtaaactatcacaagaacaaaaaaccaaacactgcatattctcactcacaggtgggggtggaacaatgagaacacatggacacaggaaggggaacatcacactctggggactgttgtggggtggggggagtggggagggatagcactgggagatatacctaatgctagatgacgagttagtgggtgcagcgcaccagcatggcacatgtatacatatgtaactaacctgcacattgtgcacatgtaccctaaaacttaaagtataataataataaattaaaaataataataataataacagtatactaataatggtaaatactacgacatttacgcaccaggcaccacactaagagctctgtgtatattaaatggtcctaatgagcctacaaaaagtgtaattatgattatccctattttacagatcagaaaactgaggcagagaggttaggaaacttgaccaacgacacatagctagtaagtggtagaactgggattcaaacctgagcagtcaggctccagagcccatgctctcaaccactccacgatattgtctcttggacatttgaactgagaaaataaggatgggtgggcatctgcaaggatggacggatggaagggtgggagggacagatggctaggtgggcgagatcatatgaaggtaaaaaaataggataggccaggcacagtggctcatgcctgcaatcccagaacttttgggaggccaagataagtggatcacctgaggtcaggagttcaagagcagcctggccaacatggtgaaacactgtctctacttaaaaaaaaaaaaaaaaagaaaaaaattagccaggtgtggtggcacctgcctgtagtggcaccccgctactcaggaggctgaggcataaggatcacttgaacccaggaggcggaggttgcagtaagctgagattgcaccacagcactccagcctgagcaacagagtgagactccgtctcaaaaaataaaaaatgaaaacaacaggatggagaccgtgatgggctgaattgtgtttccccaaaattcctatatgaaagccctaaccaccagcacctcagaatatgactgcgtttgtaaagaaggtctttagagaggtgattagtttaaatgaggacattagggtgggccctaatccagtatgaccagggtcctcatgacaagaggaagagataccagggctacaagcaggggaaaggccgtgtcaagacacagccaggaagtggccgtctgcacaccaagaagtgaggcctcaggggaaaccagacctgtagacaccttgagctcggactgacagcctccagagctgggagaaactaaacttctgctgtttaaatccccctagtctacggaagtttgctatggcagctgtagcaaactaagacagagaatgcatgaattaacaaaaggggatggaaggggtggatgcacctgtggataaatggacaggtggtcaatccactgataaaaggctaaaccagctaggcgtggtggctcacacctataatcccagcactttggtaggcccaggtgggcggatcacttgaggtcaggagttcaagaccagcctggctaacatggagaaaccccgtctttactaaaaatacaaaatcagctgggcgtggtggcacgtgtctgtaatcccagctactcaggaggctgagacaggagaatcacttgaacccaggaggcggaggttgcagtgagccaggatggtggcactgtactccagcctgggcaacagagtgagactctgtctcaaagaaagactaaaccgatggcatgggtttgacggacacatggaccaacggatagacagacaagggagaatgggatggaggggtaagcgaatggagagctgaaagggggaccgggagacagaggactgcacgctgcagggtaggtttctttagacgcccacccttcaccctctcgttgctctcccaggtggtcttcaggcaggacctgccccctgcctctactgtgtgtaaagctgggcggacccccagcttctataccagcctcaccctgcagggccagggctggagcacaaggttccacagtgaacttgggcctcagagcccacatgtcctggtcccaaggatggcagcctaggaggcaggagtcaccccagcaccccaccctgaggccccgagactaacctgcacctggctctgggccgcagcgaccctcctgcggaactcctggagccgagaccgctcgccagcatcctggagctccttgccctcgagctcccgcagctgcctctggccttcactcagctcggcccgcacctgctctgcctcctgctccagctcccggatacgctggctgtgctggcggttcagggcctgagctgcctttcctggaagaaagcgggaatgtcagcacaggcagccctgctccaccgagagggccagctgtttgtccccctgggaggtttcccagcccttggacacctgtgtgggtttcaccaagcctttgcaccaccagtaccacagtttacttaatatttttcttcaaatcaactctatttatttatttattgagacggagtttgctctttttgcccaggctggagtgcagtggcgcaatcttggctcagtgcaacctccgccttccagattcaagtgattctgctgcctcagcctcccaagtagctgggattacaggcacgtgccactacacctggctaattttgtatttttagtagagattgggttttgccatgttggccaggctggtctcgaactcctgacctctggtgatccacccaccttggcctcccaaagtcctgggattacaggcgtgagccaccgcgcccagcctcaactcaccttttaaataagcctcatccactgcagcgacccaaggaaattacaaattagttttatttttaccaaatgcattctaaaataaatatgtaacctgaacctgtatataattaagcctttagaactaactttcatttccaggaaatctggaggacaaaagaatgagctaaatgacaccacaaaaaagcaaacagacaaaccccaaacgtggggtttgggacattcagcaggatgactgagagaagggagatgtcagagacctcagaaacaaatacagtcggccctctgcatctgtgggttccacacccatgggttcaaccaaccatggatggaaattatatttttctaaataaatggctgcatgtgtactgaccatttacagatttttcttatcatcattacctaaacaatacagtaaaacaactatttacccagcttttacattgtattaggtattgtaagaaatctagagatgatttaaagtgatttaaaggaagatgtgggtcagttactgtaaatactataccacattatttactaaaccttttttgagcatccacagattttggcattcacggggtcctggaaccaatcccacatagatatcaagtgacgactgtatgatgtgtgtgtggaacaaatgtggagcctgattcaagcgatccagctataaacagacactgctgataatggagagaatgtgcttatgctctggtcattaagaggactgtgccgggtgcggtggctcacgcctctaatcccagtactttgggaggctgaggtgagcggatcacgaggtcaagagatcgagaccatcctggccaacatggtgaaaccccgtctctactaaaaatacaaaaattagctggttgtgttggcacacgcctgtagtcccagctactcgagaggctgaagcaggagaatcacttgaactcgggaggcagaggttgcagtgagccaacatcgtgccactgcactccagcttggcaacagagtgagactccgtctcagaaaaaaaaaaaaaaaaaaagaggacattagtttcattaggtgtgctgatggtattacagttaagtaaaaaaaaaaaaaagttcctatttttaaagcagcacactgggaggtgtagggaagaaaggacatgaagtctggcatgtccttcaaaatattcagcaaagaaaaaagggagaggaggtaaaacaactgtggaaaactcttggtaactactaagtctggaggatgggtatatgggacccatggtactcgtctcatgtctggttgaaaatatttatgatgaatttggtaacaaattcattaactattaaaatataaacgctccactggccagcacctaaaactaccccgtgtcccctccttcactcatatcaccagtcataggcataacacaatttggagacgctcagtcctccatgacactcactgtgtgctccccaggactgagagatacttcgcccagcacaatggctgaaacattgcaggcactcgataagtaagaagaagtgccgggcatggtggctcacgcctgtaatcccagcacttgtggacactgaggcgggtggatcacctgaggtcaggagttcaacaccagcctggccaacatggtgaaaccccatctcaactaaaaatacaaaaaaaaaaaaaaattaggtgggtgtggtggcgggcgcctgtaatcccagctactcgggaggctgaggcaggagaatcgcttgaacccgggaggcagaggttgcagtgagccaagatcacgccactgcactccagcctgggtgacgagtgaaactctttctcaaaaaaagaaaaagaagaaaaaagaagtactgcttactaagagctattctaagcacttcacctgaattaactcacttcaccctcacaacacccctattcagtaggtataacgactatccccattttagagatgaaaaaactgaggcacggagggtttatgctacttgctcagggtcacacagctggaagaggctgggctgagtatcaaacctaggccatccggcccctgctcctaaccacctcattgttgaaatccctctagaacagtgcagaagtaacgatgagaagtccccctcgggtgagaggcccacctgatgcccacgcctcacctgtgcggaccagctcgccaataagctcctccttcatgcggatgttgatagccagctcccggatcttctgctgggcctgggccagccgccactctgaggctgtggcaggggggacctggcgggcctgaactcgggccttgctcccaccaactgctgcaacaggcagcctgtcaaggttgctgccccaactgacagtgggggagacagaggagtggagagcaggggctgccagggatggtgggtgggactgtcccaaggtggctggcccagaaccgtggaggggcagtggggaggaggccctctctgcatcccacccagcttacctctggaccctggaatggctgcatccaactcctcaaggcaaagctctgggcccttcctctctggcagactccctgggcgtgcccccgccctctgactgcagttgctgatcctatttctggaggacagaagcaggaggccatgctcctccccagcccctgccccagcctagccacccccaggcctggagggaagaagagaggccaccgggtcttccacctcccagggtcaatataaacccaggatgtgagtctggcagaatcaggagtccaggggcagagttttaggaggtacagggcagctgggggcatagagggccaccctggaggctgaagtcaggaggcctgggcccaccttgtatcacactcgctccagtgagacctttcggctcagtgccccacagctctcccccaggggctggccagggcaacatgagggcatcctaggacccagaggcttccccactgctgtcaggagaggagacggtgcgatccccagcctgcctagccctgggccctgagcaggtccttgtcaggtgggggcagtgggtcccactcacctgcgcaggtgtaaggtccgcctgggcggctcctcctcctcctcttcctcctctgaagcagctgaagagccacttcccagcctgttcacctcagtcagcaactcagctccagcctccctgccatttgtcacctgctaggggagtgagccatttcccatcccaagtcatcatccctgcgatataccccaccttgcctgccctcctcatatctctccctcctcaagccctgccttaccttcgtgatccagctcaaatgacccctctggcagccttctgaatctcaagctggggtgagagcttcctccctcccctcccctcccgcctgctttggctcccatgatacctggtactcctcaggtgacaatctgccctttctaccttgtgtacaggtcatgtgcacccaagtcctatctcaccaccaattccctgccagagtgatgggtgaacatgagacttctgccaacccccagctttgagagctgagatgacccaggcctaaaagccccagaggacccagaactttcaggcaggagtaacctttgtccaaacaaggttccccacgtggaaaagtgaacttgcaaagagagccatccaaagacagagggggtggtctgaaaggtgatgagctctccgtatgcagaagtgtgcaaggtttccacccgatgccggaagcctgaaccccctctgtaacctcctcattccaagcgatcttcagctaccccagggatgcccgatggcactgcacccttctgagaggcccagagtcattcaaatcttggctcttcctctggggacagctgaaagcagcctctcgcatctcacagccagtcccatgaaagcatgagtgggggacacgtgccccagtgcccccttcccctgccccgaacttgaccagtccagcagggcccacagacacccagcctcaccctcttctcacctctcccctctgctcagagccaacttcatctccagggaggcaggcaggcggcaccatgcccagcacatgggcgtgggcaccccccaggggggctgtatgaggtcgaggcacaaaggacccgggaggcaggccattcaggagccgcgggcccccccagcctggccgcaccagctctaaccgcagccgcagttccaccatctcctcctgctgctcacgcagccggtcgctctgcaagacatggtccaggtgccaagggggcatgaatgccccgacaggcaggagtgtaggaaactgaggaacaggtctgaggccactccaccgtctctgggctgaaaatgaggagtgtcaaatactcctctcctccccaacaactctgtaggagttcagactcaaactcaccccacagatcccatcacactcctatcctgccagaccgccacctccaaccgccgccaccagagggcgccaggagcaatgctgacctggtgacgcccggctccaaggtcccccgctgctgcccctcctgtcccctctcccgtccaagctcacaccacccagcaaagctgccctgcctggcggtcctgcacacccacctgcgctgttgtgatgctcacctccacactttcgctcatgtgcacctcctgactctacacccctaccccgcagtaccctaccctaactccctcccatcctgagaaactcagctctgccttcccttcatcctcctctgggaagccttccccgcactgtgaagcgggcgccgcacctgcagtttgtactgctccatggcgtcctccagcgcagccagaaagtctcggttctcctcctccagccgcgccacctggttctgcagggtcagcagctgctgcgccccctcatcctcctatagggcagggagaggggcttcaggggcgggggttgacagggcgagctggacacccggcctcttcttgtttagccctgctttctatctactcttccaagccctacctgcagtgggaactccagacccactggtgggaggaaaccccagaccccagctggcctgggtgccctctgcaagccatttgggtcatctcttgtaattatccatcgtatttgtattaataatatcaccactattattaggaacaatttactgcgtcttcaccggcatgctaggcacatgtgacaccctcagcccttacaacatccccactaagagatggggtaagtcctacggttatccctattttacagctggagacctgagactcggtgaagttaaggaagtgaccacggtaatcagcagaagtgaccgaatcccgaacgtgccctgctaatgggcaggaggcaggggcgcagctgctgtctgaagaccctcttccttcctctccaccactccccactgcccacaaccacaaccacaacctgtccctcggccacctttcgcccgccggccccctgcgccgcctggtcctcgacggaggcgctctcgatgccgctatcgggcccggaggcggagctcagggcgctgcgctcgccctcgacggcgcacagccagtcgcgcaccttgcgggcggcggcgccgggcagcccgggctcggcctgcagctcgcgcaagaggctgtaggcggcgtcggtgcaggcccggtagcgcgcgcactcggcgcccaggcgcatggcggccgccgcggaggcggtggctgggcctggggcgcgccggccgcggtggatgatgcgggtctcggagcggtgccgtggcggaccccgcgcgccgctcgccgtctcttcgggtggccgctcggcctcgggccgccagttgaccgtggcgcggttgcggatgttctgggcgcggctggcgtagttgagggtgttgagggtctcgtcgaagtcggaggaggaagggctgacgcaggcgatcatcaccgtcttggcgttcccgcccagcgagtctttgaggatcctgagggcgcgagggggaggctctcaggggccccgacgctccaggcccagggccagcgggccagacctgggaccggctcctggcgcggttcccgtgggctggagacctcaggggacctgggcttccacccccactggtgtgctggacactccccgcctccccggcccccaggccacataggagccagggggcagctcaccgggtgatcttggagtcgcggtagggtatgtggctgccccggcgctgagggtcccccagggcgctgatgacgttgcccagcgccaggaggctgctgttgatctggatgctctccttgagccgctcgccggtgctgcccgtcttgagcaccctctctgagcccgccaggtccacgaagtggaacttggagacgagcagctggcccggggcggggcggggtaggcggctgggggcgcgcccccgctgctccagggtcacggtgaagaccgtgtgtgagcggctagacaggtggttgaggtgcgtggctcccgtgtgccgcgccgcgttgcccatctccaggaggctcagcacctcatccaggccctccacgtcgacctccttcaccccgcacagcactgcgggcacagaaggccgtgagccccagggcaggggccgccagactgaccagccaggagggcaggcagagcagaactagccccaaacctgcccttcctgacccactgctccctccccatgcccacggggtactgcccttcctagttccggcttgaggggctccggcttcccactggcccacctcagtgcctctcactctgggtatagaagcatgtactgaactcagtggaggcaagaagctaaagcaaaacctcccagggcttgggttttccatgaggagttgccattcccagacaggtaagcactccactccaaacaggtgaagcccccctaagcccctctccgtcagtggaggaccccagagttcctcaccaacattcccgcgctcatcttcccggagctggatgtcacggctggcagtgcccacctcgagcaggtctcggaactcctccttgtacacttccaggtaggacacatgtaccagacagtcaagcaggtcgttctcatcgatgagcttgaaggcctcggccatggccctcgggacaatgccctgctcatcctcaaggagggaggctggggagacaccgcagggcctcctgccacttcagctggacacggcccatggcccccaggcccggaagctcataggcccctgccagagctggaggatggtgctctaggatggagaaggcagtggccgaggccaggatgggacaggtggcctgagcttggccatgctccagcgtggtcaggcagaattataaaatttaagagttggaagcaacctctcctgattcaatcaacccctttcatgctgtaagcatccccttcactgcatcctcaacagattatcaaataaccttgccttgattactcctaatccatgctcagttatctaaagggcctcctaaatttatcccaaggaaataatcagaggaacttcagagcagcactcttcctcatgacttcaaaaaatgcaaacatcctaagtgtccatccgaagatccaataggagatctggccaaatcaactttttttttttgagactgagttttgctctcgttgcccaagctggagggcagtggcgtgatctcggctcattgcaacctccaccttccggtttcaagcgcttctcctgcctcagcctcctgagtagctgggattataggcatctgccaccatgcccagctaatttttgtattgttagtagagatggtgtttcaccatgttggccaggccggtctcaaactcctgacctcgtgatccgccggcctcagcctcccaaagtgctgggattacaggcatgagccaccgcacctaaccaactattttatattcacaatggaatgccaggtagccattaaaaagttagatttttttttttttggtagagacagggtcttgctgtgttgcccaggctggtctcccaactcctatgcccaagcagtcctcccagctcagcctcccaaagtgatgggattacatgtgtgagcccctgcgcctggcctaaaaagttagattgaagaatatttcatgatacagagaaatgttcatgatacatttgttgttgttgttgtgtttttgaaatggcatctcactgttgcccaggctggaatgcagtgaagcaatcttggctcactgcaacttctgcctcctgggttcaagcaatcctcctgcctcagcctcctgagtagctgggattatagacccccaccaccatgcttggccagttttttgtttgtttgtttttgagacggagtcttgctctgtcaccaggctggagtgcggtggccagatctcggctcactgcaacctctgcctcccaggttcaagcgattcccctgcctcagcctcccaagtagctgggactacaggcatgcaccaccacgcccagctaattttttgtattttagtagagacagggtttcaccatgttggccaggatggtcttgatctcctgacctcatgatctgcccacctcggcctcccaaagtgctgggattacaggtgtgagccaccacgcccggctcagtttttgtatttttagtagagatggggttttgccatgttggctaggctggtctcgaactcctgacctcaggtgatctgcctgcctccgcctcccaaagtgctgggattacaggcgtgagccactgtgcctggccaatgatacattattaagaaaatcaaacaggacacaaaagaatgtatataatataatcccatttttgaaaagtaaaataatcttcccagggaaagaaactggaaggctaacagggcaggggatttccgaaaggcaattatcaagtacattttatttcgtgcatgtgttttgctgtattttcctaattttttttacacaaagtatctttctgtaactgctatggtctgaatttgtttatgctccccaaaattcacatgtagaaatccttacctccaatatgatggaagtgagggctttgggaagtggatggggggagccctcataaatgggattagttcccttataaaagagagctgagagagaccccttctgtgtactaccatgtgagtttagagagagacagcgactgtctgtaaggaagaaggcccttcaatctgctggtgccttcatcttaaacttcccagcctccagaactgtgaggaataaatttctcttgaggagccacccagtctatggtattctgttatagtgaagggagcagagcaaggcagtaacccgacagaaaacagcttgtgttacttaaaaggggacacttccttcagttggcccaaaggatctttctcgaaactgctccagagcctggctgaagcaccctgcagccctgctgtgcagtatccaaagcagcctcttccaggacacacggcccccattcccaactgctccagctagaacagattcctgaccttccctagccagcctgacaacctctagagacacgccaccttcccgtgcccttcctctgctgaggtccccagagccaggcagcatggcgccatctctatggaggtgagaaggccactcacctccaacgacccttccttcctgccctgcctagcccacagacatggctggtcccagcctgggccacagatccctgtctaggaaatcgactcttcctcccccagcatccccaccttccacagaacaggcagcaagaggacaaggcagaaatccaggaaggaactaaggctccttaaagtgggcacagggccacgaacagggtcactcacccacactggcctcccccatggtgtatgtcttccctgagcccgtctgaccataggcaaagacagtggcattgaagccctcgaagaaggcctcaaggaggggctgaacgcaggcctggtacacggcctcctgccccgcatcctcggccagcaccacgtggaagccaaagtgtcggtcacggcccagagtgacgcggccaagccctggctccacctgcaggcagctctgatgcccgtgcagcagctccttgggcagcagtggtcgaactcgcagggcaacccgcactggggcctcctcagcccctggcagcctctgagcctccagccccatgccgagggaggactgctctgggccctgtggagagagagagaagccctggccatcagcacttgtactccaggagctggactcaccctgcaggggactcgagccagatcctgcagctcctgaccttggagggattgggggagggtggtcaaagttcacaatatccccatgtccaacctggtgctcaaaaattgcaagggccatgatatatatagtcccccacaggaacatgtcatggcttccggcactggcgaaatgaggccctaactcctgaactccagtgtttcagctgcactcttccctatggcccctatggccccatctcctagaagaacgcacacacacagcaccacaccacaccagggaactcctgtccctaacacccactgggtttaccacagtctttgtgtcaagtcactcacatcccctgccccaccttcttcaaaaaagtcaacagatccttcaagaccaagctctcaccaccaaatcctgccaattccatctcctaaatatctctcaagttcacctgctgcttcccattctgttgctaaagccctggtcctggccactgacatcgtgccaggatgactttgagcagccttccccctggcatcagtctccctgtcccctcccgcagggcaaccagggacatctttctttttcttcttgagacagggtctctctctttcacccagactggagtacagtggcatgatcactgcttactgtagccaaggcttcccaggttcaagtgatcctcccacctcagccttcagagtagccgggaccacagacatgtacctggctaattttattattagtattagtattagtattagtattagtattagtattagtattttgtagagacagtctggctatgttgcccaggctggtcttgaactcctgggctcaagggatccttccaaagtgcagtgactacaggcatcagccactgcgcctcagaggcatctctcaaaatgcaaatgcaattatttcactccctgcctaaccccaactcccccaaaaaaaggctctccactgcccttgggattcaaaatatttttgtttttgtttttgttttgttttgttttttatttgagacggagtcttgctctgttgcccaggctggactgcagtggcccgatctccgctcactgcaagctctgcctcctgggttcacaccattctcctgcctcagcctcccaagtagctgggactacaggcgcccgccaccacgcccggctaattttttgtatttttcatagagacagggtttcaccgtgttagccaggatggtctcgatctcctgacctcgtgatctgcccgcctcggcctcccaaagtgctgggattccaggcgtaagtcaccgtgcccggcctgggattcaaaatattaaggggaaaaaaaaaaaagacaagccttaaatcaggccctgcctccctggactactcacttcccacaccccaggcctttcctcgcctcctctctctgcctgcaacggctaggtgttacccaagcctcctcatccctcccggctgaggctgcagccaccttctaattcagggagccacggaagctcccctcctctgtaaccccaccacgacacgcacacaacccccagtgctgttccacccgcccgtgaccactccaactgcaggttactacccgcttctctccccgacctcccagaccaggagctggaaggcagggaccctctgggtccactttgcactttatcaccagcgcccaacacaaggtcccacgctgcccaacagatagtgatggataatcttcatccagggaactttccctgccctccctcctcctaccgcgttcctcacccccaccgccagcccggcacttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagccggcagaaactttaatctccccacgtttaaaaaagttttctcagttataagactctctttttctcacattttagcattcctaaaattgagttccatcttacactcattgtcaagggaaacttggcaccaggaggggcaggagaggtgatctgggggtgtccacggcagcctcaaagagatggttggtgtcttcacctctgagacctctgatccattgtttgcactggaagcaccatgaatgggtgaattttaaaatctgaaaacatatttgtcacttaaaacgccattagaaaaagtaaactccagtgtagtttctagtgaaattttattatgtatatagaagattacctgtcatagacaggcaacataattaaaggccatagaaattgccaggctcgtcagatagatctatattaggaaaccctcagcctccagtaacagaaaccacaatttgaagtggcttgaaccataaggtcatgtgttatctcggggaacagtgaaacccagagggatgagggctcctgggcaggttgagtcagtggcaacattaccaaggaggtggcctttttaactctttttttttttttgccatcaacttcagacacaaaacgtccagaggaagaagacagcagtgtgtggtgaagcatgccctttggatcaagagcactccaagctgatttccttcccattccatgtaccacacagcttaggcctgtccacccccaaactaatcactgtcaaggggatggaactaccatgattggcttgcaataccagtgtgagacagcgtggatataggaaagtcatccacaatctccacaaccacatcctcgaagcttcatagaggagaggctggccaactgattcgtgtatcacaaaggaccatgattcaggtaccaagcatctatctgtcagatgccaggagctgtgccatttcctccaatagacaattcaattaaggagaaactaaaacctcgagcaattggaaagagcacatgaaaccccagtgttctttgacatgctgtagaatgacactgttgttcccaaatattctaaatcaattggggtcctgaacaagaacaacacagagcagcctgccgccgtgatgcccaaagagaatcattttagaccctgaaaatgtgaagaagctgaaaactgaacttggattttcatatgtgtaaaatgtaataaaaggtgatgatgattaatgaaacatcatgctttaagaggtacaattctgggccagccaaggtggctcatgcctgtaaacccatcactctaggaggctgaggcaggcagatcccttcagcccaggagtttgagaccaacctgggcaatagggcaaagctgtttccacaaaaaatgcaaaacataggcaggcgtagtggcatgggcctatagtcccagctacttgggaggttgaagtaggaagatacactggcttgagcctgggaggtggaggttgcagtgagccgagatggtgccactgcactccaacctgtgtgagagagtgagaccctgtctcaaaaaaaaaaaaaaaaaaagagagagagacagaggtacaattctaattacaattatagtaattaa

SEQ ID NO: 344 - DNA, 101847 bp, Homo sapiens
ccagagacagacagcatgatggaaagaaagattcagacagaaacacagagtccacaggagggcaggcggttctcagcaggagagcttgcagctgatccaggaaacagaagggcaggaatcggatctcagaggcagaaaagcagccagagatcccagagtcccctgggtccaagccctccataaagccaaaccccacatccactcaacctccaagacccttcccatcccgacccaacccagtcctaccgccaccagctgcttctggggtaaggcagcctgctgtggctgcctggggctggggccaggcactactgtcctgtggtctgaccctctaccccgcttcagggcccatttatctccctcagccccctggggtgggagctggtacatgcttcctggcatgaggcagccccccacctatgactcatccctcccgggggtgtccttagcccccaccctatctactcttttccggggacaagttggggactgagaatcacaagacagtgaccaggactgggcagagggactctgtacccatgcagaataataccaaccccccaaggaaaaccttcccccttgaaaccccccatcttcccaaacagtcacaacaggagccttttaaaacagcagctttaatgccccccagaatcagcaccatgtcatcacaggcttgggtcaaggggcgggtcagacgccagtcacatccgctcactgcccacagccacccccccacagtgagtcatctgccagggtggcaggagccacaatgggggtttgtccacaggggggaaggctagacccacgggaccaagtcactgaaataacggacgtgcacacgcacgctcacgtgcacacaagcctctagcaccaaggggagggacagtggggttctgctgagaccccgactcctccaggggatgctgaatctcagctcattatctgggcctcagtcctgggcagtacctggtgaggacaggttggaaacggtcgtcagccatctgaccttccccggagacgctcaggcagaggcaccgccaaggggagggagcggaggctacaacaggaagtgggggctctgacctcagaggggtccatacttaggtctttaaaggagggaacatggaaggggaccctactgggggctccacggctggggctctatattcagctctttggtctgggcgtctgccccaggtcccctactgcgagggagcgtctcctccaggaccctgacctggaaccctggcccaaggactcctcccccagaacccgatccaggcaggctcagtgcccagttccccacggtgggggctcagcccatacctgtcccctggctctggaccacccggggtgggcagcggcgctcgcaggcctcacgggtcccaaaacggttggcattccctccacagccaccatagacaaaagggtgacaggcctctgtgctgcctgtcacagcccgatggtaccagcgcagggtgtaggcagtgcaggagccctcatccagtggcagggaacaggggtctgggccaatggggtcaagtcagcagggtttgtgggaatcagagagggttgaaaggtcagggggaggtcagcagggctcagccctgcctgcccctccccagaccccgctggcagccccccattctcaccatcactatcccaaggagcttcagggtcctggtactcctccacagaatactcggagtattcagagtactcatcatcctcagggggtacccgctctgcaggtagggcagggtgtgctgggagcagtggctgctggccccggggcaaggtgggcagcactgatttccactgtgtgcacacagtgcccatgcgtgtgccctgcatgcagaccctacgtgcttggcgtgtgccctgcattcatggacacccatgtgcgtgtctcggccccacccatagctgccccacgggttcagctgtcctcaccttcctcctctgcatgagagacgcggagcacaggcacagcatggagctgggagccggcagtgtctgcagcataactagggaggggtcctggagccaagagcaggggcctcagggccctgaagtcaccatgggcagccatcccagccaacccccctgagaggaccccagttgataggcagggcagggcctggggtgaagaaagttctgggagtagaaaactactcacgtgatccagatgcgatgaactggccctggcaggctagagggggcagagagggatagagagacaatgacagagagaaggatgggaagatggagagacagacagagacacacaggcagaggggtagagatacacaaagagatagcaggagagggtaacaggagagagaggaagagagagggtgggaggtagatagagagatggaaaaagagaagaaggcagaggagagggaagttgggaacaggccaacaaaaggcaagagacagaagcaggccagacacagaaacaggcaggtggtgcagacagagacgggaagagacagcttcactctgatgcccctcccaccgggtccaggtcaggcccaaggggaccagctctgctcccaccatcatcccactccccacacagccaagctggacatctgagagcactgcatggcaatcctcatctgcctgtgtgtctccctccactggggacacatgtcatgtgtcagtcctgcagcacatgtgtccttctgtgtatccatccatccccccatcttcttgactgcttgccctgtaagttctaggggcctgcctgcccttgcctagggtgctggggtggagtgggagactgcgggctgggcaccactcaccacagtgctgactcatctcttggcgcacaaagccccggatgtcatcctcctgggagcagaagaccacagggaccataaagaacccatggcccacaggaaggacatagggcacataatacagggactatggtgagactgcatggagccagggcccaggggtcagggtgctgggtgagggaggtagggccccagcccacccaggcccacccaggccctcccaggcccatccaggcccacactcaccgtcagtgcagcttctcccttctcgcctcgaggaccggcaggccctggccgcccctatgtgcaacagatgggaccaggctgtgacctctgacctcagggacaacagaagtcaccccgatctctgacccaagccttggaatccctactcacctgctcccctctctcgccaggagctccagggaccccaggagcccccaccactctctctccggggggacctcgctcaccctgtcagacacagggaccaagtgagcagggtcagaggcagtggggatcagagtcaggcaggttgggggccacagcttcagaggttggggcaggcaggctggaagatggttatgaggttggaagggtagggaaggttcagggatcaggagtcagagctggggccccttaccttctggccctgaagtccttcggggcctctgggaccaacactgccaggtggccctgggggaccagcagagccatcatttccactggggcctgggaagcccccaattcctggggttccctggggagatataggacagagtcagtaatcagaggccccagagatggaccctctcccaaagtgcacgctcccctcaattcaccatgaccatggcttcaactcacccgctcccctttctcgccctggtcacccttggggcctggctgcccgtcaaagcctcggtcaccctgggaacagaagaagcatgagagaccttctgccctgacctccctcagctctggaacctccctgaactcccatgagctccctggcctaatgcccaaaccttctgtaacccaagcacctgtgagccaaccagatgtgatccccatgactccaactccactatagccccctgccctgatgcacatgccccctccacctcccatgctttcatcctaactccactgtgaccccaacccaccttgacacctcgagaccagccccacttcagcccccaaagtcccaaccctctacagccttccttgtccctacacccccatgacccgaccatgagcttccctgccccatcctgactccctgtcatgtccactgtccacagaccctgtaccttgggaccgatcaggccctccttgccaggggcccccgactggcccggcacaccaggctccccctggagaaaaaaagacatgaacttggcccccgtccacccgtggccccctcattctgagcgtgcccacactcaccatctctcctttgtgtcctgccagcccggggcggcctgggggaccagcttctccctgcaggcatcaggcagtggggtgagccttaggccccaggccacgtagccccccagcccccatcccctctgtaccttgtctcccttctctccatcaaggccacaggctcccttcactccccgttcaccctgagggagaaaagcagatgaagaagtgattcccagacacctcactctgtgacccccttcaccctgaaactaactctccaaacaggcctcagctactccaacctctgacccagtgccctaatatctgaccccaggtccctcgcccttcaacattaggccttcctgaccagaaaaaaaccaatcttgtttctttcctaccttgaggccccggggacccatgaagccaacatctcctttttctcctcggataccaggcactccatcctttcctggggatccctagcagggagagggtccatgtgaggtcagaggaggtcagtgagggaccaaagagaatcgccctggatagtgggtagggaacaccatggggtgggagtcacctctggaggccagagccactggggcttgccatggggacaagggtcaccataggcaggggacaccatcataggcggctactgtggaggtgggggaccctgggtgacatgaggacaccatgagagcactgggtcactataaggtcaaaagctaccacactggtgggaccaccatggtgacgggggccctctggggacagggggcccctgtgggagcaggggcatcttaccgggtcaccagggatccctgctgcaccaggttgaccctgtgagaaacacagatgggggagcccttcagtgggactgtccccaacactggcccatccgctgcatgtgtggccactcagatgctcagcggccagggcccaggccacacacagatcccgggtgaacacacatggggccggcagcaagggagccagaacccccagcacttaagaggacccccaggatatgtgtgtgtgtgatgctggctctggacctgggcctgggcctgggcctggggcagaacttgcctggggtcccaggagtccacgcagtcctggcaacccggctgagcccttgtcaccaggctctcccttgctgccctgtgggagtgaccaggagagggattcagtcaggaccagatcaggctgggggcttagaatacaacgagcccgccagctggggcagagctcaagtcactcccgaacggccctagcagcacgtcctcccagcctgtgccatagcgggtggaactgggggctgtagtccacagactggctcatttctcaccccaaggactccagacccttgccccgccctcttatcactgggttcctcatcccatctgaagcaccttcagatggggacacccaaggagcccctttcctgtccctatagggccccttcatagggccagtccacagagctctcctaacctcacaccaaggccttgagccctccctagagcccctcctctcggccactccatagtcagccacagaaccccttccccctaaaccccagaaagcctcctcctgtcctcccctcctgccctcacagatgctgtggaaccaccacagccacaggaccccacagagagtacaccaccctcttccctgtaccttgtcaccagggtccccattgtctccccgaggtcctttgtcaccatccaagccccgaggccctcgttcaccctgggttggtttgggtaagaagtcacggtaaggggctgaaggtccctcaccctctgggagtttgagctctcagatgccctgggccagccccacggggtccctctcgcacccaggggagacccagtccacacgtgggcccactcaccatgtcccccttggcaccccgtgggcctggaggccccaggatcacagctgagtctccctgagggggcaggcaggaatcagaggagtcgggagcaccctggcccctgccctgccctccccatgcccacactcaccttgtcaccctttagtcctgcactcccaacatcaccctattgggcaaaagagtgtgagtcccgcccaaactggggaggccccgcacctgaattctaatatcatacaagatccactcacccccccactcatgccaggaccttccccacgttcctaccttctccccacgctctcccctgctgccagggggcccctgtgtgagagaaggtgaccgtgagctacaggaaccagggcagtggaggacggaggaggatcagggggaggagggaaacagtggggaccagacaaaggggacaggggtagacgaggagggccagagggctagggaggatggcagagagtcctggggtacaaagggcacaggcaggggactgaagtcacagcactgtcactttccccagcgggacccaccgtgagtcctcggggtccctcctggccggggcggccatcttcaccctggatggtgacattaggttcattgactcagaggttggaaatcagaggcaagagctgggatgaagggagttcggctgtggagtaagacatacgtacccggatgcctggctccccacgctcgcctcggggcccaggcagccctactccagggtctccctggagaccaacaggacaccggggatcagtgaggggaatcagtgggggacgcagggtcatgggaggtcagtggaggctgaagggggtgaccagggcacaagagagagtcagcagcacttgtcccacctaccttgtctcctttgagtccagaggccccaggtggtccctgtaggtcagagtgaggtgagggtcctgtggctctcaaagcgcctcccccaacaccccacagtgtggcccgccccatcctaagtcctcacgaggacaggaaatcaaatacgtggggctttagggcacctctactcaccactgaccccggtggtccaggtggccccaggggtcctgggattccttctctccctggggggcctgccagaccctaccagaaaaatggggcaagagaggcagagagtgacttgggaaccctcctaccctctgccccctcaagactgggaacccccaaggcagggccccctcctcacccaccatggattcaccatgcccctacatgctgttcccagcccctcacccgctctccactagggcctggctgacccatctctcctcgagggcctgtctgacccgggaacccaacaacaccaggagcaccgggcaggccagggaggcccagatctccctgaaataaaaacagcaaagggagggaatggtcaatgcaggacccctcccaggactctcatcagaactccctcttcctcctgtgggggcccggcctgctgcccctacaactggtgatggggcattgacttaccttcacacctggagggccaggaggcccaggggagcccgggaccccgactcctgggtcaccctttgaggaaaagaggcatcggatcaagctcagggagtctcacgaccaggaccccagcagggacccttctgggtacacataccttgaaacctttgggtcctggagcccctttctgaccctaagaaaacccagcaaacagcatttgagagggtaggaacatgagcacagagttcagacacgggctgaaaatattcccaggggagttctgatgtgaccatgaacacatgggaactcagacatgcgaccaagaattggctcacaggagctcagacatgaccatggcctatctcaggacagcacagacagagggacgctcagatactaccatagacaggtgggagttcaggcatggcacaggcacagggagcccacacgcgagtgcagacatctggctccacagacgtgagtgcggacacacgggcgctcagaggggaaccccaacacgtccactcccgggtagagcaggcatggccacaggctgaacgctggcagccaggggcaggggaaaggaggattgtaaacacaggaccaaggagaggttcacaagaactcaggtgtgtcctgggatctgggagatcagaccagagcacacgtgtgcccagatgtggtgagaaacagaccaaggatgggcacacagaagccaagacagggcccccagagctcagagtgtggaagccgacagtgtgtggctccctgtgatccagagagcaggctcctggatgttgggacatgcagcccgactcaggggctcagacatgtgccccggcccaagagtggccccttatgcccgccatcacactcctcaggccaggctcgcccttgcctaggccccggactcacatcttccccagggtctccgggctcccctgcacggccagcttcaccctgcacagaatggcaggtgaggggtgtctggactgagccttctctgctcagtagtcaggccccagggccaacccacctcaccttctcgcctcgcggccctggcagtcctcggtcacctttggctccctgttgacagaggtcaggaggcaacacaggcatcagtcacagaaagatgagactccggagggaggcatggggccagagcttaaatatgcggtctactatgaaagctgagggtcatgagggtgggtaaactatgggtcgaaggtcagaagttaggccactggagagacaggacccccagaacatctgctgtcagaagttccctacttaccggctcacccaccaggtctccagcaaggcctccaggggctccctggtaagggggagaggtcagtgggattccttggcccccaccagttgaccccccctcactggcagccccacacacactcaccttctctccctttgctccagggagcccgaccacagcctgtggggaatgctagtgagtttcctcctcctcccccgcccccaccctgccacccccatggcatttggaaacaggcttgtgggtgaggcagaggagttgctgcagggggtggaagtcagggtcaaagatcacctgtccaggggcccccgtggggccaggttctcctttaggtccgacagggccaggcagacctggtgacccctatggcagagcagcgtgaggaactcagtgcctctccaccaccacccctgctgccccactcctcatatttcaggcccacagctgggcaccacaccctagcgagctgcccccagaacacatactggcacaccagggctccctctgtctccatcttttccactggcaccatctcgacctggggctcccggcttccctgtctccccctgagagggaagagctctgtcagggctgcctgtcgacccttgacccctggagcccaacccttgacccccagaactcaccacttgtccaggcaaacctggagacccctgtggaccctgacggagaacaagtcggatgtcagggtgacaatggacacaggacgacatgagagaacatgggccccaaggagtgaaaacacggtgtccctacaggggccacagggactcactcaccacaaggcctgaagggccggggggtccaggaagtcccacagctccagtaggtccagtcaggccctggaggaagagaaagttcagggcagtgccaaccccacccatctccctatgaccctaacctgtgagctaggccactcacccgtcctggaggtcctgtctctccaggctccccctgcaaacaacccagagactgcatgagcagagcccacgtggccagggctcctggagctcatcctcattgcaggagatgacagcccaggaggttggcgcacactaccccaggcatggacacagcttgaaggagcctcctcctcctatccacacacctagactcaccttcaggccagaaggtccttggggtcctgcagggccagcaagaccctagagaaaagggtcaagggcagggaacagggctcagggattaacacagagaaggcctggctcatcagctgtggccaatgcctatcccagcccttccagaccctcaccaggcagtgttccctggtcactcaccggggcaccaggtggtccagggtctccatgaccaccctgttgtggcgaaaaagagtctgatgagggggagttagccgcaccccaccaaggaaactgaggcagtactggtcactggggcagggcacaggatgggggcaagacaggtgaaggttcttgggtactcaccactgggccaggggggcctcttggaccctgcagaccctacatagagagggcactgatgagcctcaatctgggcctcacttgggcctgttcccaacctctgggggctttttccttgggggtcaatttccatacctcaccctttccagtcacagataatacctacccatggactgcctctcatagatagcacacacgggcctgcacacacacatccacatacaaccacacacagacacaggcacacacaggcacacacagacacaggcacacacaagcaggcacacacagagaggcacacagacacaggtacacacaaacacacacacacagacatgcacacacacagcagcagcagcacctagcggagggtccggagcctggggccaggtgcttcagccaccactcaccggcttcccttcaggcccagccataccacgctctcctggtagaccctgcagagaataggtttaaggccttagtttcccagttccaacttcccctccacccaccatccccctagacagagtcaggacccagacagtcccaggcagtacagaccccagccctgcacacaggacaatacatgtgagagccaccttcttgcacatgtgtggctgttgggcaaggacttaccgggttgccgtcctgacccctcggtccaggctctccccggtctcctttgatgcctggcacaccctgaaggcagagtgtcgtgccctgagcccccagtccctgccacgtgcccaggtgcatatgcacaccacctctagtgtgcccccagaaaggagggggactctatggaagggtggagagaggcctcaccctgtctcctttgggaccttggtcaccattgctgcccggctccccctgtggggatgagatgtcaagtcagtccctagtgccatggcagagggtggccccgagctgattccacacactgaccttagcacccttgagtccagggggtccctgttctccagagagtccaggacctggctcatccacagacacctacaaacacaaggtcacaggggagagatgtctctgtcatagaggcatgggggagtcatcacagatctcaggatcacagagggttatagggtcagaaattccagggttatggcacacactaccatatttctggggaccaagctaagggtggcttcctggtcactagtcacaggactaaggcagggatggggtgatcaccttggggccagggggtccggggggcccaggggttccagggagtccaggagggccatctctgccctgcaggaaacaagaaaatggggtggcagccccagcacagcctccagacagcctgccccacgaagcccatcgcagcccacctgttctccacgttctcctttctctccccgttctccctgaaatgcaaatagcgggtgagggccaagcccatggggggtcccacccctcccaacccctcttccctcactctcctggccagcccccagcctcaccctctctcctggccttcctgcctctcccacacccccagccctgcctgggagcccgggaataccaggctttccaggctccccggcaaggccggaaggcccgggggggcccctctccccaagggccagaccaggtggcccctgagggccagggtctccacggtcgcccttcagcccgcgttctccaggaaagccgatggggccctgcaggagtggaagagagaatgctggtggctgtacagctacaccccactccacggggcacaacccactgagccacttctgctcacctccttgcctggggggccctgttcgcctgagtcccccttggggcctcgacgccgttcgggcacaggcaggaagctaccagagctctcatcccaggtctccacgatctcccgcagggcagatgcctgagggacagcaagaggtcagaggagcggggtgcgtcgccgcagcccctatgcctgtgggcaccactagccccaagggcccccacttgtccctacccccagcccctaaacaacccaccttgatgccagcagtttccagcaaccgatccacattctggggacaaagtctgggtgaagggctgcccatgacagagaagctcctgccttctgccccgcacggcctcaggaaagcaccttcacacccttttccctaggcctcttgcccagagcaccctttagcacttggttgaggcatggctggagactcctgggagcccctttctggtgtgtccccactgcccaagttcccttgagtgtgggctacaagaaccccaatggggcagggcactgaacacacagcacagaacctatggagcctcatggcaaggggaaggggatggcaaggtggccccaatgggcatgcaaaacagagtcaaggggacatcccaagcctggctcaccggcacacttccaggctctcctcgcaggccacgctctccagggaggccctggagagatgaagacaaactgctaggaaccagcctatgggtgtgcatgtgcacatgtgggtgctgtggctacctgggcatgtggaaaaggtgggggcctcacctgctcccctttggatccagtctccccacggtcaccctgaaaacaagaatgaccaggtggggaaatggcccccagcctggtcagccccctcaccacgccccctacccaacatccgcactcaccttggggcccgtgcctcctgggacaccaggaaaaccctgagatacggcagaacacaaaggggtcacaaaggcccatggcttcccaggagggttgcccattgaaacatcatggcttctaatgctctgaagtcccagaatgacccaggacactcacctggccaggagggcccactggccctgggaggcctggaggcccctggggtccaaggataccaggagctccacgctcacccttggggccatcacgaccctgtgaaggatgcagccagcatcagcaccctgagacctcagaaaagagtggagtcatattcccccagggtcagggtcaggggtcagaggttgcagaaaactccaatactcacttctctcccagaggcgcctgaatctcctttctctccctaaggaagacaaggatgcttcaggcatggctccaagcagagaccagagagaccccaggtgggggactttaccttcctcccgtcttctccagggtccccaggttctccctgtgggcagaggactcacatcagcccaaacattcactggtgtctggctgcaagacactaccttgctagatttcagatgactgtgactgtatttctgtgcctgtagctccatggttgtgtgtgtcttggagcatggcctgtggccgtctgagtgagctgctacatgtctaagggtgtgcctgcataggcctgctcaccccaacaggcaactgcacacatgtcctttgactctggctctctagaggtagctccacatttatgcatctctgggttggtgatcgtccacatgtcctgggtgtgtgcatatccatgtgtgtcttagtacatgtacccatgggtctgtgtgtcctggtctgtttgcacatcttggcccatgtctgcatatgggcatgggcttatacatgtctccaaagagcatgggcttatacatgccttgagagccatgtgtcttggcatctgtctgcaactcttgtgtgtagctcaatgtgtatgaccataagcgtgtgggtgaccatataaagtcatgggccagcatgtcctagcacatgtcacaggtcagagccatccatgtgtgtctcaccatgtctcaacacaggtccacatgcggtcttgggtccatgtcttagcacatgagtctgggtggaagtgtctgggtatcaacatgtctctaagtgccccaaatgtggctacacaccagtgtgtttgtgcctgtcgacctgtctgtggctcttcacctgtgcctatggctgtgggttatctgggcatgtgtcagcccatcctggcataaattggcccattcacctaactccctatgtgtctgtgaggctgcctgtgtgtgcatatagaactatgtttccaggcctggcgcaatggctcacgcctgtaatcccagcactttaggaggccgaggcgggcggatcacctgaggtcagtttgtgatcagcctgactaacatggagaaaccccatctctactaaaaatacaaaattagccaggcatggtggcgcatgcctgtaatcccagttactcgggaggttgaggcaggagaatcacttgaacccgagagtcgaaggttgcagtgagctgagattgtgccactgcactccaacctgggcaacaagagcgaaactccatctcaaaaaaaaaaaaactatgtttctggatgcatctgtatgtctgggccaggatgcatgtgtctacacgtgtgcctcatgtgttgctacagatcttggctgtgtaggtgtgctggcgtttcttggcaggtttcgccgcagctgccctggacacactcacgttttttccattcaggccaggtttgccatcctcgcctggctttccctgtgggaacagatcactggttggatgtcggggatcgggtgagggtagtaagggggaaaagggggtaacatgaaagtctggtctcaccggtaatccagggggaccagaggggccagggaggccctgttctccacggaggcctggaagcccctggaaaaagtctttgttaagatttatagggcctctgagatatcccttggggcacaccccatggactaagaggaccccaaaaagatctccctccagggtagagacccccaggactgagaggtcccattgagatccctcaggcacagaccccatggatgggggcccctgctgagactcccaagggaagaacccccaggacttggagggcctatgaagacccccaaggcaaagaaggtcagaaagggggattctactaaaacctgtgtgccagggactgagaccctcccaaaggcaaggctgaaccgaccccccaccaactctctcggatgctgtgactatgatgatctggttggagcttacgcagccccgagccccctctgtcccagcatctcccctcacttacgtctctccctgggtccccagctttgcctgcagcaccctgaggagagactcaaagtcagttcatcatggtcatggggtcaggggctctagtccctgtgagcctaaggcctgcatggcaagaacatgccccacccaggcagggctctgggagaagacacagacaacaggtctcgccccagagctcgtcaaggccaagaccaaccaatgaggctggggtctagggtcctcatgtgaaggggtaggggaaggggacaaccaggcaggactaccaagactcacattcggcccagagggcccagcggctcctggtttcccatccagtccgctccggccatccagcccagggggaccccggtcaccctgtggaaaatagagtggtaagaggccaccaaggctgaggtggatctgataacccaggctcatgtcctgagaaacccccacaccctctcaccttttctcctgctgggcctcggacacctgggtccccctggagggaacagggtcagataagaggtgagggtaagatggggacttggcagacggggcaaagtgcatcactcacctgtgggcctgggggtccccgaaacccttcaatgccctgaggataggggaggaagaaatcagagcaggccctcccatgcctgcacccccgaggaccaatcacactcaccctttccccaggggctccagggaggccaggatcacccttgggccctcgaggaccctcttgtccgcggtccccaggctctccctgtggcagagataagcttgctgaggaacagccttgaagccaagccatgcccaaggtagaacctgctgggaggggcactggggtctttcttaccctccacccacagaccctaataccttctctctggctccaggtcctgtgtctacctgtggggggaatgaccagtgagaagaatggctcaacaaggggaagaggagttggcgaggggatacagggtctgtgaggggctccagggatccgcggaggtttcagagggacagtgggggaagtgggagttagtggaaggaatgaggggacatgatgtggagccaaaggggcaagtgagaacaatgacagaggaccagacccagcgcagcccttaccagccgtcccgggggtcctgggggaccctgggaaaggaaatgattatagtcaataggagccctcaggtcccaggccatggctctggtttgccccaggctcaactctgcccccaagttccccgaagcaccccaatgccagcccccagcaggcatgggtggccatccatgcttcccacctggacctccagaccccttgtgtgaaggcacactggcagcagcgccaggggaccctccatcccttctgagcccaggacaccagccctactcaccggctccccacggtcacccttgggtccagatgatccagggctgccctgcagaaaggcaggggtcagggccactcaaggtaggcagcagtttgggagagctttggaagcaccatgaggactcatgggaatgttggtagccttcagatgcgtgtgtgcaggggtcaaaggaagtgaagattgggagggtttagcattacagggttggggggtaggatcaggtattgggaattggctggttggagggttaaggttggggtgaggagtcataggctgggactcacatttcgtccatcctctccaggatctccctggtctcccttttcacccacaggcccccgaactccaggtgccccctaagaagagcagctggcctgagacagaccctcccaatattttgcaggtgcccctatgacccgctacactgccccaggttccccattactccaaaatccacatcagaggttcccatcaccccatgcctccctgcagggactcccatcaccccttacccccctcagcctttcctatcaccttcatgcccacctcccatcacccctgttacttctctctgccaagactcacccgaaggccacgctcgcctgcttttccaggcaaacccgggtcaccctggtgatagagagaaaagtcatactgcacagggcagtcaggatctaactcactcagggagaggggacagagaagggtctgagcagcagctggacaggaggcagggagtggatggatgaactggtggagcaccagcctactgggatcctagttcaagggtaaaggatcagaaaccacagtgggaaggagtctcaccggaggaccctcgtcacctttctctccaacttcaccctgtgaaacatgagagtcagccctggttccaagaacccccatgatgctggcaacagccctactcccttacccgccatgactcccccgactccagcctcttacatctcgtcctcgggggccaacaggtcctggggggccaggccgcccagggtctcccttctctccaggaggccctgagtcaccctgtggaggaggcaagagggaggtgatgcaggacgctcgaagcaagcagttctcaaggggaggggaccccagaagccttgaggttgcccagggtaacgggtactcactgggggtcctgctctgccagtaaggccaatgggaccctgaaggggacagaaggggggcaggacttagtcagggtcccaccacctcatctccctctgtcacactccccattcccacattgattcacccggtctccagggtctcccttggggccagggtctccaggaagaaccaagccgggtgggccctgtggatggaaggataagaagtcaggaagacaaccttcaccaactgccccctaaacacttcgcttcacttacccgttccccttggactccggtagctcctctgggcccagcgggccccacatctccctggaggtgacaaagaccatcagtgctagtcccaggctccagttaaccccctgacccagcaagtcctgtgaccccccaagtcccatagataggccctatgacctagacctcaaccctgtagaaacctccccttgccccataccaggcttaccttttctcctttgggtccagcaacagcaggtccctgaaaacaaacaggacagatacagcttggccctgccttggggttgtatgatcaaagtcttcattggaatggaggtcacatggaattggaagtcatacagctcagtccccgcccagaagtcacagagtcaccgctgacagcagggaaggggttatacaaaatggactgacacaaagagctcatgacctgcatggcggtcttggggtcacaggatcatagccaagagtctgggggcaggttctagcagaaggagagccgcagagctcccagcctgctcacgggcccagcactgtggaatcacagcccagatagtgttctataggagggtcactgctcaagggctgtgctgtgctcagagcgccatcctcccgtcactcaccaccactgcagggtccccagggcgaccaggctccccctgtggagagaggataggagcagggacaggtcagggagtcacctaggagcccaaaatcccagtgtcccatctgccacatccctagtaccagacagtgccacccccagccgaggacccaccttctctccttggcggccagtgggtcctggtggcccctgaatgtagagaaagtgtgagcccaggaggggaagggaaaggggagggacacacaaaagtcccactcctggtcccaccacagtcacagactcacttcaggacccttggctccaggacgtccagcaacccctggcagcccctggaggagaggaagggaagagctgtgcaggtgggtggggacgggggatatggacagacagggctagaggctggggtgggggctggagaggggtcagggaagattgggatttaggttggcaggggtaagacttggcaggagaacagagaccaggtcagtgaaaatcaaggtcagttcagcagggtcagaggttcaaagccaggtccctggggctgagggttagagcctgtatcagcagggataagtggtcattgaggaggggtgaggagcaggggtagcaggggtcaagggcaagaagtcagaaccagaaagggcacagccaggtcagctggtatgagcattgcagccagtgggtttacccgggatcccgctgggcctgggggtccacgttcgccctgatggaaaagaagaggtcagagctgagttgggcccagatcctccagggcccttggcaccccccaggttgcacttaccttctctccagcctcacccaggggccctggaaagccccggtcaccctgaagagagagggtgagagaaagacagagagagagagggttggtggcggggcttgaacgtcaaaccccagacaaggggtcccaaactccaaccaccccctccaaaaccacgacctctgacctggagggaactcttatctccttatcttccagcctcccctaacaccatggggagcccagagtagcacccctcacacctgaatcccccaactggtactcactttggggccaatagctccaggaggtccccgtgggccctggaagggatgaatttgggggttcagagatttgggtttgggcatgaggatggagcagtggttgatgattgaggtaggggctggagctgtgcccaccatattcagaatccctggcccctccactcacctgctcacccggagacccaggttgtcctgggaggcctggagctccatcctcagagtcaccctgaaggagaaacacacgggtgggaagaccgaagggaggccctgcccccagcacgcagcctcccaccccagaactgggacatcatcaagtcagccttcctactttttctcctttctttccaggggggccaacggggccttggggtccagggcttccgggaagaccctaggaagaagtgagtaaaaatatgagccaagaactatgaagcccagcacccaaccactgccccaggagagacccacacccctgagcagggcccccagcagagcctcaaggcccctcaccggcagcccaggctccccaggagcaatgccaccttcacctggtccagggggaccctgggagagaacagcaggtcagggaatgaacaggggaatcagactccaagccacccctagcacaacctgtccctcacttacccgctccccacgatcgcctttgtcaccctagaaaacagatgacgaccccatgaccctgggccacacctcactcccaaagataccaggagtgatgagggtcatggggtccaattggatttcaaggattttgggagaactgaggcgtcatggtgaggatgggggtaatcaaagggtcacaagggccagagtaactggcaggggttatgtgggttcaaatggggtcaccaggtctctgcatcacatggcactcatgaggctgtcaccttcatggctgttccaggaagccctggggggccacggggtcctgggtcccccagtggtccacgaggtccaggggggccctgatggaggagacaaagtataaggtgcaaccccacagacctcactctcgcccccctcgtgttggtccccccactacacatcacttgcctccacataccctgcacttaccgatggtccagggtcccctttccgcccaggaagcccaggtccttcacctccgatgacttgtccgggagccccctgtaaggacagagagcagtgggcaggattcaggctatgggggccttgagctggaagaagcccctagacatgtccagctattcctattcgcgccttaggccctgcacagggtctggtgtggggcagtcctgctcctccctgggacatcccggccgcctcccttcccccttcacctaccggctccccctttgggcctcgaggtcctcgctctccctgaggacgaaacagagcagagggtggtgcttgggctcaggcgaatgtcaacgtgggcactgcaccaccaccccaggctcccaccctgtggaagaaccctgggaagacacttagagagcaaagaagggaaggcaccttaccgggtccccacgagggccaggcaaccctggagagccctgcaaatggaggccagaggcagaacagtcggagccaccccacccactcaggcagcgcccaccctgacctgcaggacaaggcttgctcacctttaggccaggggctccaggggtcccaggattcccggcgcggccagggctgcctggacgcccatctgctccagggaagccctgaggaggtgaagaggtcaggacaggaagggaccctcccccaaggcccctggtttgctggaggggcctcaccccatcaacaaggggtcgcctaccccactgacccccaagtgttattgggggtggaacagtgaggcagagaaatggcccctcagagcttcacagagcccaattccaggcacaagggcagcgacaaggcagagggcttccctgcctctgggacttggagctgctgctcaggctctgcagcggggctagaggccccactggcccttctatttcagagtgtcccccaaagtctctgtggtggtttataacctccagctgggcttctaggaattcccgatgattctaactctgcttcttccttctctcttgtaaaaaccccgagacagctttgaggagtgcctcagagaaacctcgatggtctccacactcaccctctcgcccttggcagtggcacttccagggggcccctgggggccgggagcaccggtcctgccctgaaagaagatagcagttaggtggggataagccagtcagggtgcagggacagatgtgggggacactcaccgggaggccagggtcgccaggaggcccaacttgtcctctcaggccctaggaagggtaatcagtgagacctgtgctgccaacctctcctgccccactgacactcaacccattctctattccccgcccgcaggggcactcaccatctctccaggttcccccttctggccctggggaaagacatgtcagatgtgggtcagagtggctagccccaggtgcagcctctgttcacctctcgatgagggactcttacctttggacaatacactgggcagggctctggccggggctgcggacatagggtctctttgaggttgaacatttctaccaagaacccccagaccccttatattctaccacccagtcccccagaggcctcttccaaacctgagtagtgaaggatgcctgacacagggctgtggccagaccactgactgcctggtccaggcttggcccatcatccacggcgaagaaggtctggacagagtccatacccggcgccaagcgacgcagctgctctgggtccgctccagccattcccaacatcaccacattaagccctaaggtggggtccagtggctgcatgatagccttttcagggccacccctattcccagaccccttccccatcagcctactccttaccagaagcctgggcctcacggatggggctgaatatgtcacctctcaagggttcatccactagcagaaccatcacccctggtacgtgctggcggcgcccaggagcatctggtgccaacatgtatctgtgagctgtgaccacggctgtgcctggaaggaaggacatgtcagaaccctggggcaccaagctcccagtggatagccccaggagtccatgcctgctgcagtcctcacccaggttgttcccacttgggtccatgtagggcatgtcacggatcctttgcaagataatgccaaggtcatgggagccattcagtgggaacagtggggagggccgatgactgtaagacagcaggccaacctggggtggaaggaaacacagagcctgaggaggatgacagagcagggatgggggtgcacagagcctggagaaacacatcagggtgtgtgtgaccaaaccctatctattagggagtcagcagtgatggcaggatagggagccaggcagtaggtgaggtctggagcctgtgagagagctgggagaatgcctgaacctattgggtggtcaggagatggtaactggtatggagcctgggtggggggcctcagggagaggtagaatctggctgccccagggccaaacctgaactgcctgtggcccaagaggcccaagtgccaacaccagacgctccaggaccctcctcgtagcctccgcacggtgagcattgtcttgagtggcatgtggtaggaacaccacatccgccaggccacgggggcacactgtaggaaggggaacaagttactgaagcgggcagcccacccagacacacctttctgcccttcccactacgcccactatacctggcgtctgtgtgacagatgcctcaggaccccgcacaccatccaggacaggcgtcagggagaagatgtaagagacgccaggctctagccctgtcacccgctgggagcttgagatccctggaagtgtctgcggggacccaggcacttctgcaggagacagaacttgattaaaaagctgtctccacagagccccaactgccagcccacccaaatcctggcctccccctcaccctggccagggcctctgagtggccgccaggataggatgtagctggatgccctggacactggagtccaggccaaagtcaccgagtcgatcgaggtgtccaccacacgtagttcaatgcttggaacacgaggtgactctgaaggaggaatgaaagatcgaggatcagaggctgagtcctgagaacccagaagggagagatctgagatcctgggtccggtttgtcttattgaagcatcatgggaggtcatgctggggtcacccagggtcagagggtgaggggtaggggtacaggaggagtcactcagagtcggggtgcaggaagtcagggtgggtcatcagcaggggaggagcacgccaaggtgaggcaggcttaccagtgcgcgcagtcacctctgcagagggcccttctccagctggccctaggacactcagcctcacgcggtactgtgtcgctggctccagcccgtccaggtgatagctgctgagctcgggccccaggacccgggactgttcctggccacctggggcaggcgtgagggtgggggccaagagcatgtgggatagtgacacctgggggcattaaagggcctgcccacttcactggctctgttaactgggttcaccctcctgactgatcttcctcatcctcactgaccctgcccactttacggaccctgccagactgaccctccatgaactcattgatcccacccacttcattgattgatcttacctactgtcacggatcccgcagacccccagtgacagaccccgcccaccatcactgtcctcgcctaccttgcggagtctgccacagccctgcccccaatggtccctaacttcctcctggggacacctctcaccctcaggttgccagtgcagaaggaagccctgcgctctgggcaccggctcccagcgcagcctcagcgagtgctccccgcgctgcaccacgtgaagcgtccccagggctggcggagcctcaggcgctggagagaaagctcaggaatcagggaggctctgcccccatggcccctgcaccaatcccaggcccaccctggcacacgcaccccgcccagcctctcagacccctctccctcctctcagaccctgcccccaaaggctcactaccaatcctggtcctttctccaatccagagcacaagcccggatccccaaaccatccacaccacccatccgaagctctccagcgcatgctctgcctacgcgtagtgacaacaatggagacaggtgtgccctcgcggtccccgacaagtgcagtcactcgcactgagtagctgactccaccttcgagaccccggatctctgcagagtctgtgtttcctgggagtatctggtgcctcatggggccgcctggccaggtgggcatacagcaatggttaggggtgagcagtcccagccaggaaggacaggggtggcgtcagggagccataccttcactccggccccaggccagtctgtaagctgtggctccagtgacccctacccaggtgatccgtagaacgtcgctggaagcattgaggatctgcagcctcgacacacgacccacaggctcaggggctggggacagaggcaaggtaaggggtcctggtagagaacagagaggcagtgcaggaatggttgacgcaggggtgatctgaaagtcagtgtgaggttagtgtggacaggtcactttaggcagccctgaggaggaggaggtcagtgccttggggtgggcagtgtggggccaccaggaggtcaccgtgggtggacacttaatcagtgtggggtgggtcagtgtggacaggacagtcactgagcaggggggtggaggcagctgggcaatcaggaacacacagcagggcagggtagctaatgcggtgtggctagtagctggccagggtccactcaccagtcctcacaaccacagaggcagggggcccatccacgccagccacatgggccctcacatgcaccgtatactcagtatctggctccagtccatccagctcagccaccgtggcctccccagaaaccaactgggatttctctgggcctgggaacagggatggaggcagctccagggctagcaaactctgtgccccagagccccacctggacccccaataaacccccagcccccattccaccctgacctgccccctcccaaaccccagtccccaccgtgggctgagtgccaggaaaccctgtatcctgtggcgccaggaaccctggtccaggtaatggtgacagatgagctgctggcctgagtcacatggaccgtcctcactgggcccagtgggtctagtggggagaggcaatggggagtctgctggaacaggcaggaaggagtggggctatctgataggggaagatgatgggagtctaacaggagacgggaatttgatagaggagatggtgaataggtccagtggaggagtggggaggtggaggttttaggaagcagtgagcaggtctgatggaggagaaagtgtaaatctcagaggagatttgggtccagcaaaaaagggatgggggtctgagggttgaagtggtggatatttgagggcaaaggctgtgggagtcttaggagagaagcggaggaatctgaatacggggagggcttaaggggagacagctgaaactgaagaggaagcagcgtctctgagggaggagggagtgggattctgaagggggaggcaggagttctggggagaagcaagggtctgcaagggaaggcatgggggtctgaaagagcaatggaggcagagagccaagggacgggggcagggcctgacccgttcgagccacgatgactgcagcagggccctcctctctgcctcgcagtaccgacacagccacctggtaggtggttccaggctgcagccctgtgatgtctgtggcagtagagtctgggggcagtgtctggctggactccggacctgaggtcagagggaaatgctggcatggctcctgcctgtcccctctggcacccataccctcattggtccctttggcagtccccccacacaccccacactgaccactgcctgtgctccagctaatccgaaatccactggctccagggacgggtccccaggccaccctcactcgcgttgcatctgacaccacaacccgcagccctggaacagcaagtggagtttccggctctaggagttacagacagaagtcagaagtcagaaccaggaccagagtgaggcaggcagctgtcctccacaagcctcctgcagtactcaccccggcggacagtgaggacactggcactgccctcacggggacccactcgagcagacacccgcacagtgtagctaagcccagcctgaacgtcatccaagtcgaatgctgtctgactcccaggaagcaccagggtccgctcaacccctaagagagaagtcagggtaggtgggcaggggtcagaaagagacagggatgtgggacgatggcagtgatggacagggacgcagagtgagaagggccatgggggtggggatgtggggtggtggggaccagagagctgggatatggctgaaaaaagtgagtgcaagacaaggacataggatgaaaggggccagtgatggtcagggacactggaggacaggagtctgtgggatcttagcatgtaggatgacaggagtcagtggactgcagtgagaactgatgagccattgacagacactgatgtgggatggcagaggtcagtgctggatggggacatgcaatgagaggttggtgtacagtggtcaccactagggtaacagaaagacaggtgattgagcttgtggctgtgcagaggtgaaagccgtggatggggtgtggggcagggaggagattggttggggtagggtaggggcagacacaccctgttgacagttcagggctcagtgccatcttgggaagcagatggataacgagacagggaggagactatagggacccaggtgtggaaggagagggctggaggtacactcagacccctcaggctggaacttcagtgtgtgtggtgggggtgctggctgcgtccacctcaccctgggtgctgcgcacaatgatgcggtactgggtggcaccagggactgggctccaggacactcgcacccgctgcccgggcagctcggtggcttgcaggtctgttacagggctcacaggcagctctggtcctgttggagagcacagcatagaggcagcctggggctccgacacctcccccactcactggcccagcccacagagccctcaccagtgggaaccacggttgcaggggtggccacctcgtggccctccagcagagtgtagagtgtgaggcggtactcagtgcccggctgcagcccatccaactggtagcgggtcacatcagagggcagtaccaccttctgcggtggctccaagcctgcaagataacagggtcagaccagcagaggccatgccctgacccttgcctgtccatcccttcccccgcactgaccagtctcacgccgccattccaaccggtagccacgggcctcaggcaccaagttccaggaaaggaggatggatgtggggcccaggatgaccgggcgcagggtctgctcaacagaagcgtctgcccagggcacatgggatgtcagtggcctccgggccttgccctgcctgcccgtcccagcctgaagaaagtgcccagccttctcaccagtgcgagccatcagggaagtggcgggccccacactgcggccaaatagggtgctcacggtcacctcatagtccgtgccaggctccaagtcacgcagcaacactgaaccctgcccagggcccagctcctgctgctgtgtgggcccacctgcatgggggacaccaaggggccagtgggccttgcagactcaggactctacagccttgtctgaggcgcggggactcccctcagcccacatctctcactcaccactgaggacccgccatgtcacacggtagccagtggcacctggcacactccgccaggccaccaggaggctgtgggctgtggtattctggatggtcagttccggcccttctagggcagctgggggagagtcccaccagggattcatggagtcagaagtgggagggggtactggggtcgggggttaggtgaatggggtcagaggctggcagaattgctcactggtccgagctgtcccgctcacagcctccccgatgctgttggcgtagagggcaatcacagtcacttggtactcggtcagtggccggagaccccgcagccgcacactggtctcaccagctgggacgttcacctgcccagggcaagaggtcactttatcttgcccagccaagtccccagccaccacctatcactcctgacatcctacctcctgccgctcactcggcagtggctgtcccagccccgtcagaggagtgtactggaccttgtagccagtcacagggccactggccgctgtccactgtactctcaaggattggctgcttggctcagacagcaccaggtctcgtggagcagaggtcgagtcatccgctgggaatgcgggatcaggggatcaggcaggaggattggggtgggcatgtatgatgcagagttggggtcggggtcaggagcacataggatggaatcagcactgccaagtggggattggggtccggggtctaggtcagggtacaccgtgtgggcaggaactcacgaggtcgggtcacaggcacgccaccagcagtcgtgcacactctccgggaaacgaggggcagtagtgtcctcaagatgctgaagtcattgacgaagaagaagaagtcactggtgggctgtgaggcaactcgcttcagctcctcagggtcagcattcttgatccctgaagtgacgacccatcaggactcagtcacccacatgctctctgactgcccccaccccccagctgacctgtcactcctgctcggtccttacccacagcaaatagcttgaccccctgccccttcagcctttgggcagctgtgtccaccaggtcctgggacttcccgtctgtgatcaggatgcagacctgggacaggtgcaggggtcaaatcacggttcccctggacacttcatttggggtcatcttgggaggcatggtaggggtagggatcaccttggggacaccaggtcgggccagctggggcaggaagacatggtcagccacatggagaattgcagcccctgtgcgagtgttgccccccttgtagctaagctcacggatggcgcggatcacatcacccccagagccaagtgcatccaggccgaactctgtcctgttggagggtaggggtggcaacaggctaggactcaggatctcttctggccctggccttgaggaggcctctagggtgagggttacgggtatcaggctctcttgaggggtcccttcgttctgtcattctccacacccacttgcctctggaacccccaggttaacaaactccccaggggctcctttgtgcaccatctgcaggtgggcctgggcagacctgaaggagcccttaggggctcacagtctgtggggaacaagatgctgcttaattaaataattgcaggaggaggggtccagatgtaggaaagtggatgctggccagatggagcacctctggtgaacggctgcaagggttagagggctagaacgtggagaatccaacaggcgtgggggccccctcctgggctccccatctccagatcagaaaacacagcctcactgtcttgcaccttcctgtcttgcagtagcctggaggtgcctcagggcacgaaggttctacctagggaatccttacctctgtctccaaaggaggtcctggctagggggtctctaggttccccaaaacttgtttctgcaaagacctggcctggggtttccagggtctcctccctctctggggaaggagtcttggtggggatctcgtggtccccagcccccagggcccctactcaccgtgggtcatcgctgtactgcactgtggcaaagcgcacaccctgtgcactggctgctccagagaaaggcagcaccagcccttcgagaaagctgcggacctcgcggaaattgctgcggccaatggatgaggagccatccagtaagaacacaatgtcagcggcgtaaaggcgcgtgcaggtcactggggcgggcaggagagatcagggcctcttctgggaggccaaccacccgcctacccgcacggtggcctcactgggacttgggatggtggggagagtaggcctcatcttatgcaaaccagggccgaatcggcctgagcctgagggccttggagggagttgagctcggtgggtcccagagcagactcccgcggagggttgggggtgtgcgggggagggagagtcgccagcacgggtgtggacttgggactgaggtcagcctctaggggccggcgtggattggcataaggcaggggaccccgcacgcatccagggagccagaatttgggtaggaacaggataggaggcggtttagggaacccagcaccgatcgcggagggttcggggagtcccagaattaggaggaatccgcggggcgtcgtggagttggctgggttgtgggcggggggtgttggggatgaaggccgagtggagcggagggtggcacggtgcagtgccccgggccgggtcctcccttgcggtgcccacctctctccctgtgctgggctcgcactcggggcgcctctgccaggatcccggcgcagagcgcggccaccagaagccgcagcgtcatcctaggcagtaaaagccgtcagctaggacccccgcctctgtcccttgctcccccgtggccttggcaggtccgagcccagcgcccctccagcccgagtcctggtcttgcctgcgcgtccgcccgctcccgccgccgccgctgcagtctctcgggcagagcagagaaaagtccctgatctcggggggcggagcggcaggcgggaacccaggcacccgccctcacccatatccctgagaggtcgccgccccccccacccctcccccagacaaacgatatgacgcacttaactataaaccccccgaccccccgtggcttctgggaatttcccagaaggttctgcatgggcagatgctgagggagtacccctaactccatctaaggtcacaggtcttggctgctttaggtcaatcacagtgaccaggctgaggagtggacaggttcctgcagagccacaaggcagcagcgccgtggggggtggggctgcagttggggatgactcacccccaatccagtgggggtgcccagacaagccctcaggccatgggtcccgccggccactcctgtgattcagccatctgtctggtgggcctcctgggccccacccggatctccttgacaggcaagaagccctggcaaatgagtgactctgggccggtcttagggaaaccaaggtccccttggcctggatccaagtaactcaccccctctttgtaggggataagccggaaggaggagagaacctgtgtcatgcttatgcatacatcccagtgtcccacatcccctaccatgtcacaggcagatgcaatccagctgtgcctgcagggagggggccgcccatctgtggagggcgggaccacccacagtgacagctcatctctcaggaatcgagccctccatgccccaggccaggtccccctacctacatgtcctcacccacaggcatcctctccttccatctacttttcttgtaggtccctgccacccatctcccctaccaggccgaggtccccttgggccccttcctcctttcctcactgccctcatggtacctgtagcttccagcttcataactgccccctaccttactcctgtccccttacccaggctgacttcacaccctcccccagcttcgcttctgaggctgtggacagtcctccaacacacaccacgccagggccactgtccgaaggaggtggggctctgtatatgcatatctctccattagatgggtgacactaaggcagagaggcactgctaagaagggcaggcccccatctgggtcctgctccccctttttttcctgctaatcctgaataactctgggcagcccagaaagcacatctatactcaccaaggctgctgggccccttctaatatgcccggccccacagcctcccctgggatccacagggagatatggggacagcactggctggactcctccacagcccgaggactctggtgtggccagagctggaggcagtgaagaccatccatgctgcctgctttcctattgcccaaggaaggctggggctctatcccttattactgaccccccaaactatcctggggcatagtgctatgaccttattccaaggtcagggtctcctcagccatgtcccaggaccccccatccctgcaaggtgtgctccaggtggggggctgcagagaaccaggtatgttatcacacaggcagccccttccccctaagactgtcacctcctcccgtgcagccagggcgggcaagagcaggccagtggcatggacagtacggtacagacatatgtgcacacgtgggccagtcttaggggagacaggaggcccagctgggagggtgggtgctcaggcaaacctcatcagaattgaggtgcctccaaaagaaaggacaggctgctgtgagagggtctctcaaagggtgctgggagaggctgttgagaaggtaggagtaaggttggaatgactccacgtctggagcttctatgagactcacgagcaggagtgtggccctctgaagccccagctctggcctcctgggaggaacacagcctagggcacagcccgaggccagtgcctacctgcaaccccatcagggcggtggagcccccagagcacatccttctccctcccaagctttccctgaacatttccttccctggcctcagtcactacctcaccccatctgtttccaaccagggcctctttatcaggtcccagccccacacatcccactgtaccctggacaccaccaaactcctcactggactatggaagattaccctcctccaacccactcgtgcctccgcgtctcccagccctgctgggaatgtagtcctctttgtgtcccctacagctggctccagttcgtgtggccatgacctctgttctgccacagcacagctcaccaagactgatacagaaatatggcctgagagtccccatgctgaatctcaactctgaccaagtcacttctcttcacagtaacctccaacacacctccccagcatggctccagggtaaagaccagagtccctggcttggtacgcaaggtcccttagaaccagaccactcccagcaactcaagctctcgtgtccagcacacctgtagcctctaagggccaggctgggcttagaaatgaagccccatcctccaggagctcaaacttgacaacagacttggcacttgttcccctgcctgggtgttgcacctccatgagcacccagggttgggcctgtcagggttctgcgctgcccagcatcttctctccagccgttcacaaagtagaatgatctgcgcaatgccccagtcccgggccgtagaaggtgcttaacaaatgtctccgaattggcaacgtatggcaaccaatggtgagggaaaggcagtggggcagggtgatagtgatacaagggttccttgggctacttccaagctacgatgctggggggacttctgaacagccatcttctaaaagaccttgtcccagcaccctgcttgtgactgccaggcagcgacttcctcaaaggaaaattgggcccctcgctttcaacttccccctgggatcccagagaacctgactgtggaagcactggggggtgcaggaggagcagcctacctgcgcacccaccatggggaccagagccaaaagagataacagagggactaggtagctaagagctgtaccaggtcctggctgcctcaggaaaatggggaggggattgtcaggccagcagctctggacttgcctgggacaaatgtagtagagggagggggctcgggccccactgagctcagggctattcttggagcctgagtcagcggaggcaaaggattcctgccctgcttgtccaggcagcagttagaaaccaaatgagaacactatgccccaggctatcctcctcccagaatgcagagtaaacacacacaagaggcatccttggagacaccccttggccccttctggtccaccagggaccaccagggggtgacttggcacaaggtccacagtgaggggtttcccacctgagcctgcagggattccaggctgggactcctacaggggcaaaggctgggtttacacttcctatggactcccacagcccaatcttgggaccagctggctgaggaactcccctaagtggctgagtggaaacatctgggctcagctccctgtaggcatcaaagacttccggcctcagctgcaacccccacgcttgcccctggctgaggacacatcagcctgtgggaaggcaggaggatccaggagccacagaactagagggaagtccttgctccccatctactgccccatggactccatgccaatgccaaaagagggatgacacacttctcagcagaggattttattggtggtcacctgtggcacaggttagaggagccgaagtgctgtgtttgtggtgggggggggaccacaaaccccggccctgccctcttgcttacataggcttcccgcctagaagcgcagccagaacatgccgctacggatccggttgtagtctgggagctgctcaatggggcctgtggggatagggtggagcgtcagggtggggtacctggcctgcacagggacacctggccctgtgccgcacccagctcggagatgctgcccagagcagcacaagacaggctttgagtggaaagagaggagagaacattcccccaggggtgctgagcctgtcccttcatgttctggcccttgaagccccaccccacatggaggtgcccgttacctgacgggtgcagggtattgatgaaggcaccttggcaggcagtcaaggaactgctgggacaggttttctgagcaagaactccctggcagccaggggactggggagagctgcttggggccttaactggctgctctgtaagctgagcagcagtgcgggagcagaggtggaaggggaggccaagagaacggcctgaggaaataaacaaagagcagaccccctaggccacttaccatatccagccactgctgggcactggtcatagatgtacttggagcagatctcacgtaccacactggcatccacctcctgcagggtgaggcagagggcatactggctaacgggcacctggccaccacctcagccagtcagcatcatccaactagcagagatctcccacaggcagcatgcagctgtccccagcccaaaagaggaaaggcagaagggatccctgctatagacctccatgggccccgcccatctccacagccatcagcacctatgccctgccctcccactatgctacccctgcaggtgacagctgcctaggacaccagggatgcctataggagcaggctgcgctatgccaggccccaaccctacacctcccaggtgtctgccaggccaagactccagaacctctcccaggggtccatgttaccgcaatccggctttcccattcagccagggggatgcggcggccataggtcaggaggctgcgtccgatgtcctcacacacaggagtagtgcctttaagggtgagagaaggctcagaggtccacccagcccaatcctggacccacaggtacacaaacaatctccagcctcaggttgacaaggacctccctgacctcatgctgactcagatcacagccctctcttctatggtcacctattatggcagtgatgggctgtggacctgtctcacacctgcctgcatctccaagggtggggtgatggggcatggcgtggtcttcaaagttttcctttctaaccttggttagttaggagcagtggccaccttggtgctgtcgctggcaagatgtactctacccctccccgctgagctgtaggactcaccatctagatgagataccagggcatttctgaggatgtttttgccccgggccacctcactctccgtggcactggtacacaggcgcatcctaaagtgggggggtgggtggtattcattctgagccagtgtgtcatctctcagcctcccactgtgctggttaaagccgccatcccacctaggaataccaggctgccacttaccactgcccttgcaggacgaacatcatgtcatcgattttcattcggtcacagacaaagtgtgcacccagcaagcccgtctctgcatagcagatgctgaaggtctggaaactctggcatagcttgttggccacagcacctgaagccagtgggctggacaggtgctgccagggggataggtggtcagcacccaccctcttgtcttcaacgcacactgtgacccccacgcacaggagcacacagccccagcaccctctcttccctgaaggcgaggtcccatgctcgcgctggcactcaccacgccaccaccataagtgcagtcatagtggccgatgatggcattggccacttgcaaggccacattgtccgggctggcccagccaggaccctctactgcaatggccacgtgggcaaaaggtagagcatcatcacggtggcggatctgaaacagtacatgacaaggctgaggaacagccagactgccaggggaacagaaaaggtggcaggtgtgggtagagggtgtatgtgtgtgaacatgtgtgcctgtgatgcagcagccacagaaccccttcccaactgctgaggtatctctggagtcaccaggataaccatgcacatgggggtcctcccacaggcccccagctgagcactactcctgcccaaaaggcagcatacctcactgccagtgaagcggcatggagtaagagtgggcacagcgtcctctgcatatgtccatgggatgccaccgaggtgcttctgggcgaggtctaacagttgctggtgctccactcctgctgagacagacagtggcattactgaccagccagggcccaaggcacagggtggggcgattcacagacaggcagaggacccccatgtcctgtcttagtgggagaaaccaggagtatgtgacattagaacagggtgaggaaagaaggtcctcctcagacagaccctgccttgtggacaggacaggcacctcagggccaaatagctcccatggcctcagtcccaggagagcaaaagcgttcagagtttcaaaatgggctgccatgtgatccaagtgtgggttctcacttgagaagatgcattccacctacatcaaggacaagactggtactcctgggcacaaagccacctggcctgccttttccctctagctctccctcaagtatttctggctgctggccctgcagggggtggcaagtgagggggcagaaagaggagctattacagggctgtgattagctcttgggtcccctgagagctggggacatttgcaaataatgttacaaacgtataccctaggactccttggatcttgcctcctcacctccacaagaggagggctctgtggtgccaccagttgcattggcctttttttttttttttgagacggagtctcgctctgttgcccaggctggagcacagtggtgcaatctcagctaactgcaagctccacctcccgggtccacgccattctcctgcctcagcctcccgagtagctgggactataggcgcccgccaccacgcctggctaatttttttgtattttcagtagagacggggtttcactgtgttagccaggatggtctcgagctcctgatcttgtgatccgcccgcctcggcctcccaaagtgctgggattacaggcgtgagccaccgcgcccggcctgcgttggcctttcattccttccttccatgagctcaagccctgctagtctgacacacacgtcagattgctcttgcccccaggttccccagctccaaagcccctggtcatgctcttcctattggtcttttctgcacactcagccgccaaggtcataagctgggaagcatgtttgtttttttttttttttttgagatggagtttcactctgttgtgcaggccggagtgcagtggtacaatctcagctcgctgcaacctccgtcccccgggttcaagggattctcctgcctcagccttccaagtagctgggattataggcaactgccaccaagcctggctaatttttgtatttttaccagagacggggttttgtcacgttggctgggctggtctcgaactccttacctcaggtgattcacccacctcggccttccaaagtgctaggattacaggcgtgagccaccacgaccagccaagatgggaagcaccttgacctcagttccttacccatgtccagaccccaaccaggttccatctataaaaccacctggagtccatctactgctcccccttgctcctgccatctcctgcccagtccctgccacagcccctctctagccagcctacctgcactgtgaccccacacagcagcagagcaaaccttagaccatgacactgctcttcccctgcgctcagctccccacaccccacctaaataacactcaccacctttcaggcttctgttcaaactacaggtgctttaaaaagcccctcccccaaactccaactctgagtccccagtgaaatcttccccacccttctgtgccttcctttcaaggcacttcttggtttgttatcaggcatgcatcaacacacaactaatggctggctctcccaagggcaaggccacaaggaacaaggccaggagcttacatcccctaccagcccatgaactcagtatcctagaaccaggtggggctaagacagacctgtaccagagggacagcatcctgtgtaaccagtcccagtggtggcggcagggtagaatcctatcccacctcagagagcacaggaggaaggtcattcccctcaaggttagggtgggagcagagtcccctggggtgaaaggtcccctatggtgggaaccaggacctcggctttgataaccaaggctgggaccccactacccaggacttcagtgattccatcactcacctccagctgctgccagcaccattcgaggggccttgtaatgtgtgctgaggtactcggtcaagtctgcacgagacagcttcctacaagacatatggtcagtgtgtcaacacctctaccacactggagtgagttggggtacatgcatgaatgggactgaggaggcagactaggagaggcatggtttctccgaagagtgggccctagcacactccccaacccccttcccctgtctctgccacccacccctccagggcccagagggcaacccttgtctgcccttgcctcatgcctgacttcaggacaggctcatagtcttctctgagaaggcgtgagccaacactgtgggactctcaaaagggcagcatcaaagctcccggagccatccacaaaggagacaagagaccacatggaggggacacccagacacttcgcccttggactgtcaggacatgcaccaaaacataccttaaaacaaagcccaaaattcaagtgaagcccacaaagccattaaaaaagactcactggaccacatggatacagaaactgtctccagttgcataactcaggaaaataaccccgacagctagccaactaaaaatgtgacctggaaagggtctggccaggccagaatggagcaagcatccccccacaaggccagccaactctcacctgacattctcactgggcccctccacagcctgggctagaggtgtgccctggaatgctgtggcatgcaggtagttaaagaccacatctcgcatagatgcatcattctcctgcatctcccgcaggatcacatcacgttccttctcaatctgtgagtcttccagactacagttctgcacaatgtcacccaggagctccacagctagatgcaaggaggacatgtttaggtgccaggtggaccactgcagaccaacgacagcacaaaatccccaggcctggcatctcctgctgcccacccctagttgcccagctgcaaagccatacgctaagggtaatatgattctgtggtcagccaggggctcctaggtagctgtcctctgcttccctgccctctgtccccgcctcttcctccaggtgttacctttcggcagatccttggacagcgccttgatgtagtaagctgtgtgctcccgggtgctgtaggcattaagatgggcccccatgctctccacctccttctccagggcactgccaggccgattctttgttccctggaaccagatatcaaccagaacaatcaggagctacacaggaacccaagaaccctgtcctcagaggctaaacacccagcaggaccactggtccacaggtacctccctcagcatagactctggggacacagatcccagagtctgtttaccaagcactaagcaggccttgaggtgaccaaaaccatggcatcatgcgccaacagaacagagatagccagggccaggactgaagggcatggccagagcaagtgttgcctaaagctcctgtaacagcttaccaacaagctgtggggatcattaccagtacacctcccccctccttattgacagccatggtcaggtaagcccacacctgtgttcaagtgatagaacccactcctcccatgccattcccatgactgtatgtttgtgaatacatgctagtggcctctgtgggacccaatcctagtcctgtgtgtggagaacagtggtgctatctcttggtgtgcacacacacgttaattctgcacacatacctgtgacattgcagctggctaggttgcctactatggctccatggccctgcccaccccataatccttctccatgtttttcattcctttaaaaaacatgggtctttacaaccaagggatgcctagatattccaccagagaagaacatttcataagcaagcatgcatgcccatgtctgtgggtttgttaaaatgcatgtgcatatctacgtgtgttccacaggcctggcttctctggtgaaaagtggggctcctatggttccttgggtcctcttggctctgagggcctcaggcaggggctcatcagatacgtgcccactcaggagaggttaagctcatgtggctccttttaggaaagccagccagacatcagccccgcaactgaggcccataatcaggctaatttttctgaccttcatcctcaggagggacaacaggcagccctaagcccagaggagacagactttaagagcctcaccttgaaagccagatgctccaaaaagtagcctgccccattattcttctcagtctcaaaacggctgccaacatcaatccacactcccacctggtcaagaagccaccagaaaaggttacaaacaaaccactccccagccccctactcacaccccacctgagtgactcagtacaagccccaggcagggacttatgaatcctggagtcagggagagctgccccagcaggacccctgtgcttggggacacagtcatgcttggaaaacaggggcagccgaatgactcgtcacaccacatcattgctctcctgattggctatcaaggacccacagggacacttctaactgtgcacatttacctggtctcaccagcatacaaatccttaaattcactctcaattttcagttaattatttgtttttgtctaagcatacaacatatcatttgcaaataacaacttattttttcctttctaaaaattacacgctgcctttgttctggcaatgattttatcctttcatcattaaggaagggactattggtttagactgtatattttatcacactaaatattgttcctataatatcttttttgttgttgtttttaatcagctctgaacaccaaacagtgttgccttggcacccaataaggtaatattaattttcttgacagcctcctggttgctgtgaaacacgcaccacaggctgggcgcggtggcttatacctgtaatcccagcactttgggaggccaaggcaggtggattacgaggtcagcagttcgagaccagcctggccaatatagtgaaaccctgtctctactaaaaatacaaaaattagccaggtgtggtggcacgtgcctgtagtcctagctacttgggaggctgaggcagaattgcttgaacccaagaggcagaggatgtagtgagccaagatcgtgccactgcactccagcctgggtgacagagagactccatctcaaaaaaaaaaaaaaaatgtaaaagaaacacgtaccactcaccccacttggtcacacggtctagtcttttaatttactatttgttcacagctgatttaagtttttcacatctactttcctaagtacttttttttttttttgacatggagtctcactctgtcacgagacgagtgcagtggtgtgatgtcggctcactcaacctctgcttcctgggttcaagtgattctcccgcctcagcctcccgagtagctggaactacaggcgtgcaccaccacgcccagctaatttttgtttttttgtgtgtgtgtgttttttttttgagacggagtctcgctctgtcacccaggctggagtgcagtggtgcgatcttggctcactgcaagctctgcctcccaggttcatggcattctcctgcctcagcctcccgagtagctggaactacaggcgcccgccaccacgcccggctaattttttgtatttttagtagagacggggtttcaccgtgttagccaggatggtctcaatctcctgaccttgtgattcgcccgcctcggcctcccaaagtgctgggattacaggcgtgagccaccgcgtctagcctaatttttgtatttttagtagaggcggggtttcaccatgttggccaggatggtctcaatctcttgacctcgtgatccgcctgcctcggtctcccaaagtgctgggattataggcatgagccactgcgcccagccaagacttttttttattgtataaatttatggggtacaagcacaatttttagaaatttctatccacacctgaaactccatttttttctttttttttttttttaagacagagggccttgctctgtcacccaggccagagtacagtgacataatcatggctcactgcaacctcttattcctgggctcaatcgatcctcctgctttggcctctcaaagccctggaattactggtgtaagccactgtgccccgcccacaagtgtgatgtcattacaggcacagaatgcacaagtagtcaaatcagggattctgaattatccatcaccagaataacaaaccttgtacccattaagtaatttctttttttttttttgagatggactctcgctctctcacccaggctggagtgcagtggctccatctcggctcactgcaatctctgcctcccgggttcaagcgattctcttgcctcagtctccccaggagctgggattacaggcgtgtgccatgcatggctaatttttgtatttttagtagagatggggcttcactatgtttgccaggctggtcttgaactcctggcctcagctgatccgcctgccttggtctcccaaagtgctgagattacaggtgtgagcctccaggcctggacccattaagtagtttctcatcatccaccccttcatccttccaagtcttcactgtccatcattccactctctacatctgtatgtacgtattttttagctcccactgataagtgagaacatgtgatatttgctttcctaagagatgtcaatgcatataccatatatcacacaatcttagatgaacatgtatttcacatctaacatcttggaatgcaagaggcattttacaatctatagtatcctttgattaaaattggcaagattcttgagattctttctctggcactggagcacagacagctccttacaatctagcacattttagagttcatgtaatatagcattctttactataacaagtgacatataacaaggaagttgcaggccaccttttcctatgcttagtaacaatttaaatcgcaggacattgtttctggaaaactaaaaggatgtgtcaataaaaacatctggccctggggctgggggctgaaaggaggaggagataattatttcttgggaatcttctcacctattcatatatctatctgtgactcaagatttcttgtgtcaatttagagaatttgtattttttggaaaatcacacatttcattgtactgttaaaatgcatttgcttcctaaaatgtatttctggtctagcctggagattatgaccttgggcagtgaggctgacagacctggacccctgcaagtcacctaaggtgtctgaatcccattttccgcattataagaggagacatgatcacttcccttatatgggctccttaacaaaaggctggaaaagaatttggccgcctacttaacgggcattatatgctaaataatgttggcttatagtgaagattgtcccgtgaagccaaggcgtggctagggtagggaatggggccattctcggggtgagtggtcctgggtccgaacccaaaccacaaacgggaagactcgagcccaaggtcacaccccaaccagggaaaagacggcaggcccaacctggaggccctctccccaaaagcgtccccaactcaccgtgcaagtgggctgagaggactgctcggaggccacacgcaggccgttgtccagcaggctaacctgcgtctccggcacgaactggagcgcctgagcgaaggttgccgtactccgcaaggctggcgtccgcagcagggccggctgtggaagggaacagccgcgagtgaggactcggtcaggggatcgctccccacctcccaggtcctcaggaggacccccgaaccccgcccctaggcaagcggcgagatacctttccccgccctccgccgtgaccttcccacggccctgaccccgcgtcctccccacctcgacctgccactgctaacagcccacacctgtccgcttcccgaagccctgtcccgaagccccgcgctctcgccaccacctcaccgagcggcgggcgcgcaatagcacttgtgccccggcggtagcggcccgacagaccacggacgccgccatcttccagctgcagtcggccctgttgcgccgcgcaagcgtagactgggcgcgttggcggtcgcggcgcaggcgcagtaccgtacagttggtgctcggccgcctcctggcgggaaccgggacagtctattgtgctggcctggctttggctgactggctctgaccgcgctgccgccagtccctgcgcacatcagtccacctgccgtccatcagcccgagcaggtccgcccgccgtgcagtccatctccccattccacgcgtggaagtcagagtgcattatgtttctcaccagccgcgctgcgtactgaggtctggcgggcggggagttgcagccacagcgtgtccgcaggttcgagcccagggctaaagtaccagcgtggaaacttacctgggaccacaagttggtgctgaaagtcagtatttttttctctttatttattttttattttctgagacagggtctcgctctgtcgcccaggctggagtgcaatggcgcgatctcggctcactgcaacctccgcctcccggcttcaagcgattctcctgcctcagcctcccgagtagctgggattatgcccggtaatttttgtttctttagaagagacaaggtttctccatgttggccagttttgcgccctgccagttttctctttaaaagaactaagtacaggccgggagcggtggctcactcctgtaatcccaacactttgggaggccgaggcaggtggatcacttgaggcgaggagtccaagaccagcctggccaacatggtgaaacctttccttttctgtaagaggaaaaagaattctggctgggtgcagtggctcatgcctgtaatcccagcactttggaaggccgaggtgggcggatcacctgaggtcgggaatttgagaccagcctgaccgacatggagaaaccccgtctctactaaaaatacaaaagtagacgggcgtggtggcgcatgcctgtaatcctagctactccagaggctgaggcaggagaatcacttgaacccgggaggcggaggttgcggtgagccgagatcgcgccatttccagcctgggcaacaagagcgaaactccgtctcaaaaaaaaaaaaaaaaaaaaaaaaagacttctaaggtatgctttgttatgtcaactaaagaaaaaaaaaaacaagcttttaaatatttaaagttagttctattcagaagtcttaccaagaattgcaacccgggagagcctttcagggagtttctgctagactgctccaaagcagtgtttccgacagtttatacactggtggtggcggctctccatgtgctcagaaattacatcaaatgtgctcagaagttacattagagcataaatctcatcaaggtttgggtgcaagagtacatctgtttataggtcacagaagcataatcattaatcctgtcagacagtatcttaagtacaggaagaggcaagggctaggatcattgcattttttaccatgttggccaggctgatatcaaactcctggcctcaagcaatccacccacctcagcctcccaaagtgctaggattacaggggtgagccaccacaccttacccaaaaactactcttatacttaaaataaaactatctttataaaaatcatgccagatgccatgaccacaggctctcacaccacacccagctaatttttttttattttttgtggagacgggggtctcattatgttgcccaggctgatcttaaactcctgagctcaagtgatcctcctacctcagcctcccaaagtgctgggattacagtcatgagccaccgtgccaggctgactttatttcttataaagggttacaacctgcaggctgggaggtgggcttctggtcaaaaccagagacagacccttaaaaagaggcaggagctttatgtcgaatggcttggctaaacatacatattcggccgggcacggtggctcacacctgtaatcccaaactttgggaggccgaggtgggcggatcacaaggtcaggagattgagaccatcctggctaacatggtgaaaccccgtctctactaaaaatacaaaaaatctgccaggcatgatggcatgtgcctataatcccagctactcgggaagctgaggcagaagaatcgcttgaacctgggaggcggaggttgcagtgagccgagatcgcgccactgcactccagcctgggtgacagagcgagactctgtctcaaaaaagaaaaaacaaaaacaaaaaataccatattcaacaggttacaggaagagctatagatactcatgaagggggtcctaatgcaagtatactgaataaacatgtgtgttgtatatgacccatgttcactttggggtggagacttaacattgaaatacattacaggccgggtgcggtggctcacgcctataatctcagcactttgggaagccgaggtgggtggctcacgaggtcagaagatcaagaccatcctggccaacacagtaaaaccccgtctctactaaaaatacaaaaattagctgggcgtggtggcgtatgcctgtagtcccagctactcaggagggtgaggaaggagaatcacttgaaaccgggaagcggaggttgcagtgagccaagatcgcaccactgcactccagcctgggctacagagggagactccatctcaaaaaaaaaaaaaaaaaagaaaagaaatacaattagcaccatatgtcaaaatgaaggatacaaaagcactcagtgcacaggttccataaaccaactgaagccagtccctggtcagtggtctcttattaggaaaaagtcaccaaaatccatctcttgtgcaatcaaagctatagttatggcttgtggggtcagtgtctggtgatggatgaactgcaattgtttctatattgcttatctcaaggccagtgcttgtttagctgctggagaaaaagaaaaaccttgcagcagttagaacatagtttattctttggtgaacggcttaactcttgcctggcatggccttaatgtcttgtttatactttggtatcttattgctacaaagggttcattctctcagtcttatgatctctatttttttctttcttttttgagacagagtctcattctgtcacccaggctggagtgcagtggcaggatctctgctcactgcaacctccatctcccaggttcaagcaattctcctgcctcggcctcccgagtagctggaactgcaggcacatgccaacatcgctaatttttgacagagtctcattctgtcacccaggctgaagtgcagtggcgtgatcttggctcactgcaacctcagcctcctggattcaagcaattctcctgcctcagccttccaagtagctgggacgccacacgccaccatgccctggctcaagtgatccttctacctcaggctcctgagtagctgggaacacaggtgcacaccatcatacccagctaacttttatattttttgtagagacaggatttcactatgtggcccaggctggtctcaaactccaggctcaagtgagcctcctgccttggcctcccaaagtgctgggactacagatgtgagccaccgcccctggacgtgatctcttttttttttttttttgagatggagtctcgctctgttgccaggctggagtgcagtggcatgatcttggctcactgcaacatccgcctcctgggttcaagcgattctcctgcctcaggctcccaagtagctgggactaaggcatgtgccaccacacccagctaatttttgtagttttagtagagatgggatttcaccatgttggccaggatggtctcgatctcttgacctcgtgatctgccaaagtgctgggattacaggcatgagctaccacgcccgaccttttttatttttgagaccgagtttcgctcttgttgcccaggttggagtgcaatggcgcaatcttatcagcaacctctgcctcccgggttcaagcgatgctcatgcctcagtctcccgagtagctgggactacaggcatgtgccatcacgcctagctaattttgtatttttagtagagatggggtttctccatgttagtcaggctggtctcaaactcccaacctcaggtgatccacccaccttggcctcccaaagtgctgggattacaggtgtgagccaccgcacccggcctgcctgcttcctttccttccttccttccttccctccctccttcctttccttccttccttcctcccttcctttctctctctttcttttttttttttgagagggtctggctttctgtcactcaggctggaatgcagtggtgtgatcatggctcactgcagcctcaaccttccagctcaagccatcttcccactccagcctcctgagtagctggaactatataggcatgcaccatcacacccagctaatttttaaaaacatttttctagagatggggtctcactatattccccagtctggtcttgaactcctaggctcaagtgatcctcccacctcagcctcccaaatgaaatattcctaaacccagtcacctagcctccctacctatacccactgctaccctgggctaagaagggaaggccattgaagtaggagacaactaggaagtctgatgctggttgggaacgatgcgtttcaaggggttggtcaaaacaggaaatattactaaaaggttaagtgcaagcagtgatcattgcaataattttgcaacagtgtttggtgactcattgattctctggaatttacttggtatatagagtgaggtaaggtcaaaatatcctctctccccctaaaaggcaaactaaattttgtaacaccgtttcttgatgaggccctgtttccctacccatctctgttgttccctctatcatcccatagattctcaaacttgtaccaggtccatgcaggctgtgttctgtagggagggctctggcactcaacttacccttcttactctgtttgatacattcacctatttattcttctagatgtttctttttattttttaaatttacttttaatttttttaaatagagatgggattttgccacattacccagcttggtctcgaactcctgggctcaagtgattctcctgccttggtctcacaaagtgctgggattacaggcatgagccactgcacgcagctttttttttttttttttttttgagacggagtttgctcttgttgctcaggttggatggagtgcagtggtgtgatctaggctcactgcaacctccacctcctggttcaagcaagtctcatgcctcagcctcccaagtagctgggattacaggggcctgtctccatgcacagatagtttttgtatttttagtagagacaaggtttcaccatcttgaccaggctggtctcgaactcctgacctcaggtgatccgcccacctcagcctcccaaagtcctgggattacaggcgtgagccaccacgcctgcctgttctattcattattgaaagtggggggttgaaatatgaactataattgtagagctgactactttcaattctgataatttttgtttcattatttttggggctccgttaggcacataaatgtttctaattgtcatattgccttgttttgaaacttttattaggtgggtggatcacctcaggtcaggagttcaagaccagcctgaccaacatggataaaccccgtctctactaaaaatacaaaattagtagggcatggtggcgcatgcctgtaatcccagctactcaggaggctgaggcaggagaattgcttgaacccgggaggcagaggctgtggtgagccaagatcatgccattgcactccagcctgggcaacaagagcgaaactctgtctcaaaaaaaaaaaaaggctgggcgcagtggcttacgcctgtaatcccagcactttgggaggccaaggcaggaagatcacgaggtcaggagacagagaccatcctggctaacacagtgaaaccccgtctctactaaaaatacaaaaaaaatgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaagtacaaaaaaaattagctgggtatggtggcagacacctgtagtcccggctactcaggaagccgaggctggagaatggcatgaacccaggaggcagaggttgcagtgagccgagattgcgccactgcactcctgcctaggcgacaaagtgagactccgtctcaaaaaaaaaaagcaatttttatcaatagataacgtccttctttgtctcttgtaatctttttgatttagaggctactatacctgacaataataaagccaccttgactctcttctggttgctatttgcatgaagtatttttttttctttttctttttctttttttctttcttgaaacagagtctcactctgttgccccaggctagagtgcagtggtgtgatcatgactcactgcagctttgaccttcctgagatcaggtgatcctcccacctcagcctccggggtagctgggactaaaggtgcacaccaccatgcccagctaattttttgtgttttttgtagaaatggggttttgccttgttgcccaggctggtctcaaactctttaagcaatccacctgcctcagcctcccaaagtgctgggattacaggtgtaagccaccatgccaggccataaaatatttcttccatccttttacttctggtgtttttatgttcttatatctgaagtgagtctctgatagacaacatatagattaaccttttttaaaaaaccaatctgaaaattcatttattaataggagagtttaatctatttatatttaatgagattactgacaaatgatttgctttcaggttcagaatttgtttggtccctttaaaatttttctctgtattaattttttttttttttttttttttgagacagagtcttgctctttcacccaggccacagtgcagtggcactcttggctcgctgcaagctctgcctccccagttcatgccattctcctgcctcagcctcccgagtagctgggactacaggtgcccaccactgtgcccggctaattttttgtatttttagtagagatggggtttcactgtgttagccaggatggtcttgatctcctgacctcgtgatccacccacctaggcctcccaaagtgctgggattacaggcatgagccaccgcgcccggccctctttattagtattctttatgttcagacataattttcctaatttcctttagttctttgtccatggcttcccttagttcattgaacatactaagacagttgatttattgtttttgattaataattccaatgcctgggcttcctgagggatacttcccatcacaatctctttttcagccaggtgcagtggctcatgcctatgatctcagaactttgggaggctgaggtgggagagtcatttgagttcaggagtttgagaccagggcaacatagtgagaccctgtctctcttttgactccagcccacttcccctcacttggaggacatcagagaggctgtggcattttcggggtccagccaaagggaaggtgggttgaagatggtcccaggttgggttctctaggaatccaactccaagaggaagatcagagcacaagatatttacaagagtcccttgagatgagcacctcagggaaggagggaaagggttgggcaaggaagaagtctggctataggggctctgccacagccagagtggacctgtctgctggccgtcccctgagtggctggcagcagctggcctttgtgtggcatatctctgagtctaccacagggacacactgggtgttataagtaaaatgtttattcagaaacagaatgctgttcttcagtaccgcaaggaaaaattagcattgagacaaaaagttttctcagcaaggcaaatttactttctgcagaaagggtgctccttgcagatgaaacaatggtgagagcacacttgaacaaaggagggaagcaatttttattctttatgcagcttgtccttgctactgtgtcctgcctccattggctggagacggactgcacaatctaagctaaacttgaccggctaataacttaaaattttcttaaataggtaaaggcaagggagaacaaaggaaaagaggaaattgcttacgaaaggacttagaaggacttagaaaagtaataacatttctttttttcttttttttcttttttgagatggagtcttgctctgtcgcccaggctggagtgcaatggcatgatctcggctcactgcaagctctgccatgggttcacgccattcttctgcctcagcttccggagtagctgggactacaggcacccaccaccatgcctggctaatcttttttgcatttttggtagaggcggggtttcactgtgttaaccaggatggtcttgatctcctgacctcatgatctgcccgcctcagcctcccaaagtgctgggataacaggcgtgagtcactgcacccagccaaaagtaataacatttcgaaataaggaaggcacataggctgcaagctggaatgtgcctgtgagcatgtccagcacaaatattttggttaaagtacaaggacacagaatgtacttatttctttatatctaacagctacataagatagggcttaacaaagagttattagcacaaagtgaggaggcttaaaggaagttagtctttaaaagaaactattatttgtaacacttataatttattctttaacaagaagggaaactttgaagaggaacttttttttttttactttctacaccaggttaagagggacatatttatgtggtttgctccacccttgtgtaaagttagtttattggtcttgttctagaataaactaggaatgtggctcgtaggaaaatcctgctgggtaaggacagaagtgcaaagtcctattgccttaaggacatgccccacggcacccagtgctgggaaaactgtgagccatggaaggaaaacaaggtttgaaatgcgtggagccagaacctcgtctgtggaaaattcttccaaatttcatagttcctatatgaaagaaggctgatgacagtttctcaaattttacaacaatccagaacatttgtatggcaccgtcaacaacagattaggaagtttaactttcctaaactaccaataattaaaacacaaatttcaaccatgttaggaggaagactgaagtatcttttctctgtatggaaaatatctcccccaaaaatcacaaaatccttgtcctctgtagaggccttcagagtaagaagccagaccatgtaggggaccaaggtattagaaatatgtcaggaagttgccacaagttatgttatttttctggatttagtattgtagtatttgtcaatttaaaaaaaaagttttcaaaaaaaagtatcatcatttcttttctcattattttaattcacttccatttttgaattcataacgttgttgcctttttctaaagcaggaacctgggacaggcactgtggctcatacctgtcatcccagcactttgagaggcagaggcaagaggatcagttgaagccagcctgggcaagatagactccatctctacaaatatatatatattttttaattagctgggtatggtgatgtatgcctatagtctcagctacttgggaggccaaggcaggaggattgcttgagttcgtcaaaaaaacaaaaagaaacaatttttaaaaaggggaaaaagaaagagaaagggattaaagtgagggtcccttcttttccagggtccttagagcaagggcggctgaggcactagagcatgtttgagactgccatagaaacaaaggcagctagggcggcctgcctgaccccaggttggggctgctggagccaagaatctggggaggggctgttattggagacagagcagtggcctctcaagggagggccttgcagggcctgggaagaaggaagccagagccagctgctgtttgatggcaggactaaagtcacctccctgaggtggtgacaaggatgggtgaagccaaagggtgtgcgactccacagtgatgggggcttggggctctcagtcccccatcagagatcctcagcatctggttccagcttcaccactgcccccacccctcttctcagctgaccaggtccctcctcagctcaccctgtgcactggagaggcccagtaccctcactcagcacttgaggccctttatcatgtgcactgcccaccttgcccatgtgcagagagtaccaaacacagcacgtggcttttgctcagaaccagaccgccacctggatttcccttcctcacacccatttcccctcagggctcagccaggttgttggctcctctgggcaacccttcctgagccacccaagcctgtcccgttggtaagtcctctcccatcacacagggagtccccaggtactggtcaggccagaggagcagtttttgtttgttttgagacaagttcttgctctgtcacccaggctggagtacagtggcacaatcttggctcactgcaaccactgcctgccaggctcaagccatcctcccacctcagcttcctgagtagttggtactacaggcacacaccactatgtgtgtgctcagctaatttttgtttgtttgtttgtatttttcgtagggatggggttgccatgttgcccaggctggtctcgaactcttgagctcaaatgatcctcccacctcggcctctcaaagcgctgggattacgggtgtgagccaccacgcccagcccagaggagcagttgtgtctccaggagggatccttagggaggaaaggtcagttggtgggggcaatggagcagtgtgagccagcctatgccccacctgcccgcccgtcctggacaccaagtcagctgactctaaaagctgaaaagggacacacggtccagacaggcctggaaagagcagacctggcccaggacctcaggctgtcaggcaaagagaggcacatgttcggtcacccactctgggtggaagtcccctttatttggatttgccgctgggtggctagatgacgtaggtggccttcgatgtggaccaggagggcatccagcatgtgcaggaccccacggagcagggtgtggtctgagattggggcccgccgtttccagggtccgcagggctcagtggtcacctgcggatgctgagaccaggaccaagaggcaggagtgagaatggtgggcagagagggagatgtgacaaggggcagtgatggagctggggagcagggagtagggtgtggggcagtgcccagatgggatgggagggagactcagggtgatagaggatcaccgagggtctgttgtgggctacagtggtcatggggcccacaggggctggatgagagcaggggtactaaaggggagagttgggggcagggtgctggctgtgggtggtggacatgggttccacgaaggtgtgtggacacagggacaatgggctgtgagctgggggtgggggtgtgggaggtccacaggccagtgtggacccatggggcagggttgggtggaagacgggctcactgagcgtacgtatattgaggcaggggctgtgggggagaaagaagagctgtgctcacctcacccttggtggcctgtgagcgccgccgcccctgcagtatcttgcggcagatcatcagcatcgtggtggtgatcatgaccgcagccacggggtagatgcggcttgctccagggcccagccagtagccaggacagctcaggccacccctacagccctccacactctttggctgacacccccagggctgcaagtccagccccacctggtaccagaggggtctcgaccaggcgtgggtggaggcagacgtcaccagcaggagcagcaaaggcagcgaggccagcacatgcagcatggccgtcgctagtgccagggccggaacccgggcacctggcaacgggcaaacgcccctcccccgggaagaggcctggctctaaggcagcaggttccagccaggcccatggcctttcatgagcagcctggccagaaactggctgtggtcagggggctggagtccagggcttgaggacaacggcagacctgggttctgggtcctgctgtcccagcgggcctagctggccccaaactgagggagcacctccttttgaagctgggccctaggctgggtgtagtggcacacacctggaatcccagcactttgggaggttgaggcaggtggatggcttgagcccagaagtttgagaccagcctgggcatcacggcaaaaccccatctccataaaaaatacaaataattagctgggtatagtggcacatgcctgttgtcccagctacccaggaggctgaagtgggaggatcacctaagcctgggaggtcaagactgcaatgagctgtgattgcaccactgcactccagcctgggcaacagagtgagattttttctcaaaaaagataaaaaaagaaactaagtcccaaacagttaaagaaaccagtaactaacagaaattctttttttttttttgagacagagtcttgctctgtcgcccaggctggagtgcagtggcacgatctccgctcaccgcaagctctgcctcccgggttcacgccattctcctgcctcagcctcctgagtagctgggactacaggcgcccgccacctcgcccggctaattttttgtatttttagtagagacggggtttcaccgtgttagccaggatggtctcaatcttctgacctcgtgatccacctgcctcggcctcccaaagtgctgggattacaggcgtgagccaccgcacccgaccttacaaactttttttttttttttaactaggctgggcaccatggctcaggcctgtaatcccagcactttgggaggccaaggcagatggatcacccgaggtcgggggctcgagaccagcctgaccaacatggagacctgcctctactaaaatagccaggcgtggtggttcatgcctgtaatcccagctactcagcaggccgaggcaggggaatcacttgaacctggaaggtggaggttgtggtgagccgagatcgcgccattgcattccagcctgggcaacaacagcaaaactccatctcaaaaaaaagaaaaaggccggctgtggtggctcacacttgtaatcccagcacttcaggaagctgaggtgggtggatcacgacatcaggaaattgagaccatcctggctaacatggtgaaaccccgtctctactaaaaatacaaaaaaaaaaaaaaattagctgggcgtgctggcacacccctgtagtcccagctacttgggaagctgaggcaggagaatcacttaaacccgggaggcagagtttgcagtgagttgagatcatgtcactgcactctggcctgggcgacagagcgagactccatctcaaaatacaaacaaacaaaaactagctggggctgggtgcggtggctcacccctgtaatcccaacactttgggaggccaaggcaggaggatcacttgaggtcaggagttcaaaaccagcctggccaatatggtgaaacttcgtctctacaaaaatacaaaaattagctggacatgatggtgggtgcctgtaatcccagctattcaggaggctgaggtgggagaatcacttggacccaggaggtggaggttgcagtgagccaagatcgtaccattgcactccagcctgggcgacagagcgagactccgtcttgggtggggggaggtgggggaactagctgggtgtggtggcatgtacctgtagtcccagctacttaggaggctgaggcaggaagatcgcttgagcccaggaggtcaatgctgtagtgagtggtgatcacagcactgcactccagcccggggaacagagcaagagccgatttaaaaagaaaaaaaaaaaaaatccacacggcccctaaaaccttttgctttccaccaggggcatcacctctctaggctgaccaaactcgcaggtcccccacacccaaccgcagccccacagtccacatcgcagttgggtgagtgctcaaagatgtgggatcaaaatccacaggcagctcccccgctgtcagaacaaagcccaaagtctccccctggactgtgaggtccccccaccctctcacctcagctcatgctgcccctgcctcccacaggcctgcctcaatacccccactgccagcaccacagctccccaggcctagaaagtcaccttctttcttatggctggaatttcagttccagggtcacctgctgagtccccctcccatgagcatcttgggtaacatatgacctcttctatcacgtgaccctgctttattttcttcaaagcatttctaactacctgcaatttcctgtttgaggtctaaactgccctctccaacatataagcttcattcaaacaatatttactgagcagctgccaggcaccatttctgatgctaggacgtggtgtgacagagtaaataaaagctcttatttcctggggctgaacttctaggccatgagttggggggtggggggtgatggtgccaggcaccaatacagaccatgataaaacagagccaggcaagggtacctctgcgatttgaagggcagggtggcctctgtccatgctcaggatggtgcccagacccctgcacagagcctggcacctgctcagcacctgatgaacagcagtgctcgcatgtttggaggagaggacctgagcccagcattgttttcgcatttcctggcatttcctcatttatttttgagacagggtcttgctctgtcacacgagctggagtgcagctccctccagcatgatttcagctcactgcaacctccgcctcttgggttcaattgatcctcccacctcagccttcccagtagctgggattacaggcgtccagcaccatgcccagctcatttttgtatttttagtagagatggggtttcacctgcctcgggcctcccaaagtgctgggattataggcccggcatctactcatttaatattcactgagcaacccctgaagcaagaattgtagccactcacgctctaccgatgaacagcacactgaggcccagacagatcctaagacccggtccctcccctgccatcactgtcagctgacccaacgccccactgcctgctgggtcacatgcccagatgtcggcatttaatggcagaaatcaacacacactccttggctgacagtgttctaccatgcccaggtgatctgtcacccatgcggggcatgatctgggctcattgcaacctctgcctcccaagttcaagcgattctcatgcctcagcttcccgagtagctgggattacaggcatgtatcaccacgcccgactaacttttgtatttttagtagaggtgggatttcaccatgttggccaggatgttcttgaactcctgatgtcaagtgatccacctgcctctgcttcccaaagtgctgggattacaggtgtgaaccaccgtgcccggcccggtcatgcttattcttaagcatagagcagcagtgtgggggaacagctgctcctaggtgttcactctgtatcctccagggactgcccattggcacccacgctgccctgtaccttctcgggtattcctgagagcaaattattcctgagaagcagctctggttccaactgtttcacatctgaggagacagcgagtgagggctatgcatggctggggagagaccttaacaggggatgcctccacagctcccctgctctgtaccctaacctcccgagtccttcctacaccttctgccccgtctcaccttcagggcacaggaagggtcagcagccacagctgtggaccacccaccaccagggccccaccaagccacagcagagactggagttgagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcacctccagaggtgcagtcttgggcaggatgtagcatgttcagagtctggtgacctgagcaggcagaggaggggaggctctagtcagtttccaaaggacacagaccaacccccgcccctagaacagctttatccaaagacagcggagaaagcactgggcccactggggacagagccatggccaccaggaaagactccctggagctggggccagggtggggacaagcaatagattaacaaaaaagagcttggcaggccagaggtaggctcaccgaaacagggctgtcggggacaggcctcgggtgttggagggcaaaggtgacagcatcatggacagaggcaaagagatgcttcttggtgatggatgcatcgaagaagtgcccagcctcaagctggctgaccacagggcctgtgggcaagaagtaggcctcccctgactctcagaacctctaggaactcaactcccgggagccaacagaatgccctgacctcatcacccctgacctccacccctgaggctacagctgaatccacatcacttgtaaccctggactcctgtctcccaggacacctctgacctccagttccagagaaagactttttccttgtgctacttggaaaaccccttggccaaaagtatcctaccctcttcccaggtccctcctgctgttcccaccctactcactgtggcaggccgccatgtacacctccacctcaatctcccggaagtcatggaaaatctgtagcggaaaagggggccagcctcagagggaggctcagggactcagaggggggctcgggcaggcttggggagggagtttagaaggggagctttgagggtttggggagtcagaggctgggagtgctctcagggcaaattacagggtcagtgtggaagctcgaggggccttggcctgcccccgtccttacattcttcaggctcttgaggcacacagtgtccacaaaggagagggcacccaggtccaggatgaggctgtggaagtctggctgaggcaggcccagggccttcagtgtggacccatctggggccttggagtcttcttgaccattggctgttgcatcttccatcttatctcctgagctcacctgctggggagccagacatgctgccagggccacccatgagagagtgaaggcaggactggccgcacacagacacgcgagaacacgcaaggtcagatggggagcatgcatgggacacataaggacacaaacatgcgggagtcacataggtgtgcaaagacaggaatgacagatgtgtggggacatgcaggagggcacacccagatgtgcatatactgctctgctacctcctgggccgacgctgcacagggacacgagaagggagtccctgtcccattctcatcagccagggctgagtggggagggggcccaggagcaggccagaatagacacgggcatccacatgaaacgcatgcagacacctcggcaccctgccctgtctcagtctctaattaagtttggcatcctctttgacccctcaattttttttttagagacggggtctcgcttcattgcccaggctgaatgcagtggttattcacaggcaccattagagcgcactgcagccccgagctcctgggctcaaatgattttcccgccttagcctcccgaagagctgggactacaggcgcgtaccaccacgcctgcctttgaccccttgattttctcccatataccccatccctttcctctacccatgagcagactctgggggaagtcttgtgggatctacaaattcaaggtcttcatctaggcctgagaatctaagcctagattctgtggcatatcacgacgctccctgaagaatatctgacccagcctccccactcctcctgccatcggcgcaacaccctcgagcccacagctgctgggtccatggcattcctcatgagacatgtggatcctgcatctctgcagctcacagctgtcacctcctttcccacctccagtctcaccatcatcttgcagtcctcaacgttgttgctcctcatgtcttcaaggctggtgttgacattaatggaaactgaggcgcccttgggggaggcagcctacaccagggaagacagggaatgggaaacagctagcccggctgccatgacagccatgtcacataggcctggtgatgccccctggtgctgggcaggtgggtgggccaggaccagaagctgtgggacctgcagcagccaggctgaagctcctggaacagccgtgaaagggaagaggactgtgacggttctcactgtcactggttcagatgatgggagagaaaatgctgcctagagcccggacctgctaggggagtgaagcagggtccctgggagcatgagggagaaaggggaagggatgaggagtgaggacgagggaggagtcgggggccaggagaaaggctggggcagggaacagggggcaggagatgggggtcaccagacaaaaggggccctgcctgtttccgaagcttctcctctttctgcagttgcttcagcttcagctgctcctgcttcttgagcagtttcttcttctgggagatgaggaagtcgacatccacaccacactggaggcaaacatcagagaagggttggtgagctctctgggagctggggcctgacacccatcctggggactccgtctcaccctctgcttcagcgcatcactgtagaactcagcattggcaaagtacacggtggccgaggagcggaagaccttcaccccccggacttccttggcctggggatgaggcagaactggtggtggctgaatctcctctctcctggctgcatcctgttctcctgcctttccttccctagtgtgcccagtgcctgccaccgcccagccctctgctccccaggctgcagtccaggccctcccaggggcttaggccacaagcccgacggtgtcatccccatccccccacagtgcctctccctccccacctctcctgccaccacccaggcaggcttcacaggctcttaacctttctcttgggtttccaacccctgccttgtgttctgttttctgcacccagacagaggtcctcctaggctgtcatatcaatcagaccttccccgctcccaccccattcgggtcacagcccgggtctctgctgggctccaggcatgcatggtaagggctgggctgccccctcatcctctcccatgtctcagaccccttaattcctccccgcactgcctaattgcactgtgcccatgttgcaggcaacagccttgttttattccagagccccccacctatgttcctagcacttggcccaagacctctcaggagataaatggatgactgaggacttagtaaccccactgatcagatcaggaaatgcctcccttccaacctggcgccccagggagctgccattccggctctctgacccacggctgctctgcaggtggagcttgtgctgttgactccacgacagacccctccccagccccagacccatctctgtccactctccctctgtcccttcatacctctagagggggtcatagacctaaactcctcccttgaaatcccaaagaccaaagccaaagtatcctcagcccccagttccctggccaagtgtggaacgaatccacaaaggctcattcttcctccgtctccccatccacaccatctcactcagcccctgacactcacctctgagtactctgccacatctctgtaaatatccgtgtctggcacctgccccaggacagagtagtggggcctgtgaaggagagagagaatgcacgaagagggggcagaaaaaggggataacagaggggtccgaaggagcctgaagtccccagagatgtggggaaagctgcggggagccctgtggtactctctcactagctggaatgaggggaccaacatggcggactcacatctgtgtccggaccaccacgagcagcagggagaagatgaccgcaaccaccaagccaaggtccaggttcagcaagatggtggccgtgaaggtcaccagccagataagctgagaacagagggcagcggttggagggcggcgaggagccatggggctgcccagtccctgccctgggctcccagtgcactcaccagatccgcccgattggccttccagagggagcgcatgtcgctgagctgcctcagcatgcccttcaggttcacaatgatgatggctgccaggaccgcctggggtggggacagtgccaccaggggccattgagggcacccgatgctgacaaccctcctcaccgaggcaaagccagactaagcccaagcactcaggcagtaccccagacacaaacccccacccagcccctgacccttgtctccaaatctcaccttgaagatctcagccttgaaaaacagaacctaaccttgtgtccccacccctcgcctgaacctagactggctgatttgagagccctggcctggccaagacctgaaacctggctgggtgggggctcaccttgggcaggtcatggaagagttccccaagtttgacaatgatgaggaggatgaaaagggaagagatggctccagcaacctgttcggggagggagtgagcaggggagagacctccttccccaggcaaagcaatgtgcatgcccacacccatgcccacacccaaagcccacctgcgagttgcccccggtgctctcctgtaccaggctccgagacatagagcaactcacggggaagcactggaagatgcctccgataaggttactgaggcccagggccaccagctcctgacgggggacagtacgggtgtgagaagacttcctagaagtggctggtcactgttccactgtatctaggcctgtgcatccccaatctccatccccaccaagtggcccccagagactggatgctgtcccacacgtcctgctctcccaccctcagtcccccacgtggcctcagcacatctgctgtctccctgtgtcccaccggttcctcccccacccgttgctggcgcctccatacacttggatgcctcctacacatcccgcatcacccagacctggttgctgtccacccggtagccgtgcctcagggcgaagatcttccccagtgagatggcaatggcaaacccaaccacagcgatggtgaaggcgctgcccacgagctttgagaacagctgggtgttgggggccactgggggcaccagcctgtgagaggtatctgtgaggccaaagcaaggtcctgtcctggctgcccaaccctccctgacctgatggaggccagagctcaccctgcagggatgttgcccacgacatctacctcaaatctgtgctttagacccatgccataggagatgcctgtggccccgatgagctgtgggagaggacagagtcagggaggcaggtgctggcaccatggtcagggggacacataaaccactgtgaggtgaggagggagatactgggcaaaaccttcttcgagggtgggaaaaagtcacgtagggtgagagacaggcaacaccatttcggctatggggagatgctgtcaggggcaggaagaaaccaacataggggctttctgctgtgccccccacaatacccaagaaccctcccagcccccctccagctggccctcaaatacaggaggctgcccacgtggcaaggacccagcctgacctgcccttctcccctgccctccactccctggccctcgaaccgtgagcagctccccgggtatcggcatgggcagctgctgctgcagcttgtcattcaacagcttcaccaccacgagcaccaccccagccacagctgcagtgaccacggtgccaaccttgctctggggcagcttccagcagacctccagcactgtctgaggagaggccaggtcacagctagcactcaaggccatggggcacacctacccctccctccccctaccctcactcacatagatgagggacagtggcccagagtggctgctcagatggaggccaaacacatacttgagctgtgagacgaagacctgcacagctgcagctgtggtatagcctcggacaagaggttctgacaggtaggtgaccacgaagccgaagtggatcaggcccagccccacctgtggggcggccaggggcagtcaggagaggcaggggtcctggggttgctaatgaggagcgcagggcaagtgggatgggagggggatgagtagacggcaagaggaggacgacgatggtcagacactcaggggagtacagacaggacagtggcgggagcagaagtggtggtggggggcacatactcctgactgttccacacctggaagaggccaaccaggacactgagtgtggaggccacctgtacccgggcagcatctctggctgtctcattgatcatggagtcgttcaaggcctgcggggccagggattctgtcacactgcccaccatcacagacatgacagcaaaggtccctgtaaggacggcacggggcaggtctgaagaggagaggacactgccctgccctggagccctggtcttaagagagaggccaggagacttccagttctggataaatgtactcagattatggctgcatgaacagggacagtgctggcggttcaggtttggccaggccaggagtaaaccctgagctcacaggcccttaagcatggctagaaatgctggccctgtctcatctaccctgtcccacctgtgtctactggtcccgggacacagaggctctctgtggagtagggaaggggtcagggctggccttaggctgctcaggcctctgccaagttccaggccccttgggctgcctcacccactctcatcttcctggagccagggctttgaggtcacctgcctctgtggtcctacagtcaggggtctagtcctgcctggggatgactcgtgggctagcccagggatgcagcaccaatgctgccctcttccccagccgctcctgccctgctcagtgccccctcaccctgccctccatgatggatgtgggcatcctcctggaaggctaggcctgcctccacttacccacggagatgtgccgggaagtgccaaacaggaagtagatgaagacagggtagaaggagctatagaggccaaacacggggggcaatccagccaggagggcgtaggccaagcctaggggtagaatggtagcagtgcaggcctggagagcagatcttgaaacgataagggaatcccagccctgggttaggtgccatagttccaaggtagaggtcatggccccagttttgggcatcacagaccacagggtttccaggccgacgcactgaaggtggctcaccctgcggaagctgcatgatggccacactcaggccggataacaggtcacccaggagccagtcacgcacaggataccggggtaaccagaccaaaaccgggaggtgttggagcagaagggcataggcccgagcacgggagcacctagggacatgatatgaggggtaggtgtcaggaacaggggctacctgggccccgccagcgcccccaggccccaatcttggccttactgcaaccaggtccgccactggtgggtcctaggtgctgagccccagcgccccagctcctccaaatgctcctggttcagcagcggccgttccatgtggtagtctcgcctccgcaggtccattgcttgtgttgcagacagcagtgcctgtgtgtccctcggtctggggtggcaagaccagagagacacagtgaaggcatccctggcccaacctcccctacacctccacctaggaccagagagttacctacctgatttttccaggccctaagatcaaggtacagtattccagcccccagctggcatctgtgggccacatgtccaaactcagacaggggcagtacctgaactttggctggtgagaaagcctctttctaggacaaagtcccccaagtagggactgcaggatgagcactagctatacctccagccgagatgtggcagcccagtgctgagtgttctaccagtccaggtcccaggctgctccctcccccacccagtccctctccagtccccaggtcctcctccagctgccccgggagcccactgctggctgagagcacactcagggaaggggtccagcaaaccaggggtccagctcctcaagcaactcctttcccaagcctcaggcctcagatgagaccctcccctctaagggaaggaaagtgttggagccaagcttgcccctgggcctccagccccagggtccaggttgtagacggctcaggcctgttatggggaagccaaggactggctctcacctgagaaggagcttgctcttggagtggcaatctctcacctagagggagaggctcccacatggaaagggaagtacccacttgaagtgggggaaagagctcacctgggaatagaagctttcaaggggaatctcacctagagggatctctgacctaccagggaatctttatcagcctggcaagttctgatacagggggaatcttccctctgcccagaggcacctacttgaagtcagagaaagatctcacatgggaagaaaagacctagagggagagggttctcacctggggggtactctcccatagagaaagctctgacctcgggcgaggctcccacgtggaatggggaaaagctgtcacctgggaatagatctcacagaaggatcttacctgggggaaaactctagcctgttggggaagctttcaccagtcaggaaagttctgatctaggaaaagccctgacctggggagaggatcccatttgagggacaggaactcacctgggaagcgcctctaacctggctgtactgttggaggagtgtggagtgggtgcaaggaagatcctcagagactcttgggaccgctatctcaaggagatcgtagagccccctctcctttcctacgtgagtcactcaggtcttcttaaagggctccctcccccgacaacttgggacccgcgtttggagggcggagccttgatcattggcccctccctgtaggaaggcaactggggccagaaaggccggagcgctcactccgggatcagtggagctgggtggactcgggactcagctgaaagcagctagtccacgggccgctgccagggactcccgtgccccacgcacccccgccggcacatctcctggccgggctcctccgcacgcagctgcctccctgtggcccgggatggccctcgggcgtcacaccagcggctttccgcacagcccaagggactggggtcgcgccggctcccgcccccaccccttgctgcagaggggcagccgcctgcagaaaatcagcagaggtaaaccgaggcgtcgcaagcggagaatgcctgctccagcgaggcgtcgcaagcggagaatgcctgctccagcgaggcgctcgcgcggggccaccgggaatgtgcgctgaactcaccccgacgcatccgccagccccatggctcgcaagttgtccggtgcgggctgctcctgctgctcgagctagaggccgctacgctccggaaggcggcgccgggaccgggtgaggccagctgcgctctcccgggggctaatcccggggcaggacggggaggcttgggccaatcagcgcgctggggcggggcctaagtggcgcgcgccgggcggggagagactggagaaggaggatttaaccgcttcctccccggcgacctggcctatgaggcctctcgctgctcgcccggccctctgcccggagctggatgggactgcagaactggaactaagcacccgcgccgggctggccgcagtcgcgcccccaggccctgagtaggttggagctgatcccaggtcctggctcggcggaaggtgctcacggagtgggaaaaggaaactccactggccggtgaccccagccttaactcgtaggggatccaggtctgtggggcctctcttgccttcagctgagagcgccacccgcaggctttctgcgactacgcatctctttgagacccggagccaacggtccccaagtcctcccctttaactctggccacccaggccagaaatggttggaggatcccctccgctgcactaagcacagcccggacgtagctcccagaaggttactgcgcgggccgccgaggagaatggtgggggtcagtgctgttgggtgggcgtcagtgctgttgggtgggcaaggcaggaactgcaagagcagttcctcaggttggtttcaccgcaggtgagggcaaaaaatgccgggtcagggctgcagaccctgaagaattaggaagtcctgttgccgttgccttgaccagcggggaggttttccttagcaccttattttcagcacctgtgctccaacatcaggccccaattacaaagtgaggggccagatttcaaggtgaaagagatctgccatgaaatgggctaaaaatagctggatattcttgggaggggctcagattcctcccaaaggtcagtctggcttgaatcattcacagcttccatcctacctccccagcccccaacaggaaaaggcaacaactgttttctatagaagtttattcccaaaacagagcgcggcttcacggaacaatttacacagacaggaaagagggccgctgggctggaggaggggaaccccagagaggggcatctacgaaacctaggacatagtaaagacaccctcccacccccagcaggccactcagcccttcaagagctggggtccttctcggtaaggagagtttgggtcctggctggtgggatttagctccagtcagggaagtagaatttctaatctcccaggaagctgcttcccaagagtatgcatggggtggtgggtgaggaggtgtctgcacagaccaccccccagccctgcacagccactctcccccgtggttagaggacgcctactctcaaggtcttctggatctgctgttaaacgggactcaaggctgaccttcggcctgggagacctgggggttagaaaacccctcaagatggccaggtcagggtcctcacaggtgggtcctccaagtccctctcccactttccctacctttcacttggaaacaaaggaaaaaaaattatctactgtaaacaaagtgtaaaactcaaagttttgagttgtaaacaaagtaaaaacattttttgaatctggacttgtaaacagtaacaaaattttaaagtcttcagttctggacagcagacaaaatagcaaaagtaagagttttgtgaacagggtcgtaacagtcatttttccctttttaagggaataaaggaggagtggaacggagtcacttcctgcagcccaggtgcctagggccacggaggatcctgtaaacataggaggcagtggcacctacattctgggtcttgaattcccttgtttctgctccctttgctcaccttcccaccctacccttcggaatcaattcaagcagggggcagtgtcagggaatcaaatggcaccacagacaacttttgcttgctgcaggggcaggtgaatgacccctccaccgaccctctgcaggaatgtctgactagaggcccgagcccctccccgtgggagacagggaagccttgctctgtaaacacgacatcagctgctccaccagcaccccacagcatcagtcctaggtcataaggcagtaagtggcagggactccacataataaacacacacatccaccaggaggggcggtatgagcaagcccccatgaggaagtcagaggacccctgtttccaagaccaacccccagccccagaagtttggcctttggagcattcaataaaaagcaaagaacaattctgtactttgggcccctgacgatactcagatcaacttgggggtggaatagggggaggaaggcatgtgtcccacccatctgagtccaccccaggaaggagagagagatgagcatagggtttgctcaggacccaaatggggtcaaactgcatctctccctctatctccctccccctcccagcccagcctcaaaccccccaggagacagaaaagctgaaaaataacataagcatctctctggttacaaaggtacaaaacgtataaaagtctccctccagtcccccgtctctgcacctgtcacacgcatgctcacagatgcacatggagcctcagccctgccacaccaggtagagctggggcacccaccactggggagcaggaggctgccttgggatctgcccccactcctggagtctctcctgttagcctagatcctctgtcgccctcagctgttcctcgtccacgccgtcatcccctcaggagtgaccctcacttctgggaactctggaggcacatgaggaaatcagaggttgatgcccagaggactccgagtcaggcggctctggactcccccaccacatttggcctggctgcttcccttgcctccaccactgctctcgcctcttagcccccagccccttcatgcccactccagggttctcagagtcctccattccgcgcccctagactcagccaggctccttggctgcccaggtgttttctctaagtgcttcaagagcacctactgtttacagatgctatattgagcacttgacagatattatctcatagatttccacatctcaaagagtttgttactacagacttctttacagatgaggaaactgaggcccagaaaagcttgcctctgcctaaggtcacgcagctagtaaggtaagacacagagctcaaactcaaacctgtgcgactccagagcctggacccctgctcagtccctagtctacctcccaaacagccagaccccaaagctagactgcagggggacccaggccgtgggttagctccctctggtccccacccccagcagccctcagtgcccaagccccaggatccccaaacccctgctctttcctccttcctttgtcctctctctgccctgggtcctgctcagttctgtcgatcccctgccccacccctagggcccccttcctccccaagccatctcttaccccacaaacccccagagcctgacccagctgtttctcctccttgaaactcaactctcctcttggcttacaagagacctggaagctcctggttcctccccactcccaccagtccctctcggactcctgtgtatccagctatttcctgggtctgtccgccatccccttccccacagatgcttcacacatacccgagatgaaccaggttccaactcagttcctgtgagccccaccccaaagtgtccacagacaggaggaactcaatgttgactgaatacatcgatgaatgaatgatttatcctcaacaaagcaagcccttcagcctggtatatcctggcaccacttccagcctctccttgtcctatatgaccccctaggcgaaccttcccaagcaaggcctcctgctctcctccctgccccttgcatattccaggtcatctcccacttctaggcctcagctcctgccctcccattcgctagctcagcccatcggatggcacctatttctccttagcctgggaggtgctgggaaggctggctggctccagtcacacagccagcaagtccctgctagtcacacccccatttcttgccagattcctgtccccagcctgtggccctctggctgtgctgagcctggggtagcccacacctgtctgccagccctcatccccttctgtggcagaacacagggcagggcacacaggaggttgccctaagctgatgagggtgcaagcaggtggctggaccatacttactctgagtctggcgacagctccgagatgctgtgagacgtggcagaacgtggcgtggagggcccaagcacagaggctgtggcagaaggtgtggcagtggtgtgagggcccaagggtgtgcttgaagattgcacagaggagagggccgaggagttgaaagaggcaaggatggaggaaagaatgtccaactgttctgtggaggggccatggctggggccactgaccgagtcctccctagctctgagcagctgcgggagtggcccaagggcttctcgtgaggggtgccggctaggcacctggtccagctgctcccgagagttcgagctcctagacagagagtccagcggccgggatggcaagagggggtcccttgagagttgccgctggggagacaggggcagaggtgggggctgtgggtcaaggtcccgggtgcggcggggcggaggcagcgtgctcaaccactctcgaggtgcccctaagtcgagcgcatcccgtgacccgaagcggccagccatggcgccagggtagtcccgaggtggctgcctccgtggcagggtgctgccccgatctttgggctccagtcggcctggtgcagcatccatgcattcctgggaccctggccggctcaggggacgtagaacaggggcaggggcttcctctagtcgctcacggctcagttgccgccggaggagcaggtccagctgttctctagaagagtagcggctggctggctgtgaaaggctgcccgtgcccccgccagcatagatgcgaccgtaagaggcagctggcacagcacggtggcccaaggtggctgcacggcaccaggacagctcaggggcacctcgggtctgtggcaccagtgggtattgcaaccggttcttcaggatgcctgtgagaggaagaaaatggggggcagggtttgtgtgggagggggagggcaggcaggaattgctgagtctaggggtgtggcagcccttgggatccttccaacacagggatgggagcaggaaccccttggggagcagcagaggcaaccctggtggtcccagagaggcagcaggacaggggtcagagtggaagggcagtcatcttccagttgtggtcccggggcagggggagggcgggcaggtctcatggtgcaggggatggggcaaactccctgaggtcagaagaggggcagccctcaggtcctgacaatgcaggcctggctgaaatgcaggaaccccccgggttggacaggagcagtccccaggtccctgtgatgcaagggtgagggcagaaacctcttctccgggtccccataaaagcagagtagggggcagaaatcttccagatcagagcacgggctctgggatctgggtggggggcagggggaagcagctcctagggtctctgaaaaacagatgggctggggcaggagtggtcgcctgtggtccccctgtggtgctggccagggtagagggggacagagaattcccaggtcaggacaggagcagtccctgaggaccgtgaagcaggctagagaagcagaagcgccctaggtcagagtaagaagagctctcagtttgggatgaggaagctgcaatcccttggctcagggcatgagcagcccccagcgtgtctgcggtgtgggccagggctcagggactgtacctttcctctggcgctgggcccggcccagagaagtctcatccccactggtcagggccgggtctggctggttgttgttagctgcatccttgctggtgtccagccccaggcgcctttcagagccccaagtctgcagagcacagggggctgcctcgcactcccccagggctggccagtaggacaggaggtcattgccatccacatctgtggagccaggtcaggttacaggagcttctgggttgatcccagtgactcatgacccctgaccctaatgacccttgaaaccctggctgttctcattgagcagaggtgggaacaggagggtatctcctcagagatcaatgggtgggggtgactggtgagctccctccccttaactggaggtggacagagactaaaagttggggaacctgatgactgaggggtcagaaagaccaggatgaaccccaaccgcaggaaagatggggagctggagggataacaaatggggcatcccttggtcacccaaggggtcagagggcgcctggcacctttggggtgggtgaggagcctctcactctgggctgctcggcagagtggccgttggaagcgcccccgcgtccggccattgtcctcgctttctgaagatggaatggagagactcctctcctcctccaaggacaggtcactgtcagagtcggagtctgcgcctggagttgggaaagtcagaagtactttcagaggtaagggacttggagataagggaatttggagttgagggtctagaggtgggtacggcaagggggttagggttggggacaggaaccggggcttgaagtggaggtagcagcagaagggctgggacttatcagagggaaggacgaatcaggagtggactgggagaaccagggctggagaggtaggtgcctcctgaggcagggaccctgggggagatcgtcccaccccagtcagccactgctcccagtatggggtagaagaaaaggggatggggagagatcctctgcctccctcctccctgccccaggccccaactccaccagcatctcgatggaacatggccacgtccaggtcagtggggccagcatgagcctggaggctgtggtcagtgtggtcagcggctgagccatgtcgaaccaggacattgtccctggaaaagcaggagcccccccaccatgaaagagggatgtgatggggtgccttggaggctggagtgtctttgagtgcacagccagctgcgggtggaatggcatccctgggtgtgtgtggtgggaagcatttagggcagaggcagaagcagggccccagatggccaagatgggtggagccacccgccctaggacctggtcagccaagccctggtaaggtggggctggactaagctgagtgttccctcacaaggaggctcttcctctcacctgaggtagctgcggccccgctggctgtcctggtcctgggtccggccggagcgggcactgctcacagaggagacggtggaggcgcccagagtgatgcggatgaggccactctcctcaaagagagccgtgttgttgtaggccccaggtccctgggggtggtagggacagagtgtgagctaaccctgaagcagcctaaaactctggcttctcagggcccccatcccgactcaccagcccaggtgctggccttgcctcctcaggcgctgccttcctgcccagacaggctggcatccaggcagcccgagcatctgcatttaggacacagaagagcagcagcaccgccaggccctgtgggtcagcgagggtcaaagcagagtcggcagggatcaatcagggaccagtataagtcactgtgggtcagcaatggggtcagtcactgtaggctagtgtgggtcagtgaggagcccatgcgggactcagtaagggagttggggaaggtcagcaggggagaggatggagcagcaggagtggctggagtctgtaaggtcggtgtggatcagcaaggggtcgggagccttggtgttggtgaaggtcgatccaagatcagcactcagtctgggatcagtgcctaagttagagtcagctccaggcctgggggcagcagctagggccagtgtctggtctggggtagtacccagcctggcaaagttatccagtaagagtcagctccaggcctagggtcaacgtctgcctagggatggccccagcctactgaaggcccacctggttctggggcaagggaggggcaccagagtcacctggaggccgcagagtccagcatggaggtagtggaaggctaggatgctgtggttgactgccaggagcccaaagagccaggaggcactgaccagcagaagcagcaggaaggagctgcgaagggtcctgctgtggggacatgggaagacacaggaggacatgcaaggctcatgtaggactcatgcagggaacacgggaggacacacaggggccacacacgaaacgtgaaaaaaaggaactcacacgggaacatggaggtctctggaggacactgggggagatgggaggtcccacaaagaaacaggagagcagtcaaagagccatgaggacacgtggggaaaacacaggggtatgggagccacaagggagggcacggaagacaggtgggaacacacagggcagggggcaaagtgagccacccaggccatgggagactctggggggacccagaggacaaggagagacagcagggcagaagcacatgtggggctacagtatagcgagggcgccagagagggaccacaggtcagggcaggtgtgacttcattccttcatctagaacttggagcccaacctgcaccagggaagatctgggggccccagaccccacccaggagggacctgccatcctgagaagcccccttcctccagccagccaactcacagtgcagaggtcttcttggcctccctctgccctgtggagcaggatgtgcgggcagcgaggagaaacatggtcccgttcatctggacccacggccagacatgtggggccgggcagggcagagagagagagagagagagaggcaatgagagacagagagagactaagattcacggagagaggcagaaccagtgagaaattcacacatatacacacacaccaaaggagcttagcatcacagaaaaagaaattgggaaccagagagggactgagagagagaagcagagacagaggcagggacaggcaactgaatctctgaccccgcgcccccatctccatgccagttgaatgggggtggctactgaccagaggacagaaaaaatgaaggccgagcccaggaagcctgcagaatgccacctgaccgccctcagctgagtccactgcacctcctcccccaatgagggagggaagtacagagggggcaccaagtccagggcactcaccactatgaccaggacaacagggccagcaaagctccagatgaggggctcgtggactgagatccagcagaagtcagggttcccatagccctcagggtccaggcccacagcaaggccttgggaagagaaagggtaggactgagggtgtgtgttccagagctgctgaccagcccatgtatgggagaaagcatgggtgagggcagagcagcaaccccatgaatagatggcttggggtttgaggttgggggtcatgagcaggagtggggacagggtcaggggtcaggccatgtgatggttggaggttgggggtcacagccctcacccagcagcacagcagggacgccccagcccagggcatggtagaagcgcatggcgccgcggtccacgttgcgtggctcaacctgcatgcggtagaggtgcagcccctgcacgaagagccacgcgaaggtgctgaggaagaagtagtgcaggaggatggcgactgcagtgcacaccagctgagggcaggggggcgtgtcaggacctctcctgcctcacccacctctgacccctaccccaggcatctgcttcccacctctcacccctaaaccacaatatcttaccccagcatcctgctgaaaaccctggccccaacctgagcatccctgacctctgaccctgagttttggccccaggcctcctgggccagtagggtcatcaggacacaagttccctggccctgatcctgcacctgattgtgggtcctgtgaatccccagcaggaagaggagctctgccacccccagggcggctgccacattggcatggatcccacgcacattggacttgaggctgcgcaggctcagcaggatggctgcagtcagcaccagcgcagccacagacacagccacgaccacgtgggtgaacacagccagcagctccaggtcgccctccagcctctacagagacagggatggttgatgggttgttgggcagaatccccgtgtccctttgaccccccacttccttgggacactgaacacagccccacctcacggggagaggcatccatgaggaccccaaaggtccctgtccggctgcagcgacaccgtgcgtgggacccattcctgtgcaccagctcgcagtcccgtgctgtccacacaccatgctgctccgccctgcagccacagggcagttagacacaactgtgacccagtgtcaggcaggggtttgtgagagatcatgggaagggctgagggtgcctggagttggggtacagcattcctcatggtccgggttgcacaacagcactagtgggggccccaggggaaggctgggactattagttggcctcccaagggctaacgggaccaagggtttccagaatgggggtcctcacaggccaggtgggtcccactgcacacagatcgccttgctccgattcgctgtctgtagcaggcgaaactctaggctgatgggggactccaggattccccttaggaagttgcgtccgtggaacacagccacgctgaccaccggggagttcatgacggggttctgaggaagcctggggagacacccatctgggcttacgcactgctgacctccccatgctcagcctgcttgcctcaccccgtcttcatgccactcgccagggctgacccagggtctgggatgtccccagagtggaagctgtttctaagaatccctccagcttctgctgggctgctgaggggctgagcagctccaggggacctgcaactgtttgcctctgattgccctccctcctacccccatcagtcagcctgtccttgtctgtctctgtcagccctttggtctgtctgtacctggctcatggatccctcctgtgtgtggctctgtgtctgtcagcctgtggctctgtcactctgcacaactccagagaataagattcacacagaacccggcaaggatggggctccctggagctgtgctcctctctgtgtgttgtgaacctacgcatctacccaccaaaaaaggggctgccaggctgagaagttcgtaggaagctcaggggtgaggggcctgagtacctggcacctcggcgttctgcctggaactgggcagggagcagtccccctaaggtgcggtaaacgaggagaatgataatggagatcccaggctctggctctggcggggctggtggggggaccacacttgaggtggtggagttttctatgctgctgcttgtgggcagaactgccaggagagaaggaggagcttctgtcagtgacctttgacccaaagcacccaccaacccagctctgaacccgatcaagcatgggggtctcttccctgcaggagcagaattggggagtgcagggagcatgaacccagaaagtaacagtcaaggcctgggaggggtcatttgtgatgagggagaggctctgacaaagtgaaggtgtggcaaggtggacagtggaggggagatgtgggagggagggtggaggggagatgtgggagggtggaggggagatgtgggagggtggagggtggaggggagatgtgggagggtggagggtggaggggagatgtgggagggtcgagggtggagggtggaggggagatgtgggagggagggtggagggtggaggggagatgtgagaggcagggtggtgggtggaggggagatgtgggagggtggagggtggaagggagatgtgggagggagggtggaagggagatgtgggagggagggtggaggggagatgtgggagggtggagggtggaggggagatgtgggagggtggagggtggaggggagatgtgggagggagggtggaggggagatgtgggagggagggtggaggggagatgtgggagggagggtggaggggagatgtgggagggtggagggtggaggggagatgtgggagggagggtggaggggagatgtgggagggagggtggaggggagatgtgggagggtggaggggagatgtgggagggagggtggaggggaaatatgggagggagggtggaggggagatgtgggagggtctgacactggggaggtctagaaaggggaaaattggcaggagggcaacatagtatctggttggggggacagagagacaggacttggcccaggggtcccctaggggctctcaccttcagatggggatggccgtggggactgggaaggcagcagcacatgggtgtgaggatcccaggcatcctggcctcgaaagaggttgctatggtagcgagggtagcgacgggccccccggggagaactggggtgctccatgcggtcaatgctgagcactacccaggagaaagaaaggggaggcccatcatggacctcttccccctgccaagggttctactccctcttactcgcatcccgcacctgagtcccacaatctgttttctgtgctaccagctcggagcctgtccctacaaaacgctgagggcggtggctgagtctcctgccattaacattggcattgatagccacagcccctcagaccttcaggtacctgccctttcatggcccccctgctgtgccccgccctaccccacccacaacgcactgatattaggcgtcaccagccccatgggattcaggtatgtgagttccatattccttgcgagtgtggctgcatactcctccaggtgcctcaccagtcccgcgctgcctggggagcccccaggggcccgctgccccagcgccgcccacaagtcccctgtctctggggcaagcagtgcagagccggcccacagcagattctgggaagacagagatagaattgggttcagccaggtggtgaggatgtatgaggggatagggcaggcatgagaggtctggacaggtgctcagaggggctccaacaggcaagggggcggggctggagaggacaaggacagagggagagcccaggaccttcacttcccaagagaacagcaggagcctgagctggggatccaggggcaggaggctgggagctggggggccaaggcactgagaacatagggcacagccccacctcattgaagtgggcatcctgtgtggctgtcagcccgaagccctgctgatggctctcgaaggccagcaggtgggccagcaggcgggcagtgactcgaacatcttggctaaaatagtggtcagtgtggccagtcacctcccgtagccgctgagccagcttcttggcctccatggtatccagtgccgtcttgttcagctctaggccatccagctgccaagacaaggagatggttgctctgtggtcccttaggccttcctctaaagcttcacagggagaaagccttgccagattaaagggcaaccaggaaaggctcaggagttcaagggctagggtgtggtatctggggcccaccacaggccaaggaaggtcttaggttgcaggaaaaggtctgggcagtctcaccagcagactgagctctcgaaaggcaggggaggtacagttgaagaggtcgggctccagccaaccctgggcctcatcacacagccgcacagcagcacctggaggcaggcaacccctggtcaggcctggggcctggatacctttgctgaggagataaccgcagcaccctctcctatgctgggggaatccctgaggcagaagtcagagtcatgagcatctatagctgcacccctggaggtagcggcccaagcccaggtaggccccagctgcttgtcaggcaattcctgagagggctgtagaccattctcaaccagcaaccacacaaagcacaagggtggggctgcacacactcacccacgtgggccaggactggctcatagatgtgctggttcacacagacacacaccaatgctcaccaattacacacagatgtatggaccagaccagtacgcagacacacaatgctctctcgcacacacacagacatgccaacacagaagagggcttctaggaacatccagtgaaagtcaggtgggaggattctcacacaagttttaactgccccagtggttactttgctgtcatttctctcccttgtctctggggttgggatggaggttgaatgagaattgacttggatcttaaaaaagtttgtagctaccaacaagagagagcctaacttaatcacagaatcccctccccgcaacaggttcacagacacgtgcacaggcacagagatacacacgtgagcatgcgtacacaaacaatctctgtccagccactgcagagacctcaagcagcagggagtgttctgaggggacctcaggcagtggggaggggcccccaagcagcaggaaggagctatagggtcctcagactgaggagggatctttcgtgacctcaggcagtggggaaagttctatggggaccccaggaactgagaaggggtcagcagggtcctcaggcaatggggaggggtctctgaggatctcaggcatcagagaagggcccctggggtactcagatagccagaaggggcctgcagggactttaggcagcagggaggggtctgcagggacctcaggcagcaggaggggtctgcaaaagctctggtagtgggagggggcagtgcacctgagcaaacacgtaccccttacctgcaccccgcaatcctgcccagaagccaagagaaacagatggaggctcaatgagggtgtagggaggggcccacatggactcccaccccacttccacctctttgcaggaacaaagccacccaatttaggaaaagacatggctctagcagtcagagtacaggcccacccccaccctcagtgatgtcctttccccccacatactcacccagggccccccggggacagggcactgtggccaggacgccaaactttgtctggggccaccacacaccagatctcagggacttagggcaggcatcatagagcactagagagagaagaggtgctgagccaggcagtcagggtacagggcagttgacagccacacccactgcccctccaccaccccccacaaggcccactgcccgccactcctgctggcttctcaggagctgacctgtcagattctgtgacaggtcagcaaagtacttggggcaaaggtagggttccctgggtgtaagtggtctccctcaggagaagcttccagagtccccaaggagccatgtgtgccactgacacgtgatggtggcacactggaaccagccctctatgggtggagctgggtggagcctgctcaccccggcagccgctggctgtcacctctgcgaagggactgtcacagctgttgcactggcggccaagggctcctgggcgacaggggcactgcccgctgtggggtgcacatgagcgcgaggtggagcccacagggtagcagtcacatgggaggcaagagtcactgccccgcggtcggtagtggaactcctgtttgaggatgggccaggggcctgaagtcagaggtcagggcttggggaatgagtggaatcaaggataaagggtcaagagaacagtgctcatgggccagaggacacctgggtcatgcgtgaagccaagggaggggtcacgggtaaaggatgagagacagcaacttggtcacaggacacaggcaagaggttagggcccaagtcaggtggcggaggtcagcaagctggacaggaattgcagattgcgtccaaggaagggttaaaaggtcaggggccaggcgcaccttgcagtgacactgcccatttgtcttgttgcagttgggatcaaaacctttgtgaacatcacagttgcaggggccacaggttgggctcccccaccagccccgtgggcactgctggtccatcctgggggtgcagagccaggtaagatgcctccacggtatcccagtgaccctccctgtccctgccaggtctccccatcgcctcagccccagcctcttacctgtgctcacagtggtgcccgaaatagccacccacacagtcacaggtatagccatggggggctcctggcaggtgccggcatgatccctggttctgacaggggttcaggaggcaggcatccacacagcctgggccgtagtaacctgcagattgggtcagaaagctcaggatcctggtcgcagagcatggaaggaagcaggcacccgtcccgagtccctgcctccttcaggttccccagtcttcatcatgggcccctaacgcctgcccaggtcacccttcccccaaccctctcaaggctcacctggctggcaggtgcaagaaaaggtctgccagaggtcccggcagtctgcgtgaggtgggcagggcccagaggcacaggcgttggtcacaacacagccaggctccgcattcactcggtggctggggggtagcagggccggggagccagagggtgtggagccgagccacaccccctgtggacacacagccagcaaggggtgagaccatgttaaggcacctcagcctcaagtactgcagagccagccacccggtctgatgatccttgacatgcagtcttctgataccctcaaaaaacccaggcctcaaaaatatccccaatttggtacccctgtgggaccctaattgtgctgtttctgacacagattcctaaaggcccttgataatccaagctagactcccacctccaatgccacagaaaggcttgacctagctctcaactctgggtcattcaccccctcgcaccaacccccacttgaatactgcctttcaggtcccaaggagcccctgacttctgacccctgaccctaatgccccatatcacattcccatgctgacccccacctggatgcagccaaccagaccctgaggagcctcctctgcactgccggggggcaggcctcccacgtggagctgctttaccttcaggccctgcagctcactccccaccgccatggtgtcctggaggaagtggggcagtcagcactgagggagaggggcctgatgaacccctgtcatagcccagagtcagtcttggccttcttctagcccttctaggctgccccctccctcctggacccacagtagaccttaatattgcttgattttgaccgggggtgggtagagactggggcagagactagaaggggcttctaggaatcaggcaaagtgctggctacagaggttccccaagaccaggccccaaatctggcacaaagagggcttgagagtggaccaacttggctggtgggtgggctcagtgcaaggatatatggtggggaactaggggtagaacatcagactcagtgcagtggagggaactgagaggagctggactagaggtggggtcaaataaggcggatctggttggaaggctgagaacagactaccccggggtcagaggccagacctggaagaggctaaagtccagtgagaccataaggacatggtggccccgccggccacctggttcctcctgcaactccagccgcagatcgtgccaccggccatcactgacagtcacctggtccagaaggagatgggaagcacggcccgagcccctggtcactgtcacagacagtaacccccgatctagctgtgggcagagatgcatagccctggggttagagccccatgtgggctgggacttggaggtgagatcagagggctcagaggtcaggaatatcagaggtcagaacagtggggtcaaggttatacctggcacaaagggcactgtgccaggggacatcatgttgctgatatggggtcagggggcagaggataggaccaggtgttgtgggtgggttggtgcagcttgcataagagagagctatgctggagccctgcacctgcagaggatataatgatggaaagagaatcaagggctagggtccagagcagggtcaagtgtggttgggacacctggcagaaaagtatgctgtgtgaccaacctgaacccacaagaatgtcagtggcggcctaagagactgagaactgagggtataggggtgagcagggtggacacacctggcaaaggagcgtgctgtgtggcccagcctgcacttgcatcaggaccccctgcgttgcccgtgtccgaaatgccagccccaggtaccatggcacagacacagccatgtcacttccaaagttccagctcagtgtgccgttgccacggaaatggtggggatgggccatagctgagtggataagagaaacagggttacagcccctgccccaggaacagatctgaccctgcaggcccctctgccccatgctgcccacttactaagctgacagtctttgccgccgaagcccacagggcagtcgcagctgaagctgccccagcgctccgagcagaagccactgttcttgcaggggcctgagtcacaaaagtgtagcttggcttggcagcctgggagaggaaagcacatggcggacatgagaacaagggttggggggcacaagtgctggacaggactttagtgtccagaggggctgaaagagaccaagatctcagccccatttcccattttctttcgatgagtggggttggtaagagtcaggccctaaaatctgggctgtagcatggtgcttgccaccaaaggagactggcttgaagtcaggtatggagtcctccacttcctccctatgatggggacagggccatgggctaggctggtggaagcttcaggcctacctgccatggtgccattatttgcgacaaaagccgccatgtccactcggcggccatcaatgtgcaggtcccgcatacagccgatgaagtccttatgggatacggggaagttctcggggaggttggggacacctcccagaagaagagggcccgtcaggtccagggacctggggatcaggggtctgggtcattggtgggactggggccagagtagagttgctcctggggggccacaggaagcaggggggtaggacccagagggtagggtgattgagggaggaaaataaggccgagctgtggaaggagttaggatcttacttcagttggggtgcaaaggggcacccgtgatgggccgatggtctggggaaaggtaggtgaatgggggttgagagctatgatgaaagaatgaggcatctggctggctggggaggggatggagacgtgaagactctgggggactggacatgagatgaagggactcggaggggatgtgggacattagtgagactggggtggggaggtggaggctttggaggactgcctggggactgtgtgtgggaggagggagtatggggtggaatacaggattgggggctagggtgagtaggctttcagggtctttgagaggagaggggaatcttggtggtttgggggaaagatgggagagtttggcaggatgggatgaggaatgggatgtgaagggttggagtgggctttggtaggcaggggacaaggggactagggggcaggggcctcacttcttggagcttgtttgcacaccagcagccgcgcatgagtagttgccaatctcagcaccaaactgcagagccacggccacatcacaatcatccacgcttagcacagccaccttgtccttggaggggccctgtgcaccccctagggcatctgtccggggctgaagacgcaggcacaccagtcaacagtgcccccagtaacccctgaggagcagaagtcagcatcccaactcccctcatacccgatgccagggatggcccccaccttgttgtagtatctcagatgcactgtatgccattgcccgtcactcaagccccctggaactgtggggctgaccacggtgttggattcacctggaggggagatgcatgtggaatcatcaggagcagcggagtcgccccatcccacccgtcatataagcacaaccattcccagggccaccctggatgcatcagatcagtccccccactggtgaccacaatggctggctcagagtgcctttgaacagacaggagaaacagacttcttggagggagggaccttcccacagggaatggccaaggagctaggtcttcagggcttgcatggcgtggagtgtgtgctcaggtgcacagtgaagcaaacctgaggggacttgggccctgcgtcctccagcacacacgcaccctttcgccgtcacatccggggcacccacccgtggaatatgtgagccgcacttggccagccacgagttccagggccaggaagtcgtgcttctcgttcaggcgcccgttgtagaagagcagcccgctctgctgcactgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcagcgaaagccgccgttgggcgcgtcggtgcaggtgcccccgttgcggcagacgcccggcacgcagcggccggcctcggtgtccagctcgcagtcctctcctgggggccaagccgcggtcagaggcggtcacgcccacgcccgcccctgctccggccccttcaaagaccgcgcgcccagaggccgggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgcacgtgtagcctccctcgcgccgcgcgcaggctccgccgttgcgacatgggttggagtagcagaggtcgagctcggtctcgcaaaagtctcccgtgaatccgggcgggcagcggcagcgcaggccagcgatgggctggatgggtcggaacagcgtggaggccgaggccaggaagggcgcggacgagtcaaagcggagcacggacacgcatttcatgtagttctcacagggctctcgcaggcacacgttgtcgtcgaagggcagtacgtcgagcagggagcgagccgccagcgccgcccggcgcacgtacaactgctcctgcagctcctcggagctgaaccagggccctgcagcgcccgccccggccccacgtggagctagcgccgagaaactcacattgagcacggtgccccctacgtctgtgtcgttctggatgttgaagatgaagacgtcctcagcgggcgtagcgagcaccgcagccacgccctcgaggaagcggcccagcagcggtgacaggaagcgctcctgccacatgttctcaaggcgcacggtcaggctgttggccagcaactcctccgtgatgatgaccacgcgcagcacacactgcgccgtcacgctgtgcaggccatctgcaggcgggggcaggggcagtggtcatcctggggacagtggccacccctccctgggacacaagagggctggggccagcgatagcctaggcccccagaacctctaagtcagcaggctgaccccaccaggacacaagggagtctggggctagtgaccaccagctcccccagcatcaaggtgtcaaaaagctgctgcttcctcccccaatccccaatacacggaggggtctgggccaaggatcaagcaaccccacacagtgcccatgggttagcaagtcactcccgcaacagcactcaagtaccctaagtactcagtaacccacacttccccaagttatcatggtcagcaggccaccccaactcaggacacagagaggagctagggccactggccactcattcccagccacctttcccttctcccctcctccagcatagcagaaccagcaaaacatccccctccagaaaagaagggttccagatcagggatcacctatctcctatttttggtcagcaaattgctcttccatgacactagaaggggccctggcccagtgaagactcaatgccatcctccagaatcctgggttatcaagctccaggggggtcttgaaccctgacatacacacacacacacacacaccagcattcttgagttagcagcctgctcgccactccagacctgggtcctgtggtttcacagtgaccaccccagagatgaaggtgaggtgcttagctgccttgttcgtcttgtccccacaccctagcacatactgggtggtcaataaggatagactgttgagtgagttgagggataaatgaaggttgtgccttctcaggcagtgccaggagtccctgctccagaactgaggaatgagcaccagtgaagcctatttcccaacctctgcagcctccagtaggcagaacttcaagagcctctcccacctgcactctcctattatggaggggtttctgaaagactggagcagatggggcaggaaagaggcaagtggacctctggacattttcccaaaggtcagggtctcaggccctacgaagccactgtccacctgaagcttccatagtaagctgctgttcctgaccactcaagtattggtcatttcctgcacagatagggtaagcgtcagactggacccaaagtaacccttcgtctgaacatgggcatagtgtggactgactggcccatactggctttgcctaggacctccagaggattaccccaggacctctgaccttttatcaggaggggagatatccctaggtagcagacagttctttacaggctttatggggtctgctagatgccttggaatcactgggattctgtggagattatccaggaacctaagcagagtccttgtgaggtctgtggcagatcttgtagggtgcaggaaccctacccttaaggggttcttggaaggcttagaaatccctctttggtttgaggtgccctgtggagtccctgaggcccaacaggttggtgtcactgggtcacttgcctgccccctgcccctcacctgtgacagtcaccaacatggaggccaccagtgggcggttattgtctagctttcggctgagtcgcagctccccactggtctggttgactaccagcagctgcagctcattgccacgctcaaaggagtagaagaggtggtcggagacatcggggtcataagctgggatgcgcccaataatgcccgacgggaaggtgtctgaacggttggatacatagttgttgaagaggatctggaagttgttgagcacagggctgttgtcattctggtcaaccaggcggacgtgcacagtggcccggctgaccaaaggagcagatgtggcctgcaccacaatcacatattcttggcgagcctcatagtctaggtcaatgagtgccgtcagttctccagagaagatgtccatttggaacagctcagggatgttcccctccacgatctggtacattatatgggcattggggccttcgtcagggtccactgcagtgatctgggccaccactgagcccacaatgctattctctttcacccgcacctcaaactcctcagctgggaagacaggtgcattgtcgttcacatcctgcaccatcacctggatactgactggagtccggagtgggggcacacctctgtccactgcgtaggcagtcaactcatacactgatactgcctcccggtctagccgccttactgtacggacaattccagaggtgggctcaatggtaaaatctccatccccatcttcaccattctggaaagtgtactggacccggccattggcatgagcatcccggtcagtggctgagatctgcaggacactggtgaaaggtggggcatcctcagagaccagccctgtatagtgggaggccacaaattgtggagcattgtcattcacgtcattgaccatcacctccacataagtagtgtctgccttctgtgggatgccattgtcccgagctgtgatagccagggtgtaggtcacctggtcctcatagtctaatggggcctgtaatgtaatggctcctgagtctgcatcaatgcggaactggggcaggttgtcctccaggagataggtgatacgagcattctcacccacgtcatcatcagaggcactgatgaccactatggtgctacccattggccgatcttcattcacactcactgagtagtgggcactttgaaagaccggccgatgagtgttggcatctgtgatgttgatgtgcacatagcagtgatcatgaagggcacggtcagatgcagttagtaccagcttgaagtagcgttcctgcttgtagtccagtggcagagccagagtcaccagacccacacccccctgggtgctgatggcaaagcgattccgggtgttgccgcctgtgatctggtagctgatggcactgttggcatcacggtctactgcggtcacgctgaccacactggtgcccacagctgcatcctcattcagtcgtaggtggtactccttcattgtgaactcaggccgattgtcattaacgtccagcacagtcacggtgacactggctgaggcagagagtgggggtgagccatggtctcgagcctccacaccaaagaagtaatgctccacagactcacggtccaggggaccactcacagagacccagccagtggcgctgtttatcacaaaaggagtatcaggtgccacaccagttagggagtactccaatctggcattctccccatggtctgcatcgactgcctgaatgtggatgactgagtgacccaagggagcattttccaagacagaaacttggaagggcgtgctgacaaaaataggaatgtggtcattgatgtccaccacctggatgctggccaggcccgtgttgttggacagcggtggccggccagcatcctgcgccctgatgcgcaaggcatactctctctctgcctcgaagtccagaggtgccaccacctggatctcgccagtgaggctgtcgatggcaaagtgtccacggctattgccactgatgatgttgtagtgcaccaatccgttggcgtccttgtcccggtcagtggccgtgacgcgcagcacgactgtgtgggggcgcacatcctcgcgcacctgcgccacgtagcgcttctcgctgaactgaggagcattgtcgttctcgtctagcacagttatgtgtacgcgcacagtggccgagcgcggcccgggttcctggccctggtcgctggcttccaccaccagctcatagctttccatgtgctcgcggtccactcggccgctggtgctgatgaggccggagcgtggatcaatctcgaaggcggcggcagctgcagcgcgcgcagctggcggccccacgaagcggtagcgcaggttggcgttggggggcgcgtcgccgtcagtggcacgcagctgcaggatagggtagccctcctccacattctcgcgaagggtctcccggtactgcgcttgctcaaaaaccggcgagtggtcgttgcggtcggctactgtcacggccaccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtccgggtcctgagcaaccacgcgtagcaccgcggtgcctgctgcctcattctccggcaccagcgtctggtagttgtactgcggaaactgcgggtggcggtttgcggcgcgacgaaagcgtgcccggttcgccgaggttactttcctggcttcaggacgggccgggagtcccgggggacgcggcccggggcgctgcgggaggaagcggcagcggaagagaccccgggagcgcatgcgcttgggcgccggctcgggagctgtccgagactcgcggggtgctgaacctgatgcaggagctgtcctcgccgtgcgtggtgctgaatccagctcggggccagatcccgaggcccctggaagacagttccgccggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcctcctggctgagggggaacaaagagaggagaaggagcaggagtatgggggtcgaccgtcccccgaggccccgccacggcggccgcctcgccatcatcccccgcctccctgcacggcctccaccgccccccgccccggtccgggccttgggctggccccgccgctcgggccccctcccgggcccctgccgccgccccgggcccccgcccctccgcctgtctctccgcacccccgccgccctctgggcaccatctactccgcggccggagcccctccggcgtgcggccctggctttttccgcccccaccacagcatccccgacgctgctgccgcctcccgccgctccaacatggctcccggccgccccgatggttcgctccacctctgccccggcgcccgaaacacggtggtacaacccatcgcgcatggcagctctgaggaccgaagatgttgccgccatctttattgaggacgtgagcgttgctcctggtgctgaacagagcgcgaaggttcgccgtcgttgggtccgccctccccactttcggtcgccgccttcacccacctccctccttctagggcgctgtcccagctccgtctcccagcctttttctgtccttccagatctcttgttcccccttcctgaccactagttctgaaccgtgtcccggattttggtctgaaattttggtgcccatgagcgttctcatagctctgggagggggtactgtgtgaaatcctggggtagaggggacgatggctggagaggggtctggggtgccagcaccccgaacaatagctttaactatcccatcagctagttttatgaaacatgtcgcgaccacctgcttgtttggatcgcccctgcggagcagggaccagagatgaccctcccgaggcgggagcagaggccaaattcttccctgccttgctggtccccagcagtctcccgggctcggggccccttcactggaggctgcaccccctcccaggctgcgagtcccgagtgctctgggatgccacgtggagcccggcgttgccccatggctgcgggccccgcttcttcgggtccccgcccctcgtccgtcacgaccgcatgccttaaccccttgaagggactgacacagaaactcagtcctccccccaccctcggtgcattccagctctccctgcgtaactcctggcacgcgccggtctcgccaggccaatgggtggacctggcgcaacagacgtcacgagaggagcggaggcgaggggtgaacgcggagcactccaatcggtcagtcattgtttctattggcacaatgggaggccccgcccctcacggcggactcatcgcatgggggagggggctccgcgggttgccggctaaccgtgagagagtccgggaggtacactatacggaccggcctccaaaggcggaatcgataacgagctgcagcgccgggtgcagaggacgcgggcatcccgaagcccaggaagaggtcagggccgggaccccagaacgctccacagggtgcggctcccgcgatggggtggatcctggttctaacaggcgaggaactcctggccaaggcctctggcccgccccgaacggtccctatgacatcaccatcaaccaatcagtcggcgcatcctttcgccccttgactgctccgcttccgggaggcggggcttctgcgggttccacctcccgagcgccccttgtggctaccaaggtcaggcaacaggtgtccagttgttccctctcctgtctacgaatctgaggacctccccaggatcagagctctgggcctgatacacggccggggttcctacgggtttgtgagtgggggtggaagatctgcagaggcacttagggctgaactcctttgaatgggagccaatcggtgcaggggctggaggagcgagtcccccaaagtagttttatttatctatttagagacaaggtctcactctttcggagtgcagtggtgatcacagctcaccgtagcctcgaactccccaggcgattctctcacctcagcctcccgagtagctgggactacgggtacatgtcatcacacttggctaatttttgcattttttatagagacagggtctcaccatgtaggccagattagtcttgaactcctgggctcaagcaatccgcccatcttggcctcccaaagtgctgggattataggtgtgagccaccgcgcccggcaacccagaagtggttttgacagcaccagcgctttctgtgtccacaatctagtgagtagagggcacaaaacctgacaccacggaggcagacaggcaggggctctgccggggaagggtgttggagtcccaaaggaggcgtctgagtcaccttcgcaacctgggacgccttcttgcataagatgcctgagcagtgccttgaatgaccaaggggagatccgcatctgcaaaggaagggcagggagggatagggattgggggtgggcatcctaggtcttggagactgtgtgggcaaatgtgcagagacataaagggactatggctgagggaaatcaagccctgccctctcaccaatagggctggcgctggtcccagctaacactccttttggagagcaaagctcctcacttctgagtagtgagattgattgcggatcactctccatgttgctgcctgctgtgtgtcatcccactgtcatcctccctttgtggctgttctgtggagcccctctccctcaatctgcactcacctctatgccccagccccattggcagctcctaatgcact

SEQ ID NO: 345 - DNA, 104765 bp, Homo sapiens
agtttccccacaaatgatgatgaaggcattgagtcagtattttcccatgatgaaaaattttgtgaagactgaacttcaggtcagggacgaaggagagcccaagtagccttctcagtgtcttcaaagcctatctttggactttttggtgggtaaaacatccaccttgttttcaattagccttttcatcttcaggggcctttaactgagatattttaatgtcctcaaatagaggataaattggcaaactgagtaggtttaatatctggtctgattacagtgggactgggacagatttataaactgctacttagcatacttatcagctgagcttccccttgccttaggggtctattgcccatataagcttctatcttgagtatggccagctcttgtaataataaggcctctaggaggttacccacatttcccattttaaactagtagtcacaaattccctggctttccacaacaggtcaaagtcatgtaataccctaaaaacatatctgttatctgtgttgatgttaactctttgattcttagctaaagtgtaggttcttgtgagagccacaaattattctatctgatataatttgcactgggtaaagcctcatatgttatgggactgtggatatatgcaatggcatattcagcctggaaacctctttctgaagtcagaggtatgaactatcaacaaagaaaatgagatctggatctataagaggtacttcagaaagatcaggacggggaaaggttagagcttaggtggctgaaatacagtcatggtggttgtacttcagttgggagagaaatggtaacaaggttaagattttggtaatggtgaatagtaatgtgagaaggagcaaacaaaaggatctcataagaggtaaggttagaggttgaaaaacgttgggggttcgcagtcaggacaaagatgtgaaccacttgggcacagaagtgtgcgaagtatgacctagcacaaaatcaactgtggcttgaatcaaatttgctgttgccatgacaactcagaagcaaggaaggaaggcttgagctatagggcctagcaagaaggtaaaatatccaatgggcctcaggctccttttgtatttctgagacaggacatctaaagtatgttctctctcatgaatgaataggcagaagggcaaggagtagttggggagtcccaagctgggggaagaggaaagggaggtttttaaaaggatccaatactgttatagaggttaattctcgttctaggggttcagacaaggaatccacattctacaatagccaaccagtctgagaaagtccaggagttgtctcattgttttagataaagtgtaattaaggatgcttttcatacatctggagacaaagtttttcccttacaggagatgtcatgttttagagagtgaaactgaaaataggaaaactaaggatagtgaaattatattttgtctcttgaaaacaatgtcccttttaagtcagatcatccaaaaggtatcgagtatctgccaataaattatcaaatgtactggagcaaagaaggtggacatctacgtattgcatgacgatgcaattacaaaggaaaaccaaatcctttaaatttgcatttttaaaaatattaaacatttaggttcaggggtacatatgcaggtttgttacgtaggtaaattttgtgtcatagaggtttggtgtacagattattttgtcacccaggtgataagcaggtttcttgataggtagtttgttttgatccccactctcctcccaccctccaccctcaagtacgcctcagtgtctgttgttcccttccttgtgtccagttataagttaaaacacgtagtctttagttttctgttcctgcattagttcgcttaggataatggcctccagccccatccatgttgctgcaaaggacatgaccttttttttaatggctatgtagtattccatgatgtatacgtaccacattttctttatccagtctaccattgatggacatttaggttgattccatgtctttactgttacgaatagtgctaggtgaacatatgtgtccacgtgtctttggggcaaaacaatttatgttcctttgggtatatacccaataatgggatttctgggctaaatggtagtcctgttttaagtactttgagaaaatgccaaactgttttccctagtggctgaactaatttacgctcccaccagcagtatataagcatttccttttctgtgcaacttctccagcggctgttattttttgcggttttattaatagccgttctgactggtatgagatggtacctcagtgtggttttgatttgcatttgtctgatgattagtgatgttgaactttttttcatacgccttttggccctatgtatgtcttcttttgaaaagtgtctgctcatgtcctttgtccactttttaatggagttgttttttgcgtgttaatttgtttaagttctttatagagtctggatattagacttttgccagatgcatagtttgctaggccgtatgtttactgggttaatagtttgtggggtttttttctgtatagaagcgctttagtttaattaggtcagtttgttaatttttgtttttgttgcaattgcttttggtttcttcatcatgaaatctctgccaggtcgtatgtccagaatggtattttttaggttattttccaggatttttatggttttaggttttacatttaagtatttaatccatcttgagttgatttttgtatatgatgaaaggaaggagtccagtttcagtcttctgcatatggctagccagttatctcagcaccatttattgaatatggaatcctttcctcactgcttttgttgactttgtcaaaggtcagatggtgttggtgtgtgactttatttcttggctctctattctgttccattggtctgtgtgtctgtttttgtaccagaatcatgttgttttggttactgtagactcataatatagtttgaaattaagtaatgtgatgtctccagctttgtacttttcgattagggttactttggctattcgggctatttttttgtttcatatgaattttagaatagttttttgtaattatgtgaaaaatttcattggtagttagataggaatagcattaaatctgtaaattgctttggggaatatggtcattttagcaatattgatttttcctatccgtgagcatggaatgtttttccatttgtgtcatcttgaatttctttcagtagcgtttgtaattctcattatagagatgtctcactgccctggttaagtatattcctatgtatttattttttgtgtgaggctgttgtgagtgggattacattcttgatttgactctcagcttgaatgttgttggtgtataaaaatgcttctgattttcatacattgattttgtattctgaaactttgctaaagttgtttatcagatctaggagccttgaggcagagactattgggctttctaggtatagaatcatattatctgcaaacagggatagtttgacttcctgtcttcttatttgcatgtcttttattttttttctgttgcctgattgctctggctaggactaccagaagtatgttgaataggagtagcgagagagggcatccttatctttttctggttctcaaaaggaatgcttccaacttttacccattcagtatgatgttggctgtaggtttgcatagatggctcttattattttgtgttacgttccttcagtgcctagttggttgaggtttttaacatgaagggatgttgaattttattgaagagccttttctgcatctattgagataatcgtgtggtttttgtctttagttccgtttatgtgatgaatcacatttattgatttgcatatattgaaccaaccttgcatcccatggataaagcctacttgattgtggtgggttagctttttgatgtgatgatgaatttggattgccagtaatctgttgaaaatttttggatctgtgttcatcaaggatgttggtctgaagttttccttttttgtgtgtctctgccaggttttggtatcagaatgagtctgccttcaaacaataagtgagggaagagtccctccttctcaactttttggaaaagtttcagtaggtaccagatcttctttagacatctggtagaatttggctgtgaatccatctggtccagagcttttcctggtaggtagggatttttttttaattattactaattcaattttgggacaaggatttcaatttcttactggttcaatattgggaggttgtatgtttctagaaattttatccatttcttgtaggtttcttagtttgtgtgcactggtgcttataatagtccgtgagggttctttttcctttgtatttctttggagtcagtggtaaagtcatttctgacatttctgattgtgtttacttagatctctcttcttctttattcgtctagttagtggtctaccaatcttatttattttttcaaggaaacaatttatgattttgttcttttgtatggtttcccaagtctcaactcagttcatctctgattttggttatttcttatcttctgctagctttgggattggtttgctcttgtttttctaattcctctaggtgtgatattaggtggttaatttgagatctttctagctttttgatgtgaggatttaactttctgcttaatactgctttgggtatgtttcagagattctgataagttctttgtttttattagttttgaagaatttcttgatacctgccttaatttccttgtttacccagaagtcattcaggagcaggttgtttaatttccatataattgtatggttttgtgcaatcttctttgtattgatttctatttttattgccctcttgtcctggagtgtgattggtaagattcagtttttctgaatttgctgaaaaccatttttatggccgattatgtagccaattttagagtgtgtgccatgtacagataagaagaatgtatattctattgttttggggtggagagttctggagatgttgttaagtccatttggtcaagtgttgagttcaggtcccaaatatcattcttagttttctgcctcagtgatctgtctaacactgtcagtggaggtatcgaagtcttcccctattattgtgtggttttctaagtctctttgtagctctctaagaacttgttttatgaatctaggtattcctatgttgggtgcatatgtatttaggatagttaattcttctcgttaaattaaatcttttaccttctttgtcatttttgacttgttggtttaaagtccattttgtctgaaattagaatagcaaccctgccttttttgttttacatttgcttggtagatttttctccatccctttactttgaacctgtgggtgtcactgcatgtgagatgggtctcttgaagacagcaaatagttgggtctagttttttaactcgctactctgtgtcttttaagtggggcattttgcacctttatattcaaggttaatattgatatgtgcagtttgatactgttattgtgatatcagccggttactatgcagacttgattgtgtagttgctttatggtgtcaatggtctatgtacttaatgtgtttttttgtggtggctggcaacagtcttttgtttccatagttagcactcccttgaggacctcttgtaaggcaggtctggtggtaatgaattcccttggcatttgctgtctgaaaaggatcttatttctcctttgcttatgaagcttagtttggctggatatgaaatttctcggttggaatgtcttttcattaagaatgctgaatatatgccccctgtgccttctggcttgtagggtttctgctggaaggactgctgttaagctgatgtggttccctttgtaggtgacttgctccttctctctagctgcctttaatattttttctctcatgttgaccttgaaaaatctgatgactatgtgtcttggggatggttgtcctgtacagtatctcacaggggttctctgtattttctgaatttgaatgtcagtctctctaccatggttggggaaattctcatggacaataccctcaaatatgtttaccaagttgcttgctttctctacctctctttcagggacaccagtaagtcatagattttgtctctttacatactcctatattgctcagaggtttaaaattttttttatttaataaaatagagatggggtctcgctatgttgcctaggctggccttgaactcctgggctcaagtgatccttctaccttggcctcccaacgtgctgggattacaggtgtgagccaccatgcccagccttcttggagatcttgtttattcttttttattcttttttttatttttgtctgactgagttgattcaaagaactggtcttcaagccctgagattctttcctccacttggtttattctgctgtaaatacttgaaattgcattatgcaattcttatacagagttttcagctttatcagctcattttggttctttttttaaatggttatttcatctttcatctcttgtatcattttattggattccttaaattcaattgattgggttttttgtttggtggtggtggtggtggttgttgttgtttttggagacagaatcttgctctgtcacccaggctggagtgcagtggtgcaatctcggctcactgcaacctccgcctcccacattcaagcaattctctgcctcagcctcccaagtagctgggattacaggcatctgccaccattcctggtgtgtgtgtgtgtgtgtgtgtgtgtgtgtgtgtgtgtgtagtagagacagggtttcactatcttggccaggctggtcttgtgaccttgtgatccaccaacctcagcctcccaaagtgctgggattacaggcctgagctaccgtgcctgggcttgattgggttttgactttctaatgaatctcaatgatcttcattcctatccagactctgaattctgtatctttcatttcagtcatttcagcctagttaagaacccttgccaaagaactagtgtggtcatttgaaggtgagaagacattttggctttttgagttgccaaagttcttgagctggttgattctcatttgtgtgggctgatgttcctttgatctttgaagttgctttcctttgcatggggttttttgagtttatattcttcgatgcccttgagggtttgagtgtggtacaacatgggttcagtcaactgtctttgtttaaagtatttcagggggccaagcctcagtttatcactcctggtctgcatgttctaaccctggggggctagtattgggctctagctttgttctctggcccttcgaggttagaaacttgctgcaataagaggggctaaggtgttcctggctcactggccataacactctgctggttgggtgctggccaaagtgctttgttgtggcagtggcagtgggatccgtgcttacatgtgtgtgccagcagccacagcagcacagtagggtgcctgcacatcagcagtggcagggcaccagtgggggtggggtggcagcattcatgcatgcactagcgctggtggtgatggcatggtgggatatgcatgcgtcagtgggaaccaggcactagtgggggtggggtggtggtgtctatatgcgtgcttgtgctggtggtgatggggtagcagggtgtgcacacatgtgctggcaggggaggggaggtgagatctgcccacactcatactgacaaagctgtgagcatgggctgtgggtgactgtgtgctggaaaagtggtgggaggaggctgcagtggggagaggctgcaaggtggttgattgcacaacagtggaaactggcctgctggagccagagttaggcatggtgagcaggtgaaggaattattatgacggcccttggaagcaccctggtttggcatctgagtctgtgctgcaagcagatgcagcagggctggagccccaggagaggctggtaaacaggggcacactcagatcaaactggtcccattccatgggcaagacctcccttctctgtctaggtctggcagccaccaaaggccaaagccacctagaggagctttcttccagcttcagttcagggtctgcgtcttccctctgtccactctcaatgccttccctctgaaggtctgcttggagtatggcagtcttccctatggtctggtgtctcagtgagtgatgctcttcctggctgcatctagtcagccatcattggctcctctctaaatttgcatttaatgtctgggaaaaaataggctgttaatctttgaggcataatagtccaagtgtaccgctaatttccccaggtgtgaaaatgaataaatttaaaagctgttggaaccccaaagaacacttttaagccttgatagagatgtgactgtgatctgagttatgtatggtctcagcttctgttctcagattataatcataggttaactcgttttcttatttttcttgatctgttcaatgactagagagaattaaatgatggcagggacaaaagcttcctgccttcttaattaatgactgttgttgtagattaactcccctttattgtcctgatttgcttagacaagatgacagaaaacccacgattattacagcctttgcaaaaaaaaatgttaaatgtactcttactcataagaaacactgcatataactaatcagatttctgtgactatctatgtgcaaaccctgtatgaataatgcaaccctgctaaaaactcctctgtctctgcctatctaaacgaaatcttaacttccctgcttcggattgctgactctattcctttggagttgggatttctgggtgggccatcctcacattctgtgtgtgaatgaactctctttaaactagactctgactcttttaattattttaggttgacatttgataacctgcagatgggacctgaagtaagccttctgcaatcttcactgctttgctgacatctggagctttggtacagcacaagtggcttttacttctttgacttcattggacctggagagggtctctggcctggcttctctcagattttgaatctctctggttttggctgagattcagactttattgaagcatcctgattccacgctcaagaaaactgaaattgaagctttacttttaaaagtaggagtttcatttgttatttctctagagattctgtggtttgcagatttgtgctttcacattcctttgaggataaggttttgttttattcccaaaacttttcagccttttcccttgttcaactttggtgaaggagaaagtgtttctctttgaaaagaggaagcaaatctttgtggctcaaattaaatttgtgattttatattttctaggttctgaagcttggttcagctgacatagctaaactcttcttgagtgaccagaatttccatttccacggtcttcggtcacttaagagaactcaaattatggactattgtccctccaaaatcaagtctttctccctaaggagagatccacctttagaaactccagctgcactcatgtatgaaacttatggtgccacttcttgtcattatttagaaaatggttgcacataactcatgaaaaactaaaattgcaatggccaaagtgggatacctcaactaatttacctgtgtgctcaataagaaaaagctggttctaggataaaacagaatagttaggagagttcttttcaatggtatttaaaacatccaaaagagattttaatagagttacttctttacaaaaggagaataaaaagttacctaaaacaatttccaaatttaaaaagacagctgaaatttctcctcctcctccctcacctcctccttctctttgtcctttattacctgggctactttacctagaacgacctcttctttctcctccccctgcttctgctctggttccatccctggaacagccagtgtctggtagggattaacctgccctagtgtatcagtcacggtagaacttaaaggtagaattaaggaatttcctgatcctcactaggaccctgtgagtcctagtcttctggttttgccagaaaaatcgcaattaaatatttgagcttatgaccctggctctattttaagatgaataaaaattactttaaatggagaactaacacaaactcttattaacagacctggaatcaccttatctgtaataaagtccaccttattacaaggtcccattccttgaagtaaacaaacaattcaatctgtagttgtcacaaatactctaagagacttcttagaattatttaatacctacatttctttctccccaagaggaaaatgtatttagaattagatgataaaactgaattattggacatacttttgtcaacaatccatattgacatggaagacactaaattattgagtagtaaaaaattataaaacccactaaatgtagtacctaatcaatcatggttaaagtcttccactgattttggaaaatttatcttgcctaccccaatcaaagttcaatagattcatcaaaaccccttccaaaccttaaacaataccctctaagaactgaagccctaaaaggtataaagcctatagtttcagattatttaagaataggacttgattattccctgtaacagccaatgtaatactccagtccttcctgtaaggaaatcaaacgatagaggatggaggtttgtacagaatctgacagcaattaaaaacatagtcactctttgacatccagaagggccaaacttccatatgttgttgactgacatcccaactgaacctgagttcttttctttttactttgagacagggccttactctgttgcccaggctggagtgcagtgtgattatagctcactgaggcctcaatctcctgggctcaagcagttctcccgcctcggcctcctgtatagctgggactacaggtgcgcaccacaacacttggctactttttgtatattttgtagagatggggttatcccccttgttacccaggctggtcttgaactcctgggctcaagccatccacctgcctcggcttcccaaattgctgggactacaggcatgagccacctcgccggctgaagctgagttctttactgtaatagacttatgtagtacattctttaatatttctgtagataaaaataatcaatttctcttcaccttcacttgggaaggaagacaatacacatgaatagtcatgcctcagggatgaactgagagcccagcttacttttcacaaatattaaaagcagatctcccagatattgacttcttgaaaattcattttaataaaatacacaggcaatttactcctctgctcagaggataagcaattatttcttaaaaatgggattcacttgttacaacaattagactcaaagggacacaaagcttctaaagaaaaacaccgcctgtaatcccagcactttgggaggccgaggcgggtggatcatgaggtcaggagatcgagaccatcctggctaacaaggtgaaaccccgtctctactaaaaatacaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaaaagaaaaacaccaatcctgtcaaaaacaagtgacgtgcttaggccacctaatatttaaggaaggactttctattagtccataccgactgaaaggagttttagctcttctgccatgaagaaccaagaaacagctgggagagttctgggggctggcaagacatttaaaaacttggatcccaaacttttctttaaaagcctgccccttggccggacacagtggctcaggcatgaggcctgtaatcccagcactttgggaggctgaggcaggtggatcacctgaggtcgggagttcgagaccagcctggccaacatggtgaaaccctgcctctactaaaaatacaaaaaaaatagctgagtgtggtggcgggagcctgtaatcccagctacttgggaggctggggcaggagaatcgcttgaacccgggaggcagaggttgcagtgagccaaggtcgcgccagtgcactcaagcctgggcaaaaagaataagactccatctaaatgaatgaatgaatgaatgcctggcccttacatgcttcttttaaacaggacattccagaccctcttgtttggacagaagaaaatcaagaaatgtcagaaatgatcaaaaatgactttactaatgcccaagctttggtgcatgcagattataatcttctattttcagtatttgtacatgaaagtgatggaaagattttaagggtcctgactaaaaaacatggagcccaaagagacctgtggggtattgtagccaacagttagactctgtaataagaggatttccatcttccatgagagccgtaaagcccctgctttgttagttgaagcaactgacgaaattctcatggtgacagcccttagtggttttgtttctcattcttgtgaaagcatttgctaaactcgcgtcatactcaatattattcagttagtagactagtctcatacgaagttttctttctttcagcttctcatatcaacatctctagatgtaataacctaaatcctacaactcttctgtctccatttccagataaaacactgcactattgcataaccctaactgatcactgatcaacttctttctcccaggactgacctcaaagagaccccccttactactgccaatggtgtttggtttacaaatggatcttacttaaaggataaatctgggacttaccactcaggttatacaatagtatctttaactggggggaaaaaaagaaggaggagaagaagaagaggaaagtgttaagcttctaggcaccacctgagctcaacaaacagaattaattacattagtcaggacttgtcaattggcaagaggaataactgctaatattaatatagagagtagatatgtttttagagtagctcatgattttgaaacactatggaaacacaggatttttaacttcttctggtcagtccttaaaaagtggccacctcatttcatgatttttgaaagctatattattaccacagtcactgtttataattaaaattccaggccatttcaaatcagatatcccagaaagcaaagaaaattagctagctgataaggtagcaaaaagagtggctctaaacaaaaacactctgtattaactcttaaacacctgaatttgatataaaattagctcaatccagagctccaaaatcagaatacaaaatcacactttgtgcttgaataaactccctttaaattagactctgattcttttgattattttaggttgacgcaggtgaaggcaaatagatgctgtgattcagggcagaggaatttactggagaaggtggaaacatgagtcaaccgtgaagtaattggtgtcagggagtattgaaatgaggatggttttagggttagaaactaaagggaatccaggcttcattagtttgtttatggcttgcaggtattggactatttaatattcttcccattaagcttttgaataggctttatttatttttctgagacggagtctcgctctgtcgcccaggctggaatgcagtggcacaatcttagctcactgcagcctccacctgctgggttcaagtgattctcctacctcagcctcccgagtagctgggactacaggcgcacaccaccatgcccagctaatttttgtatttttagtagagacagggtttcaccatgttggccaggatggtctcgatctcttgactttgtgatctgcctgcctcggcctcccaaagtgctggaattacaggtgtgagccacggtgcccggccaataggctttattttttagaacagcatttgatttacagaaaaattgagtatatagcacagagaattcccacatatccctgttcctctttacacagtttcgcctattattagcatcttgctttagtgttgttacagttcatatactttacattgttaaatatagtctatttaaagactatagtttatattagttcactcttggtattgtatggttctaagggttttgacaaactcataatgatttctccgttacaagatcatgcagaatagttttacctcctaacactgtctatgttctacctattcattcctctccagctctctccaagcctctgccaactgctgatctttttactgtctctatagttttgtcttgtctagaatgccatcagtgtgaagttcctccatgtcttacttttttcttaaactcagtggcaagaagctccatgtcttttaattgtgtgatagctcattttaaaagttgctgaatcgtattccatcgaatgactgtactacagtttattcactcacctattgaaggatatcttggttgcttccagttgttgacaattttgaataaaaccgctataaacatttatgtgcaggtttttgtgctgaaataagtagttaaatatctaggagtacaactgctggatcagatggtaaagctatatatttagtttgtgggaaacttccaaattttccaaagccactctgccatcgtgcattcccaccagcaataaatgaaagttcctattgctcttcatccttgtcagcatttggtattgacactggtatctattgtagtttgtttatttatttaatttttagtgtttgagacagggtcttgctctgttgctcaggctggagtgcagtggcacaatcatggctcactgcagcttccacctcctgggctcaagcaatcctcctgcctcaacctccagagtagctggacctacagacacatgacaacacacatggaaaatttttaaatttgttttgcagagatggggtcttgttgcccgggcttcttgacctcctggtctcaagtaatcctcccacctcggcctcccaaagtgttgtgactacaggcatgagcttctgcacctggcttcactgtagttttaatttgcaatttcctaatggcatatgacttgagcatcttttcctatactcatttgccgtatgtctaccttctttcatgagatatctgttcagatcttttgcccttttttttttggttttttgttttgagacagagtctcgctctgtcgccgaggctggagtgcagtggcactgtgtcagctcactgcaacctgcgtctcctgggttcaagcaattctcctgcctcagcctcctgaatagctgggattacaggtgcccatcaccatgcccagctagtttttatatttttagtagagacggggtttcaccatgttggccaggctggtcttgaactcctgacctcaggtgatccgcccgccttggcctcccaaagtgctgggattacaggcgtgagccaccgtgcacggcctcttttgcccatttttaagtttttattcttaattgtgacaaaatatacataaaatttaccatcttaatcatttgtaagtgtacagctcagtagtgttaaatacattcacattgttggcagtcattctccagaactcttcgtcttgcaaaactgaaactattcccattaaacaactccctattctgcaacttgccctcctccccctagttcccagcaaccaccatttgttatgggaaaaagccagaacagtatagaagcaagttcccccatactgggaaggagccaagacaccaaagaatgacttagataagttcagtttgaggagtagatgagtttattgggacttacctacagggtactcctgggcagcagcaaggcagcaggacaacatggaggtctgctctgccacctgtctgcttttcatttatgatctatttatttttactttaaaataattttatttttttgagacggagtctcgctctgtagcccaggctggagtatggtggcactatctcggctcactgcaagctccgcctcccaggttcatgccattctcctgcctcagcctccccagtagctgggattacaggcgcctgccaccacacctggctaattttttttgtatttttagtagagacggggtttcaccgtgttagccaggatggtctcgatctcctgaccttgtgatcgacccgccttggcctcccaaagtgctgggactacaggcgtgagccaccacgcctggccaactttaaaataattttgtattaattttcgtgggtgcgtagtagatatatacctactcatatacctcatagtaggtgtatggggtatatgagatgttttgatattggcatgtaatacataataaacacatcatggaaaatgaggtattcatcccctcaagcatttattctttgtgttataaacaatccagttatgctcttagttattttaaatttatttatatatatttatacatttatttaatgtgtaaatattattgactatagtcacctttctaagctgcttttttttttttttttttttttttttttgggagacggagtctcctcgctctgtcgcccaggctggagtacagtggcccgatctcggctcactgcaagctccgcctcccaggttcacgccattctcctgcctcagcctcccgagtagctgggactacaggcacccgccacctcgcccagctaattttttgtatttttagtagagacggggtttcaccgtattagccaggatggtctggatctcctgacctcgtgatccgcccaccttggcctcccaaagtgctgggattacaggcatgagccaccgcgcccggcctctaagctgcttttaggctaattttctggctcttttcctactgtgtgtgcgcaatgggactgttttccttggtatgctctcagatatactctgggatgtttcggttctcagggatacctgctccttgggtgggccactgactcactgcctagctttcagggttcaggcagcagacatagatccttaagtaatctggtgggtgactcatcacactacactcagccatttcattttcttatagcagtgtctaatcttaggtgttgtacatggaaaacaaaggcgttacaggaactgcaaatagggatgcggaaccttttgtcaaggaatccttgaataataaacagatctgagaccttcacttgcttcagattttgaaggaaactgggatagtccatggagggggaatggtggagtctatttctacttttaagggccctacttccccaatatgtctgttgatcctgtagccaaagaaactgatggatgtgagtgagcatgttctgagtgagggatgccaagggcttggggaattatggggggagcaaggaaacgggtgatctatcagagctgttggaggataaaggccagggggaaggagttccagaacttcaggaattagtacgtcggataaacaaaaatattaacattccaaatagaaagtaaatccctgctaatagattaacagggattgtgaaatttaacaaaaagctgtgttgggcatgatggagtccaagagacaccaaaaggggcttagaaagaggcaaatcatccacccccactactgaggcattatggtaaggaattgtgagggttaagggtagagtaggtggttctagtatctattagaaaggtcatagggtgctcactgactgggattattatttctccctgtgtgttcaagggtatcagggggtgcacaagagcagattcctcaaaggggagtcactgggatgctgacgtttttctttttggaccttgagataattacaggtgctccagactactcatgatcgtagggatgtcgaggtgacttcaaggccttggggtgattccccatgagttgtttcagttggagatccatgagtttgcatttttcagattatttagatgcctgtacatcttttgggtttctgctaaaacatggatcttaaagagaggggcattttggcagtggtacctttggccagttacttaagtggaatttcattctctcttggcttccttcacagatgatgtatgaaagcatgaaattcaaagagacaaagggaaattgtgtaaaaagcagatcagccctctgctttactcttaccttctaggtccacaaataggtataacttgaattaggacaggtggagaggagcatataattaatacgatgttaattagtatgagtaaactctctgagtttagtatggagctcattaacaaaactggtaactaaagcagatgccgtttagagttaaacctgggtaatctttccagttgttttctaagtggtattcatagacagagactaattcatctctttgttgtcggtactcttaagtctttgatgagttgattttagttgagaaggctgtggaaatagaatctgaaagcttttctctgatttctccatctgtgatagcccctaggtgttttgagatttaactgtaggtcttcattaattttggtactctcaaaccctagggaggcatctctaggtcctataagaagtttgaataattagtaaagatcttaaagctctagagaagatgcccctaagattgactaacttgtgtaaaaaatttctcccttcatggccgggcacagtggctcatgcctgtaatcccagcactttggaaggccgaggtgggtggatcacttggggtcaggagtttgagaccagcctggccaacctggtgaaaccctgtctctactaaaaatataaaaattagccaggcatggtggcatgtacctgaaatcccagctactcaggaggctgaggcacgagaattgcttgaacctgggaggcagagtttgcagtgagccgaggtcatgccactacactccagcctgggcaacagagcaagactccatctccaaaaaaaaaaaaaaaaaaaaaaaaaaaaaaaaaaaaaaaaaaacaagaaagaaaatttctcccttcattgtatgtagtttcattttcaaaactacagtttcaaaaggccacaacatgacaaccattacaattgatgaccccgaggtggtccattttgtgcactggtcttcttcatctttagttacaagctcagcttcctctctaagtcttgaggtatccttgtatgtaatgatgatatcatttgtcgaatgcttattaaattgtatagactgtgttaagagcaagtttgcacagtaacccttttaatcctcaagtatctctatgatgtaggttttagtattttgattttatagataaggacatagaggctgtatcctcagtaatatgtcatgggtcacacagcaagttaggggcatggccagaatgtgactgaagtgtgttcagctcaaaaccctatggccttaactactacaccagtctttctccattatctcatcctctgagatgcttcccatgaggcagtctcaaactcttaagtccaactcaaagaaaatggcttatctgaatatggtttaatactgttttgatttagaggattttcctattgcctaaaggctttgcagtggtgagaatgggatgggaattcccaaagtcacctggacaagtttaatattaatttttgtgggtacatagtagatatatatacttatgggttacatgagatattttgataaagcatgcaatgcgtaataatcacatcagaatggagtatccatctttgctaaaggataaagcatttatcctttatgttacaaaaaatccaattatactcttttagttattttaaaatgtataattaaattattttttactatagtcaccctgttgtgctagcaaataataggtcttactcattctttcttgccaagaccagctcggtcggggagaccctaacccagtggcactagaggaattaaagacacacacacagaaatatagaggtgtggagtgggaaatcaggggtctcacagccttcagagctgagagcccccgaacagagatttacccacgtatttattaacagcaaaccagtcattagcattgtttctatagatgttaaattaactaaaagtatcccttatgggaaacgaagggatgggccggattaaaggaataggttgggttagttaactgcagcaggagcatgtccctaaggcacagattgctcatgctattgtgtgtggcttaagaatgcctttaagtggttttccatcctgggcgggccaggtgttccttgccctcattccaataaacccacaaccttccagcttgggtgttaagggccattatgaacatgttacagtgctgcagagattttgtttatggccagttttggggacagtttatggccagattttgggggggcctgctcccaacatgtctcccttctttgatttgcaaagagataaaagcaaaggcagctttgtcacagtgagctacttctcacaggagtcaggatccacatctgcacactatacaaagacaaacaacatggattaaaagcacaatcatcattgaaatacagagcttccaagtgtttttatccattctaatgggttactagctgctaatttgtctgcagctcctttaaggactccagttcctggcattaaggtcaggtgtgcctgggatgctttaaatatttgttcttttaattttgccatatccaaaaacaagtttgtagagtgtccttctagatgcctttttattctttcccaaattttgatcttattaagaacatctaatagtttccacaaatccttatgttaagcttctagagcaggccatatcatttgaggttgaggtgccactataccgccacggttccagataataggaacttttgccatacttcttatcatttctaccatctgaccgttttgttcagatcatctgaacatagtgtggccatggcacgcagactgagaggtgcaattcaagctaaacatccccttagggtaccaattaataatgattccataggaatcattgtgcagcacctctgtctgttctgcaaagcaatcttcctaaacaagtacgttcatctttttctaactgggtccaatcctgtttacaaaaaggtttttgaggatggtatgcctcaattatatgagcagatttattatggtaaatactgagatcagaaagcatgtgtaactgtgtcagagtgattgcatccaggcattattgccggccaagattgataaatatgcccaataagtataactgttctctgtgtcagcccctgttgaaggaatactcatggcagtggtgataaccgctatcatagctaccattaaattattcattgtgactggttgtcccgctttcctcaggttttcttccgccatctgtgacagcttcttgatctgtccccaggtgggtggctgtgtttgacgggtgttgctcgtgacaattggggtcctcctcagcatcagtcttgacatggctgcaactggggggtcctcgggatcctcctgtaatctggcttatgctaaggtttcaggtgtattgatggtatccagatcagctgttgattttggcctggagaaacacaagcataacctctaccccaggttatcttcttttcaggtaatgctgtatctgcgtttgagaccagaggcattaacatgggttaaattgtgagtgtctagcattagatattgcattagcaactaggcgatcagccatttgattcccttcagtcaaagatcctggaagaggtatatgagccctaatgtgagtgatgtaaaaagggtgcattctacgtctaactgctgtttgcaattgggtaaataaagtcatcagttgtgtatctgtatgaaatcataactgagcatttttaattaactctgttggaatgaaccacatatgaagaatcagaaatcacattaataggcacatcaaaagcagtcaatacctcaattaccactacaagctctgctttttgagctgaagtataggacgtctggaaaactttactttttgagccaaaataagaagctttaccattactagacccatctgtaaaaacattctcagccccttcaattgatttaaacttagttattttggggagaatccaattagttaatttcaaaaactgaaacagcttcattttaggaaaatgattattgagaatacccacaaagtcagctaaatgggtttgccaagtaagactttttataaaagcttgctgtatttgtgccttcgtgagagggacaataatttttctaggatcatatccatgtaatttaacaatctgagttctcctactccctatagtagtgatttgatctaaataaggagttagagtccatgaattagtatgtggaagaaaaagccattttactaagtcctgttcttggacaataacaccagtgggtgaatgctgagttgaaaaaattagcaaatctagagtcttctctggatctattctatttatttgagctttatggacttgcttctcaatcagttgtaactctgcctctgcctcgtttgttaattgccaagggctagtgagactaggatttcctctaaggatagaaaacagattactcatggcataggtaggaatgcctagagcaggtcgtatccaattaatatcccctggtaatttttgaaaatcatttaatgtttttaatttatccctaagtatggttactttctgtggcacaatggtagtgtcatttactaaggtccccaagtaagaataaggagtagtagtctgaattttgtcaggagctataattaaactaacgcaagaaatcgaattttgcaagtgatcataacattggagtaatatttctcgagtggggcagcacaaagtatatcatccatatagtgaataatgtaacactgtaaaaactttttacgagtaggttcaattgcttgccccacatatgtcaggcaaattgtggggctatttaacatgcccctttccaatgaatacgctttccaatgaatacgcttagcaggctgcaggttgtttactgcaggaattgtaaatgcaaactgttcacagtcttgctcagctaaagggatagtaaagaaacagtcttttaaatctttgactatcaaaggccaattttttggaattatagcaggagaaggcaatcctggctgtaatgctctcataagttgtgtaactgaattgatgtctcttaagtcagttaacattctgcatttacctgattttttcttaattacgaaaactggagaattccaaggggaaaatgttggagctatgtgcccattttctaattgttcagtaactaatttatctaaagcctccagtttctctttacttagcgtccattgttctatccaaattggcttatctgttaaccattttaaaggtataggttctggaggcttaacaatggccgccatcaaacattatttcctaatttttggcgagaactttgtttttccacttgaagcagttctttcaaaccttgcaaatttttttctagtcccataccagggacataccccatttcatgcattgtatgttgactttgagggctatataattgttctggaattagaacttgtgctccccattgttgtaataaatctcttccctataaatttacaggtacagaagttataattggttgaatagtcccaggttgtccatcaggcccttcacagtgcaaaatataactactttgatatacttcaggggctttaccaactccagctatgttaaattgagcaggttgaattggccatgcagatggccagcgctgtagagaaatgattgaaatgtctgctcctgtatctaccaaacctttaaatttctttccctgaatagttatttcacaggtaggacgtttatcagtaatttgatttacccaataagctgctttgccttgtttatttgtgcttccaaatcctcctattcgtttaatttcactttttcccattcccacatacggcaaaatcaggagctgtgctatgcgctctcctggctctgctctccaaggaacagaagtagatgtaacaatttgaatttccccattataatctgaatcaatgactcctgtatgtatttgtatgccttttaaacttacactagaccttcctaaaagtaatcctatcgtccctgctggcaagagtccacagactcctgctgggaccttttgcgggggttccccaggcagaaagctcacagcttttgtgcagcataaatctactgtggcactaccagctgtggcgggggacagacattgtacagcagtgagggaaaggcctgagctggaaatgccccggtttagaatggggcccgggatgggcccctcatggcatttcccgaaattgggttcccttctttatcaaacttagagtgacactgattagcccaatgttttccttttttacattttggacatatttcaggatcagcagttttcttttttcccctaactgacggcctgactcactgattttttctacattctatttagtatgaccatgcttcccacagttaaaacaagttccaggaaacagagtatttcctttatccactctcagtcctgctattgcctgtgctagcagagtagctttatgcagattacctccaataccatcacaggccttgatataatcaactaaatgtgctttccctctgataggtcgcagagcagcctggcaattgggattagcattgtcaaaagctaataactgcaacactatgtcctgagcagccgaatctgcaatcatctttttaagagacttctgtaaccgagctataaaatcaatgtatggttctcttggtccctgttttatagcactaaaggaagggtattgttccccacctgaagtgattttttcccaagctctaatgcacactcctctaagctgttctaaggcatcatcctgcatgaccagttgtgcatcaaaaccagcccaaccaccaacccccaaaagttggtgtgcagttatattaatttgaggttgggcctgggcattgtgagaagccgaatggaagcttcgtctgcccaccaagttttaaattgtaagaactgagcaggggttagacaagctcgagtaagagcatcccagtcagtaggaatcatctgactggaaacagcaacattctttaacagtcccattacaaaaggagaacctggtccatactgatttatagcttgtttaaattatttgagtaatttaaaaggaaaaggctcaaatgtggctataatatttcccttttgattgggggtgggaggggtgtattctaacagggaactgccaagcctctaaatcaccctctcatctagcttgctgaattcctacctgaatagaactaaaagcagtcgcttgaggcgctgctcaaatagtcacaggggcaactacttttcgccccgtgtcctccggaaaagaaagatctggagggtctttttcttcaaaataataatgagggggtgcagaagggtagggatgaacctctccttcctttgctgctttagctggtaaatgaacatgctctgtaacctcttctgttacttcactatactctccttcctcctcatgatcagtgtgaaaaagttccaagatggaatgaaccagaccccacacttgtcccattgttacccttccaagctccccttcttactcaccacggggattgctttaagagtactcctgtgtcctccagctggttttccattccaactgttgctctggcgacccttcgacctggatttgagcccccacgaatggacaccacttgccgagaccagctcagtcggggagaccctaacccagcagcgctagaggaattaaagacacacacacagaactacagaggtgtgaagtaggaaatcaggggtctcacagccttcagagctgagaaccccgaacagagatttacccacgtatttattaatggcaaaccagtcattagcattgtctctatagatattaaattaactaaaagtatcccttatgggaaaagggatgggctgaattaaaggaataggttggactagttaactgcagcaggagcatgtccttaaggcacagatcactcatgctattgtttgtggcttaagaacgcctttaagcagttttccgtcctgggcgggccaggtgttccttgccctcattcccataaacccacaaccttccagcttgggcgttagggccattatgaacatgttacagtgctgcagagattttgtttatggtcaattttagggacagtttatggccagattttggggggcctgctcccaacactttctaatttttttgtacccattgaccatctccattccccacgccctacccactccccccaccacattatgcttcccagcctctggtaagcatccttctactctctacgtctatgagttcaattgttttaattgttggctcccacaaataagtgagagcatttagtctgtctttctgtgcctgactgatttcacttaacataatgacctccagttccatccatgttgttgcaaatgacggaatcttatttttttatggctgaatagcactccattatgtaattgtactatattttctttattgattcagctgttgatgaacatttagtttgcttccaaatcttggctattgtgaatagtgctgcaagaaacatgagagtacagatacatcttcgatattctgatttcctttctttcgagtatatacctagcaatgggattgctcaatcatatggtagctctacttttagtgttttgatgaacctccatagtggttgtattaatttacaatcccaccaacagtgtacaagggttcccttttctccacatcctcaccagcatttgttattgcctgtcttttggatataagccatttttaacctgtggtaagatgatttctcattgtagttttgatttgcatttctctgatcagtgatgttgagcaccttttcatttacctatttgacatttggatatcttcttttgagaaatgtctattcagatattttgtctgttttaatcagattattaggttattttcctatagagttgtctgagctccttatgtattcttgttattaatcccttgtcaaatgggtagtttgcaaatattttcacccattatgtgggttgtctcttcactttgttgattgcatcctttgctatacagaagtttgtttttttttttaacttgatgtgatctcttttgttgatttttgcttcaattgcctgtgcttgtggggtattactcaagaaatttttgcccagaccaatatcctggagatttccccctatgttttcttgtagtagtttcatagtttgagaacatagatttaaatctttagacttaagtctttaatgcatttgatttgatttttgtatgtggcaagagataggagtgtagtttcattcttctgcatatggatatccagttttcccagcaccatttattgaagagactgtcctttccctgatgtatgttcttaacatctttgtcaaaaatgagttcactgtagatgtgtggatttatttctgggttctctattctgttccacttgtctatgtgtctgtttttgtaactctaccatgctgttttggctactatagctctgtagtataatttgaagtaaggcaatgtgattcctccagttttgttctttttgctcaggatagctttggctattctgggcttgtgtgtgtctgtgtgtgtgtgtgtgtgtgtgtgtgtgtgtgtgtgtgtgtgttcccatataaactttaggattgttttttctatttctgtgaaaaatgtcattgatattttgatagggattgcattgcatctgtagattgctttgggtagtatggacatttaacaatattgattcgtctaatccataaacatggaatatctttccatttttttgtatcctttaaaatttttttttagggccccataactttgagtatagttttattctgaataaagtgaatatattcttttcgtgtgtttatatgtttatacaaaagtagatgaacagatgtaggcacaattgaaataaaaggaaattctttaaaatattaatattgtattattaattgatgagattataggttatttgaaacgtcttttttatagtttttgttatctttttttattatactttaagttttagggtacatgtacacaacgtgcaggtttgttacatatgtatgcatgtgccatgttggtgcactgcacccattaactcatttaacattaagtatatctcctaatgctatccctcccccctcccccaccccacaacaggccccagtgtgtgatgttccccttcctgtgtccatgtgttctcattgttcagttcccacctacgagtgagaacatgtggtgtttggttttttgtccttgagatagtttgctgagaatgatggtttccagcttcatccatgtccctacaaagaacatgaactcatcattttttatggctgcatagtattccatggtatatatatgccatattttcttaatccagtctatcattgttggacatttgggttggttccaactctttgctgttgtgaatagtgccgccataaacatacgtgtgcatgtgtctttatagcatcatgatttctaatcctttggctatgtacccagtaatgggatggctgggtcaaatggtatttctagttctagatccttgaggaatcgccacactgacttgcacaatggttgaactagtttacagtcccaccaacagtgtaaaagtgttcctatttctccatatcctctccagcacctgttgtttcctgactttttaatgatcaccattcttactggtgtgagatggtatctcattgtggttttgatttgcatttctctgatgaccagtgatggcgagcattttttcatgcatcttttggctgcataaatgtcttcttttgagaagtgtatgttcatatccttcgcccactttttgatggggttgtttttttcttgtaaatttgtttgacttctttgtagattctggatattagccctttgtcagatgagtagactgcaaaaattttctcccattctgtaggttgcctgtttactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccactttgaattgatttttgtataaggtgtaaggaagggatccagtttcagctttctacatatggctagccagttttcccagcaccatttattaaatagggaatcctttccccatttcttgtttttgtcaggtttgtcaaagatcagatggttgtagatatgcggcagtatttctgagggctctgttctgttccattggtctacatctctgttttggtaccagtaccatgctgttttggttactggagccttgtagtatagtttgaagtcaggtagcgtgatgcctccagctttgttcttttggcttaggattgacttggcaatgctggcccttttttggttccatatggactttaaagtagttttttccaattcagtgaagaaagtcattggtagcttgatggggatggcactgaatctataatttaccttgggcagtatggccattttcacgatattgattcttcctacccatgagcatggaatcttcttccatttgtttgtatcctcttttatttcattgagcagtggtttgaagttctccttgaagaggtccttcacatcccttgtaagttggattcctaggtattttattctctttgaagcaattgtgaatgggagttaactcatgatttggctctctgtttgttattggtgtgtaagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaatacccttgatttccttctcctgcctgattgccctggccagaacttccaacactatgttgaataggagtggtgagagaaggcatccctctctcaagacagggcatccctgtcttgtgccagttttcaaagggaatgcttccagtttttgcgcattcagtatgatattggctgtgggtttgtcatagataccttattattttgagatacttcccatcaatacataatttattgagagtttttggcataaagccttgttgaattttgtcaaaggccttttctgcatctattgagataatcatgtggtttttgtcgttggttctgtttatatgctggattatgtttattaatttgcgtatattgaaccagccttgcatcccagggatgaagcccacttgatcatggtggataagctttttgatgtgctgctggatttgttttgccagtattttattgaggatttttgcattgatgttcatcagggatattggtattaaattctcttttttttttgttgtgtctctgccaggctttggtatcaggatgatgctggcctcataaaatgagttagggaggattccctctttttctattgattggaatcgtttcagaaggaatggtaccagctcctccttgtacctctggtagaattcggctgtgaatccgtctggtcctggactttttttggttggtaagctattaattattgcctcaatttcagagcctgttattggtctattcagagatccagcttcttcctggtttagtcttgggagggtgtatgtgtcgaggaatttatccatttcttctagattttctagtttatttccgtagaggtgattatagtagtctctgatggtagtttgtatttctgtgggatcggtggtgatatcccctttatcattttttattgcgtctatttgattcttctctcttttcttctttattagtcttgctagctgtctatcaattttattgatcttttcaaaaaaaccagctcctggattcattgattttttgaagggttttttgtgtctctatccctttcagttctgctctgatcttagttatttcttgccttctgctagcttttgaatgtgtttgctcttgcgtctctagttcttttaattgtgatgttagggtgtcaattttttctttagttaattcttacgtattatattttatttttaactattgtaaataggattactttcttaatttctttttcagattgttcgctgttggcatatagaaatcctactgatttttgtatgttgcttctgtatcctccaattttaataaatttatcagttttaatttggtggagtctaggtttttccaaatataagatcatatcatctgcaaataaagataatttgacttcttcctttccaatttggatgcccttcatttctttctcttatctgattgctctagctaggacttccagtactatgttgaataacagtgatgaaagtgggcatatttgatccttgagcagtcttattgaaaaagaaagaaaaaataaaaaaagaaagtggacttcgttgtcttgttccatattttagaggaaaggctttcagttttccccattcagtgtgatactagccataagtctgttgtatatggcttttattatattgaggtatgttccttctatatcttgtttattgagggtttttatcatgaagaggtgttaaattttatcaagtgctttttaatcatcaattgaaataatcatatgtcttctgtccttcattctgttgagatgatatatcacattgattgatttgcatatgttaaaccatccttgcatccagggataaatctcacttggtcatgatgaatgatctttttaatgtattgttgaatttggtctgctagtatttgttgagaatttttgcatcaatattcatcagtgaaatattggcctgtagttttattttttggtgcgtctttgtctgcttttggtatcaggatagatctagcctcatagaatgagtttgcaagtattcccccctcctatactttttgtaatagtttgagtaggattggtattaattcttctccaaatgtttggtacaattcagcagtgaagccattgggtcctggctttttctttgctgggaaaatttttatttttttattaacagtttctatctcataccttgttattagtctgttcaggttttggatttcttcctggttcaatctgggtaggttgtacatatgtaggaatttatcaatttcttctagattttccaatttattggcatatagttgctcataatagccactaatgagcctttgaatttctgtggcatttgttctaatgtctcatttttcatttctaatcttatttggctcctctctcttttttttcttattctgtctaaagatttgtcaattttgtttatcttttcaaagaccaactttttgtttcattgatcttttgtgctactttatttcaaaatctttaattctgctctgatttttattatcttttcttctactaattctgggtttggtttgctcttgcttttctagttctttaagatgcattgttaggtaatttgtttgaagtttttttttctttttcgatgtagatgcttttagttataaacttccctcttagtacttcttttgttgtatcccataggttttggcatgttgtgtttccattaacatttgtttcagaaaacttttcaatttcccccttaacctcttcattgacccactggtcattcaggagcatattaatttccatgtatttgtatagtttctaaaatttctccttttattgatttctacttttatttcattgtagtcagagaagatgcttgatattatttcaattttttgaatgttttaacacttgctttgtgacctaacatatgatctatccttgagaataattcatgtgctgaggaaaagaatgtgtattctgcagctgttggatgaaatgttctgtaaatatttatgaggtccatttggtctatagtgcacattaggtgtgatatttctttattgattctctgtctggaagatctctccagtgccaaaagtggggtgttggcgtctccagctattattggtctgtctctttagctctggtaatctttcctttatatatctgcgtgttccagtgttggatgcatatacatttgtaattgttatcctcttgctgagtcgatccccttatcattatataatgaccttctttgtctcttcttatagtttttgtcttgaaatctattttgtctgatgtaagtgtagctacttctgctcctttttagtttccattggtatggaatatctttttacatcatttttagtctgtatgtgtcttccataaatgaagtgtgtttcttctaagcgacagatcactgaatcttcattttatgtcttttgattggagagtttagtacatttacatccaatgttattactgataagtaatattcatgccattttattatttgttttctgattgttttgtggtcttctcttcgtcctttcttcttgtcttccttttagtaaaggtgattttctctggtggtatgatttaatttcttgctttttacttttgtgtctatttgttgtatgtttgtgatttgagttaccatgagattttccagcactattttataagccattattttaagcttatcactgttatcacaacctaatagtgcttgcataaacaagcaaaaagaaaactaataataactctatgccttaacttcatcccccacattttaactttttgttgtttctatttatatcttaatgtactatgcatcccttgaaaatttcttttagttattattttcaattggttgatcttttggtctatttagtataagactagtttacaaggctgggcgcggtggctcacgcctgtaatcccagcactttgggaagccgaggtgggtggatcacgaggtcaagagatcaagaccatcctgccaagagatcaagaccatcctggccaacatggtgaaaccccgtctctactaaaaatacaaaaattagctgggcgtggtggcgcatgcctgtagtcccagctacttgggaggctgaggcaggagaatcacttgaacctggaaaaaaaaaaaaaaaagagtagtttacaaatcacagttacagtgttttcatattctgtgtttttctgtgtacttactattaccaatgagttttggaccttcagatgatttcttattgctcattaatgtccttttctttcaaattgaagaactcgttagcatttcttgtagatcaggtcttgtgttgatgaaatcattcagcttttgtctgtctggggaagtctttatttcttcttcacatttgaaggatattttcacgatatgtattattctagagtaaatgttttcttttccttcagcactttacatatgtcatgccgctctctcctggcctgtaaggtttccattgaaaagtctgctgtgagacctattggagctccattttatgttatttgcttcttttctcttgctgctgttggaatctttcctttatgcttgacccttggtagtttgattattaaaagccttgaggtagttttctttgggttaaatctgcttggtgttctataaccttcttgtattaggattttgatatctttctctaggtttgggaagtttactgttattatccctttaaactttttactcctatctctttctctacctcctctttaaggccaataactcttagatttgcccctttggggctgttttctagatctcatagatgtgcttcattcttttttattattttttcttttgtcccttctgattgtgtattttcattttttatttctttatttttttatttgactattttcaaatagcctgtcttcaagctaattctttcttctgcttagtctattcttccgttaagagactctgatgcactcttcagtatatcaattacatttttcaccctgagaatttcttgattcttttaaattatttcaatccctttgttaaatgtatctgataggattctgaattccttctctgtgttatcttgaatttgagtttcctcaacacagctacttggtctctttaaatctattttctatctttatgctttcttctttcttccctggaaggatactattatgagctttcatacccttcggctagttacttctctctttcctctttcctttgggcccagggatggtgccagctacactgctgccagcctcaggctcctgcactatccctttttggttccatcacaccctatccaccataagttgttcctttgtaaataaaccctcctctaattattctaatttaagtgttccaactgttttatattgagtccttgactgatatgggaaaattggcagaatatgaatctcctagtaccatcactgaggtgtagaatactgaaagttattatggaagagttctgagatcttagcagtatagagcattgcacagtcttattcctccattatggagaagaaggggctatttggcatgtattttctgaatttgggagcatattttaatatagcaactcatgtttgctactgtttgaatgaagaaatttcactgagcattttttaatgagacactggtcaagagtgccaagcctgaaataatcataatgtattgtgccttagaagaagatgcaggccattttcaactcattttacttctctgcagcccttaaagggtaaacaagagcatgtcagggattcctgtggctccatatgaagggtcgtggagactagcagaagggcagaaaccatcagactgcagtttctccaggctaaacaatggaacatccaacctgaaaatgacgttgggatagtgtcccgatgaaatacggatttcattctagaaggagttcttttggtagcaaagataggcatgaagctgaacattgctccaagaaaaccaaacattgcttataagaaccatataatgttcacacaggtagccagtagcagatggcagagatacatttgactacttactaagtggtttcttcattctctctttgcttccttcataggagatgtatgagaatatgagactcaaagagagagaaaaaagggaaagttcatttttaaaaaaaaagataaaaagataagccctctcctttactgtaagcctctaggttcaaaaacaggtttagcttgagttaggacaggtggagaggaacatagtttaggaaaggaggctggaggcaaggagatgagtctagaatggactttgatatggaagctataaaagaagcaatcttgaatattgaaacaagagtatactattaaacaagaatgattggaaaattgtggagttggccacgaaactgttaagcaaaccgctactcaggagaaaggaagagttattagaaaaggaacacaagttcatgtttatacttcaactcttgagactcactgcaattcccttctgacaggaatttttttttgtcttatatatggtagagttaattgttctagaagcctacttcaagctaacttaagcaacaaagtgggatttattggaaagccgcttgggtgtctcacagaacccaaggaagagaattgagctggatttcacaggacctggaaaaccctcagaaactcaattgttctctctctttcttctctctccagtcagaaccttcaggaaggggagagtggctcatgggctgagtggataaaccacaaaatgggtaatatactataggtgagttttaagtgacaaatgaagtctaagctgttattgcactggtcggtgactgaaactgaaaatgggaattagaggttaagtggagggaatatgttgccaaaatgttagaaggatcttcttcaaagagaagttgaggctctagaggataatggtagggcacagagtggaggtgaagcttgtgaggggtgggggtcaatggggaggataggagagcattcctgattttgaggaggaaggatagagggttttactggtgaatgacgtgagtaagtgtcatgaccgctcgtattctcaggattcttcagtattgggagatgtgactgcagtggacagggcagtgtcagagagactagattttataatagaagcttttaaattacctacccatcaccaacttatcaggagactgacactgtccatctcctccaaaaaaaaaaactgacctgcccggcactttgatgtccaccagttgagctttatgtttatcaagaatagttgtgtaaacttccaaaactgtttatggcaggcacagtggctcacgcctgtaatcccagcactttgggagggtgatgtgggtagatgacttgaggtcaggagtttgagaccagcctggccaacgtggtgaaaccccatctctactaaaaatacaaaaaagaaattagccaggcgtggtagcgggcgcctgtaatcccagctactcaggaggctgaggcatgagaatcgcttgaacccaggaggcggaggtggcagtgagccgagatcatgccactgcactccagcctgggtaacagagcaagactgtctcaaaagaaaaaaaaactgtttatatcagttatatttgttattgtaatgatgaaatttatagacaaactaatgaaataggagtataaacataccagtattttttaaaaataagttgaatattttatgactacataaacaataatcttttaaaagtcactgtcaatttgatgactaggagtcagccatacaactataaaaggttttgagaaaactgtaaagatctaaatagaggctgcatttagtttttttccccacaagaacctttaggttctagacatttatttcaaataaatgtcaactcatctggatgtagcttatgcaagaaagacctagaagagctcttattatggacccccattcaatgaaaacacaatggccctttatttctctttcaacatgaggaggtggaagggctgttcaagcccttctgttcacgatagcccaggaggtccaggagagaggcgagccgtgggtgagcaggagtgtctggggagtgtcaactttccattgaaaaatacccctatgatcaagccatttcacttccgtggcaatcttatttatgtattcaccaaaattgggtgggagctagtgtttagctgtcatcgtccgtaggctgctgtgtttggctcatggcagggtgtgaaactggcatcagggagtgtttgccaagtgaataagggtgaggctgccctttccagagccgccgggagaaactctggatacagagaccctagcctggcgccagtcccagcgttcctcctagtcggggaggaatctgtgggtgggaggtggggagcctgaaacccaaatacaacagccactctgggctgggcgtggttccctgggagctgggtctcagatccttttaaagctgatttctccccggatctccgggcaagatgggcaagtacacggtccgcgtagccaccggggatttgctcctggcgggctctcccaacctggtgcagctatggctggtgggcgagcacggggaggcagacctagggaagcagctgccaccggtgtggggaaaggtgagcgcggactgcggtgagagctggggccctgggactcagaggtgtcactgggggccggggccattcggagggtgctgctgccccacccatgagaaacctgggaagcggggtaggggctgaggtcgggtgcacttggtgcgcctgataggaaaagcgagaggaacaggagagatgagaggcattttcctgcccgagcggaaggacagagacgcccgctggggtgggcacggcaggcccggggggaggctggcgccccgcagtaccagctgctcctcctcacctccacctctccccggctgtgctgtggaggggaaacggagccaggattctctgaaggttcaccgaccccgccgtcctccctgaagaccccaaaacctgagctgtgtactgtcgcgcaggaggcagagtttgagatcgacgtccccctgcacctggggcgcctcctgatggtgaagctgcgcaaacacaacgtgctgttgagtctcgactggttctgcaagtggatctcagtgcagggcccggggacccaaggcgaggcctttttcccctgctaccgctgggtgcagggccacggaattatctgcctgcctgagggtactggtgagctcggtggagaaggggcacagcccctggcaggctggaggaagaagcgggtggggggaggctactgtaaaagagggaaaatgagagatgagggagatggggagaagtgaagggggagggtggctgatggggagacccgagcgcggaggggtgaccagggagggcatgtgctcttgtccctctcccccagcccggaccgtgagtgatgacccccagaacctgtttaagaaatatcgggaacaggagctcgaggaaagaaggaaggtgtaccgttgagccccaggaagtctttgatcccctaccagatcccaagaaacctgccacctgcctccttacccctacctgtgtgttcttcctccaggtggggctcctggaaagatgggttaatcctgcctatagcagggaataggcaaccggaccttcctagggacgagcgattcctcgaggataaggatttagactttaatgtctccctagcaaaagggtgagtaccaggtagaggctgggcacttgcttcctagggcacaaggtgggatgcttccttgatcttcttgcactccattctttccacaggttgaaggacttggccattaaggggacactggatttcataaattgtgtgaaaaggctggaagatttcaaaaaaatattcccacatggaaagactgtcctggctggtcagttttcacaacctcccaaaaccaatatacagacttccaacccagggatttgaaaaaggagggggatggaggattagatcagtgggattaggagttcggagctcagagctcacagggtgctccccaattgatgttcctagagcgggtttatgattcttggaagaatgatgccttctttgggtaccagtttctcaatggtgcaaaccccatgctcctgaggtgttcttcaaggctcccagcctgcctggtgctgcctccagggatggaagacttgaagacccagctggagaaagaactccaggtgctgctgggctttctgcccatccaccatcccagccattacccccacctcccttctcctcccatctccagccccttctctcatctcctccatctacacccaaggtttctcaacgttggcactattaacattctgcaccacataattctctgttggctggcggggggggggggggggggctttcctgtggatcgtagggtgtttagtagcattcctggcctctacccattgatgccagcagcatccccccggttgtgacaaccaaaaatgtgtctagatagtgctgaatgtcctggggttggggagaggaggaattgcccctgattgagaacattgatctacaacatctcctcctgtatcttcttttctttctccacattcctctcttccttcttcattgaacatatatcagccttagggaaaagcgcaagcttctggagagaaatagcaagaaaaactaaacaaagccttggagagctaaaagctgaatctgtttttggggggagatgggtagctaaaggaaatatttttgctacattggctaaagctggcagaagaggggatacgtgaagaatgcagtggccttatgtggtggaaaaccagaaacttcgctgcagggagctccaagtctgaaggaagacatcagtcatgaaaactttgcattcagttttttggttctgcagaaagtgattggtgtttaaagtaaaaaagacttgggtgggtagaggaaggatccaccctggaaaatgagagaagggcagctccagaaacaactccaaccctgttttctattcctgcccctggccctgtaggctggatctctgtttgaagtggatttctccttgctggatggagtcaagcctaatgtcatcatttttaagcagcaatgcgtggcagcccctttggtcatgctgaagcttcagcctgatggaggactcttacccatggtcatccaggtgagagggcccaggtatttttctaccagacactgatctcctttagggacttagatacacaagttctcagcccccactctctctcctgctctagctccagccaccttgacacggatgtcccccacctctgctctttctgccctcgcatccccccatggcctggctcctggccaagacctgggtccggagctctgatttccagctgcagcagttacagtcacatctgctgaggggacacttgattgctgaggttattgctgtggctacaatgagaagcttgcctagcctccatcctatctacaaggtacttcagcatctctgtcattctgtatctgactgtccttcatatttcagactcctacaaagagtctaaccttgtacatttcagtctagcagcaatcaatttatatgtggagacacatacacagatacatacacacacgcgtacacatacacagtaatatggaaacacccaggacacacacttactatgagttggggggagaagtgagaataggttttgcaaaggagttgaaattttggctgaggaggtttccaggtgggcaagtgaggggtggaacattacagccacaaagatctaaagaggcgaggaaagaagggaacatggataatggctgagattgggtgagattaaagtgtagggcatgagttgggatgaggaggaagaagaagtgggaggagatgagagaagaagccatgttacttagcggggagaagaatcaagagttattttctgaccatgtggggcttccaatgcctataaagacccatttgcacatgtcaggagggcaactggatatgtgagtctggagttcctagaagaggtgtaggttgaaaatacagattttagagtcattagaaaacaaaagtatcaaagtcattgtactggatgaagttctctagggtttgtagagaatttgaccgagatataactctagggtgaaccaacatttacagactgagagaagggagcagagtgagaaaagaaacaagagaaggaacctcattgaggtaggaggaaaatcaaaaagtgcaatccatggcagccaggaaaagaaagcgtttcaagagggacgcgtgattatctgtctcaagtgctgctgagagatcaagaaagttacagagaagtgacatttggatttctcaatatggaagtcattggttaataaatggacatgcgccatctcagggaagtggaggaagcctgattcatgggggtgagcagcaaatgtgaggtgggtaagcaaagacaacactgagtgaagatttgctgtgaaagggaaagcaagaaacagggagatggcaagacaaggatgtgggggtcaagcacaggttttctttagggtatccaatattgcacatgtttgtatgacagagagaggagaaggaatataattataggagggtgaaggcaaaaagggatgggctcatatgtgggtacctgcgaggatatgggatttttagaattcttccaaggacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtatggaaatggatgggtgaaggggaggatggttcaatattggaagaatcctaggggttgtttccctttcccattcctcccccaagctctccttcctccatggaaggcctctcccaaacctgcctcatgcctgaagagcttcctgcttaaaagggctagagtaggatcataggcctggagtttcctgatactcatctccctccctctgcaacttggcatggctgtgggttatcctcaggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccggtaggtgaaggtggcacagagaggcaatgaacggaggggcgggggactgtaggtccagaaggtcctgcattggcccctgagactgagtgtcttcttcccagggaataggtacgtggaggggatggttgggcttttctacaatagtgaccaagccatgaaggatgatctagagctgcaggcctggtgcagagagatgactgagactggactgcagagggcccaagaccaggggtgagacatggatccttccccactgaaccctgtcaacacccactcctctgcaaacaatctgcttcttctcacatcatcatgagacaccccacctgcccaaggaagctgagaattctccagagtgtgtccagaaatgctaacaagcactcctgatctccccagccctgttcctacacagtgttctctctcctctgcactaagagcttcctctggaactagatacaaaacttctcttaggtattttccctcactcttccctcccctctccccatagctcaaggttcatcccaagtgcattaacctttgagcacacacaaggtgggagtcctagggtgtgcaggccagaaccacagaaaagttcttttctgtatctccacatagctttccctgcgtgagacctatttcgtgttctggtttcgagatctctgattctcatttcaccaggattctcatttcaccaggttcctcatctccttagagtcccgggctcagctctgccactttgtcaccatgtgcatcttcacatgcacaggtcagcatgcttctaaccacctgggccaggtaacctatgtgatcatcccacaacggctcctgggatggagaagtgggggatcaaatgcccaggtcatcagcctgcatttctctgggctctcctccctgcagctggactggtactcctggatccctaatggcccatgcaccatgcagaagcccccgcccatctctaaggatgtgacagagaaggatatagtggacttactgcccaatctccaccaggcacgtatgcaaaagaccttcacaaagttccttggcagacgccagcctgtcatggtgagaagcaaatgcctgggtcctgggaaggaggcagctcaaaggaggggaagtattctgggctgagagtcccaaggggctgagccaacttgtcttctgcctctcagcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacggattatatgtgtggtggtggaaggtgggaggagagaccttgctttgtttcctgcccctttattcagattccaaagaaggaaagaaaagttttcctggaatgaaaattttttctagcaatcaatgctttttccaagggtatcttggaacctctctaagttaaatgacaagtgttctggatgactgagtccactggggctaagaaacctggctcttgacaagggtttttggcttgaggcctctctgaatcctcaataagccatcccttaggctacctgcagcaacgcctctggtgcaactcccagcacagccctcctgcatgatccctccccagctgcatcccagccttcctctcagtcctgtcccaggactcttgataaaccctcttctcatcatgctctatccttgcatccttaaaacataccatctagcccacagtcctagatactggagataaatggataaagaaggaactagtaggccagactctatgttagaaattttaaatatataatctcaatttatcacaccgggcacagtggctcatgcccgtaatcccagcactttgggaggcccaggggggcagatcatctgaggttgggagttcgagaccagcctgaccgacttggtgaaaccccttctctactaaaaatacaaaactagccaggtgtggtggcaggtgcctgtaatcccagctacttgggaggctgaggcaggagaatcacttgaacccaggaggcagaggttgcagtgagccgagattgcaccattgcactccagcctatacagcaaagagtgaaactcggtctcaaaaaaaaaaaatttatcctcacaacttctctgtgaggttggtatcactatcaccatcttataacaggaaaatgaaggttggagagataagggcagaaatgacctgggaccaaaatgcagcagagtcagattccatttgctagaaggaagcaaagcccaggattgtggtcatagcaataacagttaaaagactgatcataaaatctagaggccaatgaaagcctcggatggatctgatgtaatgggaaaaaaaggagagataaagattctttgagtcttttaaagaatcttatgcattcaaattacttatgtcccatatatttttaaaaggaacatatacaatacggttaatacggtagaaatagacatgtgtgagccatccagattcacctactgatgccctcaaccttctaatgtcccgtcctgttctgtgtattgcttccgtccatcatatgacttttttcagtagatgacgaaagaattttaagatagccacagaccatagactcacagaatctgacttggttgctagaagtttttgtggttgcatggaatggtagcaaggagagtcagaagagagggaggggatgaggaagaggcagaggtcacgctgaggttttcagttgcggcacaactggcgagaaatacaaagattcagaaggaaggttgtttaagtttgatgtaatactgtggttcttatgggaagaaattaaacaggtaattggagaggctgaactgaaaaaagaaaggaggtgagttctggctgggcgcggtggctcacgcctgtaatcccagcactttggaaggccaaggtgggcggatcacgaggtcaggagatggagaccatcctggctaacatggtgaaaccccgtctctacttaaaaaaaatacaaaaaattagccgggcgtggtggcgggaggctgaggcatgagaatggcgtgaaccgggaggcggagcttgcagtgagccgagatcgagccactgcactccagcctgggcgacagagagaaactccgtctcaagagaaaaaaaaaaaaatggaggtgagttctacagtttggatgacttaggagctgaatttatgaacaagggaaaaagaagaggcagagggccaaggtgtccttggccctaacaagaattagggatataaaaaagaacatgaggccaggaacggtggctcatgcctgtaatcccagcactttgggaggccgacttaggtggatcacctgaggtcaggagttcaagaccagcctgaccaacaaggtgaaaccccatctctactaaaagtacaaaaattagctgggcgtggtggcacgtgcctgtagtcccagctactcgggaggctgagacaggagaattgcttgaacccaggagttggaggttgcagtgagccgagatcgcaccactgcactccagcctgggcgatggagcgaaacttgtctcaaaaaaagaaaaaagaaaatgaagccaggaagtgagaatgatcctagtttgaaaggtaagaagaaaagctggatgatgcaggtcacggaagccctgtcatcacttcctatgactgggttgtctccctgagctctctcattttcttttttcttttttctttttttctgaaatggagtttcactcttgttgcccaggctggagtgcagcggcacgatcttggcttaccgcaacctccgcctcccaggttcaagcaattctcctgccttagcctcccaaatagctgagattacaggcatgtgccaccaagcctggctaatttttgtatttttagtagggatgaggtttcatcatattggtcaggctggtctcaaactcctgacctcaggtgacccacccgcctcggcctcccacagtgctgggattacatacaggtgtgagccaccacacccagcggctctcccattttctagatgtgtcacctcactcccattttcctccccaatctactccccatcctcgtgtgtttcctcagcaagtgtccccatctctgcacagcacagtcatatcctcagtccagctttcaaattctcccacctcatctctcaggagggtctgatataacgactcttttactcagataatctgttcaggcacctgtgcctatgagaggcttactgtgatctctgaatctatgtttgtggtaatcctacgtggactgctcacctctagatgtcttatgaaatcacctccccttatttctacaacaggctcaaattgccttcgggaatcattaaagctcagtgttctggctttgattggtccttcgctccctagtccgcctgcactcatgtagggtcatgctattacaaaactccacagggtaccatttatgttgtattccatgtggaaggtgtcctctggagtttggcaatatagcagctgtctgtaaaaatgatattgaaagcatcctgagttctggagctgcgccgattctattaggctgagaaccccagtttcaagttcatctcttcatttttctctcattccatttcacagcggcttaacagcaggtcctttgtattcgtttctggcccatagagggatctttattcaaaatcacagggttgtctctaaatttctgctaagctaatgaatggtgttagtatgttctcttctccagggcagaggcagagttttttttttttttaattagccaaaagcaacattacacaataaatcacatatcattgtagaagagaagagttaactattataactaaaagataaaatgccatggcattcaggcaacggtggattagaagtacttcgaacctatcagttctgtaaagcctagcttaagtctgttggtctaactttctaactagacttaccttcctttagaaaatatttgatgtgcagagagctagactgaggatctagcagtcacagatcaccttaattcaatcaggaactaagattatttgatgctgggttttaacccctttaaggcctgaatttccaccccacctttactgctagggtgcagctctttgaggtcccaacccaaagtgggtgagaaagagacagagagagagatacagggatggtcgagaatccttcaaagacaacatcagccacagattaaagagaaatcttcaatgtggagaaaaatctcattactttcacatgggcatcaataatacaggtagcattttctcaaatgaaacattagctgccagagacaatgaataatcttggaagtgttgaaagaaaatacctgccagactagaataaagactttctacaaatcagtaagaagaaataggcagttcaataaaaaatggacaaaaggcctggcacagtggctcatgcctgtaatcccagcactttgggaggccgaggcaggcagatcatgaggtcaggagatcgagatcatcctggccaacatggtaaaaccccgtccctaccaaaaaaaaaataataataattagctgggcatggtgatgtgtgcctataatcccagctgctcgggaggctgaggcaggaaaatcgcttgaacccaggaagcagaggttgcagtgagccgagatcgcgccactgcactccggcctggtgacagagcgagactccatctcaaaaaagaaaaaaatatactcaagacttaaacatacatttctcatggggacatccaaatgtcagtaaatatacggaaaggattatatttgatgattctatttgtcagtttaatatcacatcaacttttatggtatctggaggaattgatcccattctgggtaagtctgatgcccgtatggctcaattcgttgcttgtatctctggctttggttactgctccagagaattgcctgattccatactgcatgaagttttaagatatttgaatactagagaaatttccaaacctagcaaaagggtcctgtattatacaaatcttacagaaatctccaaggcctctcatcacatctccaggagatctacatctgtgtctcttatatgtggccaaagaggctatccttgactaactctgggtcactgggatgcctattttccccataccaccttattatttggatactttaccagaacgggtaggaagtctgctggtcagatatagatcatagttatcacagtcaacagcagtctatgtggattcttggtggcatttgacacagccactttcactttgcttaaatacttttatctcttactttctatgacatcatagtctcctggttgtccactttccttaatggttctctgccatgcaggtacccattccagggagtccctggttcccaaagtcatcctgattttcactcacaagctacccttaatatttaaacaaataggctggaaactctgtctctaggcttttgggaagggcccataggagaatgactgggtttctcattaattgattagaaggtacattgttaaggtaacagctgctgtaacaaatcagcccaaataaataatggttcaaagacaatagttgttcttttgtttcactcctgataaatttaaaacaatggttcctaattggtgcgtagtcctccttcactaagttagggactcaggctcccttcatcttgtggctctgcatatttaacatgtggtcaccatacttaagaacatttaggtagcaaaataagagagaacataaaagatgacatgtgtgatatttttatgggacacacacatagcaatcagaatccctggcaggaaacagttggcataatcaaagtcagtgtttgtttgtaaatctcttttattttctctaccataaaaattgctattgttattttatattgatatggattattgttatatttttattgtgaattattccctctagccttcaaaaggctgggcgtggtggctcatgcctgtgatcccagcactatgggaggccgaggcgggcagatcacgaggttaagagatcgagaccatcctggccaacacggtgaaaccccgtctctactaaaaatacaaaaattagcttggcatggtggcacgtgcctgtagtcccagttactcgggaggctgaggcaggagaattgcttcaaacccgagaggcggaggttgcagtgagctgagatcacgccactatactccagcctgggcgacagagcgagattccatctcaaaaaaaaaaaaaaaaaaaaacacgtagccttgctttctgctctgaattctataatgtctaatttttttttttttttgagatggagtcttgctctgtcaccaggctggagtgcaatggcatgatctcggctcactgcaacctccgcctcccgggttcaagcaagcaattctcctgcctcagcctcccaagtagctgggactacaggcgcacacgaccacacccagctaatttttgtatttttagtagagacgggttttcaccatgttgaccaggatggtctcgatctcttgacctcgtgatctgcctgctttggcctcccaaagtgctgggattacaggtgtcagccacggtgcctggcctataatatctaattttaagattatgagtgatactttttttgtctgttatacatttgcccatccttttattttcaacttccagaattagtttattttaaatgtaccttttgtgtatagtagacagttgggtttttctttgtaatctaatatgaaaatatttttcttgtaatacatgctatgttcatttacatcatttacatctattgatatgctctatttttaagtttttcatgtgattttttatatatataaattataatgttttactctgtggcttcttattgcagttagactattcaagaaggtttataattttgatctagcaataatctttatagtttctatttgatataaagaccttaatctcctcatttaaaatatttcttagtatgagcaatgatgaaattggcttgtagatatttcctccctctcatcaccaaatttttattgatatcttttaaaaatttattcttaaatgtgtgtgtacttctactacctgaattgtcattattaaacaggcaatagttgtgtactagagttctctagagagacagacccaataggatagagagacacacatatagattacacacacagatatatatataaatatagatttatagatacatatacacacacatacacatatatgaggggggttattatgggaattggctcatgtgattatggaagctgagaagtcccacaacaggccattggtgaactggagactccgggatgctggtagtatggcttaatccaagtctaaaggcctcaggtctagggaagctgattgtgtaattcttggtgtgaggccaaggtcctaagaacctgtgaagctgctgatgtaagtcctggaatccaggctggcaaacctggagttctgttgtctaagggaggagatgagtgtatcccagctctagaagacatgtttgcccttttcttgatttatcataagtattttaaactcatatggaagtgtttggatacatgttttatttgctccttagcaacatatttctggtgagttggttttttttgtttgtttgtttttgagacagagtctcaccttgtcgccaggctggagtgcagtggcgtgatctcgactcactacaacctccacctcctgggttcaagcgattctcctgccccagcccccagagtagctgggattacaggcacccgccaccacacctggctaattttttgtattttagtagagagggggtttcactatgttgcccaggctggtctcgaactcctgagctcaggcagtccacccgcctgggcctcccaaagtgctaggattacaggcgtgagccaccgcccctggcctcaagattgttcatcacatgtgcaaagtctctttaccatgtaagaaaacattcacaaatgctggggattaggacatggacattttctacctaccatgatatccatcaactctgaaagtgtccctgtgcccttttatgaccccttcctatggttccttcctccctgcattctgcacctatgaccccaggcaaccactgatctactttttgtcactataaattagtttgcatttcctcaaattttatataagttgaattataaaatatgcagggttttttatttggcttttttcactcggcaaaattattttgagatttatctttgttgtgacctgtgtccacagttcactattcttttctgttgagtagtgttccactatatgtatatactgcaacttaagaaaaatctgccacttgctgatggacatttgagttgtttccggtttttgactcttgtgatagtcaaaatattgacatatatataaattataatacagctgctatggacatttgtgaacaagtctttgtatgggcatatgattttatttctgttgggtaaatatctataagggaaataatttgcttggggatgactggttcacatggtatatgtgtgcctaacttttgtagaaactgccaaactgtttcccaaagtgtctatatctgtttacgttcctactagagttccagttactcatagggtggtggccactggattagttttcatctgcacttaccagcagcaacagcagtggcaccatggtaaggtgaatgctccttggctgcggcaggatgctagtgggtgctggggtaccagcctccatgcaggcattcatagcagcaaaagaggtagcatggcttgggcggcacaagggtcttctgccagtgaccatgcatgtgtttgtggcggtggtgttagcatggagacagggtggtgttgggagcaggactgtgtgtgcagttgtgtgtgtgctcacatcggtggtggtggctgctcagggaaggggtgggattcgctgttctccatgcctagctttgtgccagttgcagttttggcacagggccagggcactgttggtagcagagctggtgtgttccatgcccaccaacactgacaggtatggtgaggggcaggagaacggagtgtattcatgccagcagcagtggcatggcagggtgtgcacacatgtgcactggtggggaaggaaaggcaaagtttgcctgtaaacacatgcagtggcaaagcaatgtgggtggccacaggtgagtgtgtacagagaaagctgcatgggggaggctatagttaagggagggcaagggtagcctggtgcatatctgtgaaggctgctctgctggatccatatattggtcaggcatggtccaccagcacaggagctatgatgtgggcccccaaggaggtatctgggagctgcactgcaggcaggtgcagccaggctggggctctgtgagacgccagcagaccaagggatgctgaggtcaaactggtcctgtctcatgggcaacaccacccttcagagttcaggtctgactgtgcccctagggctaaagtgtcctatgggagcaagtcaagcctagggacatgggtttccctggctgtactccagtacagacattgttgcaccgaactctctgggctctgcaccagcaggatttctgcccctaccccttctctagacatctcttcctgccaactcaagtatatctggtggttgagagctctcctcttgttgggattctggaggcccatggtgagggtgggctgctccttgcctgttagactcaccccttccacaggaatcagtgggggccagaatgagtcctggtgtgcagtatccctgttcagggttcccagcttcctccccttcagcccagcctctgtgccttccctctgtccactctcaatgccttccctctgaagatctgctaggagtgcaccagtcttcctgatgtcttggtccctcactgggagatgtttctactggctgcatctagtaggccatcttggagcagcaatttgcatgttaaggctcagactgtttgtttgaatgcacacagaaaagaaaaaaagaatgaaaagaaattaaaaacacctactagatctagggaaaagcctccaaagagcaaatgtaggagtcattggaatttgagagggagttgagaaatagcaaggtgtagaaagttattccaagaaataatagcagaaaactttctaaacctagagaaagaaataaatatacaggtacaggaagttcaaatatcaccaaatagattcagatccaaataagaccaccccaaagcatataataatcgcactctcaagggtcaagaacaaagaaatggccaggcgcggtggctcacacctgtaatcccagcactttgggaggccaaggtgggtggatcatgaggtcaggagttcaggaccaacctgaccaacatggtgaaaccccatctttaactaaaaatacaaaaaaaaagttagctgggcatgatggcacatacctgtaatctcagctactcaggaggctgaggcagaagaactgcttcaacccaggaggtggaggttgcagtgagccgagatcgagactccatctcaaaaaaaaaaaaaaaaaaaaaagaacaaagaaaggatcctaaaagcaacaagagaaaagaagacaataacatgataacatgtaaaggagctctgatttgtctggcaacagacttttcatcagaagccatacaggccaaggcagaatgggaaacatattcaaaatgcaaagaaaaaaacttttttttttttttttttttttgagacagagtctcactttgtcacccagactggagtgcagtggcacaatcatggctcactgcagcctctattttcctgaagcccaagtgctcctcccacttcagcctcccgagtagttgggactacgggtatgagctaccaagcctggttaattttcaatttttatagagacaaggtctcccaatgttgcccaagctggtcttgaactcctgaacttaagttttcctcctgccttggctttccaaagtgctgggattacaagtatgagccaccacaactggcaggaaaaaaactttcagtcatgaatactatatccaagaaactatccatgaaacatgaaagagataaagactttcccagacaaatgaaactgacaaggttgatcatcagcggatctatcctataagaaacgctagagggagctcttcattctgaaagaaaaggatcctaacatgtaacaagaaaacatctaaatgtataaaactcactggtaaaagcaagtacatagacaaatagacaaatactctaatactgcaatagtgatgtgtaagctactcctgtctctagtttgaaaattaagagataggcattataaaaaatgtgagttgagacaatgaaaagtcaaaatgtagggagatggagttaaagtgtaaagttttcttcagtttttctccttttctttgtgactaaagttaattttcatcttaaatgacaactggttaagtttaaaataatgtgttataagatgttttctgtaagccttacaatagccacaaagcaaacacctataatagctacactaaaaataaaaagcaaggaaattaaaacatactaccagagaaaatcacttaagcacaaaggtagacagtaaaaaagaaagtaagggagagaggagttgcaaaatgaccagaaaacaactatgtaatatcaatagtaagttcttacctatcaataataacattaaattgactaaatttccaaattaaagacagagtggctgaatggattaaaaaaaaaacaagatccaactatattttgcctacaagaaactcacttcataaagatgcacataggctgaaactaaaggaatagaaaaagatattctatgcaagtggaaaccaaaaaggagtaagagaagttacacttagataaaataaacttcaagtcaaaaactgtaaaaagacacaaagaaggtggattaggccatttttgcattgctatagagaaatacttgaggctggataatttatgaagaaaagagagttaactggtacacagttctgcaggcttcacatcaaaccccacagactggtacatcccaagcagaaaaaatgaacataaatctataactagacacatcagagtgaaacttcagaacaccgcagatcaaaagataatctggaatacaggcaaaaaggaaggaaagatcacctacaaaggaaccagaattagcacaacaacaaaactcccaacaacaacggaagccagaaaataacagaatcaggtcttcggtgtattgaaaaaaattattggtcaaccaagaaatgtgaactcagcagaactctaaaaaaaatggtttcaatcattttttaatgagaaaatttacttctaaagaaagacctgcctcacaaaaacttttggtaatgtgctcagaaagaaaaggaaaaataatactataaaagttatctgagatgccaagaacgtggtaatatgtaaagaaaccaaaagcaacagtgtcaggttgaaacaagcatgctttataatttgtagtatttttttaaaggcagatatgctggttcctctctgccactgaatgtaacaatgaagacctgggcagaatgcgtgaagcagcagtatcacgggggttggagtgaaagcagaaggaaaactagtaatcagcttactagattttccctgcagaactcctagactgacttcaaggcagcctaaaacctagaggtgcaagtcagcatggacagatcaagctttagggaaagccctcagttctgggataagggagtgataaaggggtctcctggaaatgacaacagcagcgggggccgataagcacgtgcagtctgaagaaggggaatcttcctctccaatcagaagaagtgtggtcccaagagcgcggggaacacctccgtggattttttttcctctctctttcctcttatcacttgaccccgaatgagggcacagatgcaagaagtgtacagcaaggtaggctaaattaggccctaaatttctggctgaaggaccaaaaaggaaaatgccaggaaactgaaaagcacagaggagatcacagggagagaggagctcaggaaggaaaccccaaaatattgtttataagctcaggggctcattcctaaactgcacaaacagagattagatcacggaccaaactactaaagactgagagctgaattcagagatagggtcccatccaggttcctaactgggtggcacatgcatgggctagatccaaatagcattgcaaaggcctggaaaacagaactagaattgaaaccaccgcggaagactcattcgaactcgtgggctgaactcaaccaggtcaatgcttcagaaaaataccagcattctccacaggacataaacaagattgtctcataacataccattcaaaatattaggatacaatccaaaattgctcatcataagaagacaggaaaatctcagttcacatgggaagagacatagatgactatgaagagaagttataaaatactccaagtcggggcaaacactgttgaaaaggtagaagacctcaggaactaaatagaaaaatataaaggagaaccaaatgaacatttcagaactgaaaaatgcaataaggttttttaactgtttctgtcaagatggcggatgagaggcattgctggcacgcctctcccacgtggaaggacaaaatagtgtagagacattcactttgtgaacttttttcaagaggcgatgcagtcattgaacaggaaaacccagggacgctttgaaggacgcaggaggctgcagtctacactgtgagtcaggtgaaggactgtgagtcccagagtgtgagaggggaagagtttttgcctctgggatacacacccccaccagggaccctgaaagtacaggacacggaggaaggccctaaccccacccagcaaagggaccaactcggggagggtggcggaatataaaaataggagcagtggcagaagacacttgcgtgcactcccaaatcccaacacaggagggcagccgttccttactgttcctcacaggggacccccgtggaggacaggcaaaaagtttagacggcggtcgcaggttgaacgaagctcccgaggggtttcatgatatatatacataaccttgggtggggaccaactcccttggccagggccaggcgtgggagagtgaaaagtgggctgcgagtgcagggggccgtgagtgcggaagccgcgggtgcaggaacctcgggtgccggctttgcaggacagggaagggtgtggcgtgaaaaccacaattgcgatctcccgtggggaaagcttataactgtggcaagttccgattacagactggctggaattcagctcgccgctgccagtggaagctgtggtagtagatctgcctcactgagtgcatgggaattgggggctcaccgctgcctgctactccccactctgcacaaactcttctgcgcagcgggggcagaagaacatcaacccagtggcctgagacccactccatcccccaacattcacaggagctgctgcttgccctgcacacggagaatcagagcacaaacctgaccgacgcagcccccatctcgctttgccccgccacttgccctggtagcttaacacaaaggacagaatctcttgagagctctgtggccctgactattgcctgtgaaaccagagtattcctccctccacgcccccaccaccacgcccctcccccccccccccccccacacacccacctaccgcagccggtgttcatttgcaagcaccacctcctggctggaggccaaccagcacagtccattacagcatctcctggtagaataacattgcacccaggaagaaggaggctctatgatctcagctattaccactgcctgcatcactccggctaaccaggaggtcctgagtccacatgaccagctcattactactataactagcattcaagaaagccaacatactatggctaccaataaccaaggaatttcagagtctacgtcactcccctgctacccccagtagagctggtgttgctacccacttctgggaaactggcattcacaactggcatttcccaacaccagcctggagggtggcaacgtcactgggcagctagacccagaggagcaacaacattcacagtagcgtggctcacagggactcccactcatagggaaagggggagtgcgccccatcaagggaagaccctgtgggaccaaagaatcgggatggcaggccttgagcatcagatccttccgctggtggaaagcttccttgagcagaggcgcagctgaagtgctaggctcagcggggaaagccttcagctctatcgcaacagtcagacagctttggtgcatgggaaggatcttggagaagaggcagtctttccccccttgttcaccaccatatgcacagttgggacttctcccacaggagctcgacatggatgcaactatagacggccattctggaacacatcaaggcgactgcatccccacaagaggagcaccctccaggatcaggcttgcacaagaaacagtcacaattcctctctatttggaacaccaacacctacagatgaaaagaggtgcctgtctgatctgaatagccagagcgctgggacaggagcatatctaagaagtggaaaacgtccctgctgaccttgcaggggagctaaggtggctccaacccttctccctgataagacctcactgtgactcaccgagggctcctccagccacctctgtcaagcctgggtcttcatttacccacttgctttacccacaaccgattcctactcagggacacctcttctactggcctgaaacctgaaccatcaaaccagtaaataaaatactgggggaaaataaataaataaaaagtgcatgagatgggagaaggagataagctttaagaaacctctaccattccaaccccctaggagataatggaatggaaaaccaaacactgtatgttctcacttataagtgagagctaagctaggaatacgcaaaggcatacagagtgatataacggactttagagattcagaaggagattcaggagggtgggaagaggaccaagggaacaaaatctatgcattaggtacaatgtacaccattcaggtgacgggtgcaccaaaatctcagacttcaccgctatataattcatccatgtcaccaaaaaccacctgtaccccattaataaattaataataaaataaatttttaaaaaaagttttagctcactgagtgagcttgcagcagaatggagacagcaaaggaaacagtcagtgaatttgaagatagctcaatagaaactatgcaatttgaatgacatcaagaaaaaattgtttaagtaaatagagtctcaaggacatgaaggacaaaaccaaaaggtctaacattcatgtcatcagagtcaaagaaagataagagtgtgtggtgcacaaaaaaaataaataacgacttccaatttttcaaatttcataaaagatataacttacagcttcgaaaatctcaacaaatcaccaacaggataaaacaaacaaatcctcatccagataatcacaatcaaactagtgaaaactaaagccaaagaaaaaaatcttgaaagcaagcagagaaaagcaatgtatttcccatagagaaataataatttgaatgactgcagggttctcatcaaaaacaatggaggccagaagattcatctgacaaagcactaatatccagaatctacaacaaactcaaacgaattagcaagaaaacaacaatcccatcaaaaagtgggctaaggacatgaatagacaacaattctcaagatatacaaaatgaccaacatatgaaaaatgctcaacatcactaatcaggaaaacacaaatcaaaaccacaatgtgataccaccttactcctgcaagaatggccatcatcaaaaaaatcaaaacataatagacgttggcacggatgtagtgaacagggaacacttctacactgctggtgggaatgtaaactagtacaaccactatggaaaacagtgtggagattcacagagaactaaaagtagaactaccattcgatccagcaatcccactactgggcatctacccagaggaaaagaagtcattatacaaaaaaggtacttgcacacacatgtttatagcagcacaattcgcaattgcgaaactgtggaaccaaccaaaatgcccatcaatcaacaagtggataaagaaactgtgatatgcatatacacatacatacgatggaatactactcagccataaaaagcaacgagttaatggcagcaacctggatgcaactggagactattattctaagtgaagtaactcaggaatggaaaaccaaatatcctatattctcactcataagtgggagctaagctatgaggatgcaaaggcataagaatgacacaatagaatttggggactcagggggaaagggcgggaagagggtgaaggattaaagaacacaaattgggtgcagtgtttactgctcaggtaatgggtgcaccaaaatctcataaatcaccactaaagaacttactcaggtaaccaaacaccacctgttccccaataacctgtggaaagaaaatttttttaaaaaaagaaagtagaataatatttttaaagtgctgaaagaaaagagctatcaactcagaattctatatccagaaaaaaatatctttgagaaatgaaggtgaaatgatgacattctcagatgaaaagaagaaaaaaaaactaagacaatcaatttccagcatatgtaatctaaaagaattgcttaagaaatttcttcagacagaagggaagtgatgtgagaaggaaacctggaacacggggaatcaagcgagaacaacagaaacattaaatatctgggtaaatataacagactatccctctcctaatgagttctttaaaatatatttgatggttagaagcaaatattttaacatgactaaaagatttttaatatacacagatgtgattaatgggctgaccatctgagttcatctgctctcagccaaaaaaataaccacggcttctccctctgctcagcatgtcttttctctaccatgaggttctacttctttgtaacttctgttccccatggccatcttggcccctctggcttctctccgtctttgttcctattgctaactgcctgatcctctctgtattttccagatcaacacacacacacacacacacccatagtgagaaactgaccctgctcttttgtctggggagtggtcccatccaagtacacctctgactgtggatggggcagatttccttataaggggatggcaggtattatgatcgccatgtagaattcagatgcattaaacattttgttattctgagaaccatgccacacatttacacccctctaagccttgatatggtctattccttcttcctgggatttcttttcctctttgcctagaaaacttgtacatatccttaaaaatccaacacgagggctcagtcactcctcctttctcttcagtccccattgcccttacatccaacctctattcaagtatttaatatgctctttggacactggttgtctatacatttgtcgccccaaccagacagcttgctcccaaaaggaggcatcaggagattctcattactatattcctactgcccattaaccgttatattcattcatgtcttgtcatccattcaacaaatattaattgaatgtccactgtgtgtcagcctctgtatgaggcactggaatgcaaacgtgaacaagtcagagtccctgccccctcggagattagcgtggaccacactgtgtctggcacatagtgaatgttcagtaagttatttttaagttggatcgtacttgcttatagttctctaccaaggagccctttgacctttctcagacatcagagctttcacagatgaaaaggagtggaaagttaagtgggccatgattcccaaaagcacctcagacttggttatcaaaaaccaagcaactcttctagtccttatgtgtcccacatctcagcaaatacacacacatcatatacctagttaccccagccaagaaccagggagtaacaatgaccaatctttccttctcttctgctctctctcacacagtctactctttctctttctcttcctgtcatcaccaattaaacaatggagtcctgaccgctccacttccttcgcatgtcttccaccctgcccgtctccattcctgcttcccctgcttgctgcaggcctttattatctctccccagcacaccaaagacgtctcctcatgggtctcctgttttctgtgcaaccacatcactcatctcttcctgacccaaaattcatgaatttccctgaaatttcatcagctccctgcaactcttgctgtctgtttgcccagaatgcctaccctctccccaactgtccttcattcccatcaacccggtagatatctacacagatttaaagactcagctcaagttgcctccctgagaagccttttctatctcctcgaggtgaacctatccctccctgctttgtgcccccataataccccacacgggattctttctccattgtaacacactgttgcatttactttttatgtctttgtttccccccactagactaggaactccttgagggaaaacaaaatctctatgttctcaatgcctggtgcatagtatatgctcaataaatacttttctgaatgaatccagtaaacaaaatacttccctgtctttggcctttgtgaaacaagcagctagaccttccaggacgggcttctttgagcctctacaagagtcaaattaagtaagtaattcactgggttgtctgcctttgtagatctgaggaggccaaactccacctaattttccctaccctgaggcccatctggttctcacccaacaacttcatgagcacatccagatggtccctctaacatgagcactgccaatgacatgtaggacagtctcacacaatctcatactcgtatccctcttctgcgatcttaatccccaaacccaattttgcctctcctttaaccctgtgtccccaccacagttttatccttcatccattcctataacatgtcccctgtttattccccaaactttatcttcttgccttcaaaccttcaacctatgcataagcataatcattctacataaaagctattgagactaggcatggtggcacatgcctgtaatcctagcactttgggaggacaaagcaggaggaatgcttggggccagaagttcaagaccagcttgggcaacatagccagacccccatctctatgaaaagttaaaaaaaaaaaatggtagccaggtgtggtggcctgcacctgtagtcctagctacctgggagactggggctggaggatcccttgacccaaggaattcaaggctgtggtgaactatgatcatgccactgcattccagcctaggtgacagagagagaccctgtctctcaatatataaataattttttcaaaaagttattgaacatctatgatgtccagatcctgtgccaggcactgaagataaatagagaaatagaaggtaaatagagataggtagagtctctgcacaggggaaactcagggaggccaaagagataatatataatatgtaaataccaacccagtctatcaataagcattggcctcaggttttggaagggtcagttccatggactgtggaggtggtcaaaaaatgctttgtgtgtgtgtgtgtgtgtgtgtgtgtgtgaagatggggtcccactatgttgtccaggctagtctcaactccagggctcaagcaatcctcccacctcagactcccagagtgctgggattacaaatatgagccaccacgcccagctaaaagaatgcttcttgaaagagacagggcttgactgggatttgagctgggaaaaaagttcttcaacaagttcaaaaaaaaggagatcaaaatttcagattgagttagtggctcaaggaaagacccaggagtcagcaaatgcagtgttttaagagaccaataactaaatgatttgggctggagtggaacacgggcgtgggaagagcaggaggtgagtctaggaagacagtttggtggtagacggtgggaggtataattaccaggattagaaattgggacagtggcaggtaagcaagaaggtgaggaattctgtgttcaggaggaagaggattaacacgtaaatagcattttataaaggttcatgtggcagctgtaaggagatgggttggagtggggacagattcatggtaggaagtctatcatgatctaggtggtaaaatagactgaaactatgggatggaggagaaagatattacaggagaagaaccagttagagctggatgttaatgagaaaagtcaaggataaggccaatgttttgagcccatgactttgggtatacacaaatgccagtgataaaaaatggaaagcttaaagaaggaaactgagacaaatgactgactttggtcgtcgacaaatctttatgagcagtggtgggtatgagataaaggaagagatgtccagcaagtaatggcaaatccagacttggaacttttgagagaagtcagatattgaagaggagatgagggagccacctgcgtggaagaggagacctgcaagagcaaaggatgtggagggaagagcaggactgagccttgagatccgccttttcaggaggaggaagggggccaggcgccgtggctcatgcctgtaatcccagcactttgggaggccgaggcggatggatcacctgaggtcaggagttcgagaccagcctggccaacatggtgaaactccatctctactaaaaatacaaaaattggctgggcacggtggctcacgcctataatcccagcactttgggaggccaaggcaggtggatcatgaggttaggggtttgagaccagcctgaccaacatggtgaaaccccatctccactgaaaatacaaaaaaattagctgggcgtggtggcgggtgcctgtaatcccacctactcaggaggctgaggcaggagaattgcttgaacccgggaggcagaggttgcagtgagccaagatcgcaccactgcactccagcctgggcaaaggagcaagactctgtctcaaaaaaaaaaaaaaatacaaaaattagccaggtgtggtggtgcacgcctgtagtcccagctactcggaggctgaagcacaagaatcgcttgaacctgggaggcagaggttgcagtgagccgagatcacaccactgcactccagtctggtgacagagtgagactttgtctcaatcagaaaaaaaaaaaaagagagaaggaaggggaaagaatagagagcccacctggaggttaggaggagaaccagcacagggacgaagcagccagtggcagagagaggttcgaggcttaggaggttggtgttgcctggtatcctgtaagtttgtattcttatggtttgtatgcacaggaagaaagcatgtgaagaaatacaccagattgttaggagcagttaaaaaacaaaaagcaaacaaaaaagtggtgaaaaggagctgaggatgttcccttctattgtccatgaatttttacaattagtagtgattattttaataattatccccactgccacgccagccaaaaagcagtggtgacaagtcactttgctctcccacatctctctctctctctctccagccatgcctcttccctccttctcagcaccccgtctctcccccagcacacccctaatctttccactccaggctttaaactctttgacatagtttcctccaagtgttggtcagctactctttgtggggagaagagtaaactgtcccaggggccaacataaaaagagagcttgtttctgcctctaatgttttgttcatggtggttcccgtacctgttactttccctccacttattgtttccagcatttttttttttttttttttttgagacagagactcactgtgtcgccaggctggagtgcagtagcgcgatctcggctcactgtaacctccacctcctgggttcaagcgattcttcttctcagcctcacaagtagctgaaactacaggcacatgctaccacacccatttaatttttgcctgtagtcctggcaactcaggaggctgaagtgggaggatcgcttgagcctaggaggtggaggttgtagtgagctgaaattgtgcctgtgcactccagcctgggtgacagagtgagaccctgtctcaaaaataaaaatagtaacatacaagagtggtttcttagttatgacaattgaccagtcatgtgagatgagaacatcaggagaagcaaactgggggaggggaatacaagaactctctgttgtcttcattaattctctgtgcgtctaaaattattccaaaataaaaagtttattgagaaaatacattagcaacatggaaaatgcttatgatataatattaaatgaaaaaaaggatgacaggtatctgctcagggtaaaaaagaagataaatggggagagaaggaggaagtgagagttggcttcctcctacctgtcccacctcgtctcaactccctgattccattcttgctgatgcagccgcccaaaggagtatctgccactttatttcctgccagttcaaatcccatcccatcagctctcattaagaaaccctttccggccgggcatgatggctcatacctgtaatcccagcactttgggaggccaaggcggacggatcacctgagggcggatcacctgaggagttcgagagcaggctggccaacatggtgaaaccccgtctctactaaaaatacaaaaattagccgggcatggtggcgggcacctgtaatcccagctactcaagaggtgaggcaagagaatcacttgagcccagggggcagaagttgcagtgagccaagatcaagccattgcactccagcctgggtgacagagcaagactctctctcaaaaaaaaaaaaaaaaaaaaaaaaaaaaaaaagaataagaaggaatagaaaggaaggcagagtactgatgacatctgatccagccacaccttaatcctattgacctcagacttagctctatgagccaataaatccccttcctactttatttttgaaattgtaaattgataatttataattaaatttatgggatacaaagtgatgttacaatttatgaatacaatgtggaataactaaatcaagctggttaacatatccagtacctcaaatacttaacatttttgtggtgagaacatttgaaatttactctcttggcaattttgaaatgtacaatactctattattaactatattcaccatgctgtgcaatagaactcaaaagtatttttaaaatcctcctgtctgactaaaatctgatgccctttgatcaccatctctcccttccccacaacccccagcctctgtaaccacaattctaccttctgcttctgtgggttttagattccacatatatgtgagaacctgcagtacttgctttcctgaacctgacttaattcacttagcataatattctctaattccatctatgttgtcacaaatgtcagaatgtctttcttttctgttgttgttcttgttttttttgtttgtttgttttttgagactgagtctcactctgtcacccaggctggagtgcagtggtgcgagctcggctcactgcaacctccacctccccggttcaagtgattctcctgcctcagcctcctgagtagctgggattacaggcacccaccaccatgcccagctaatttttatatttttagtagagacggggtttcaccatgttggccaggctggtctcgaactcctgacctcaactgatccatccatctcggcctcccaaactgccaggattacaggtgtgagccaccatgcctggccgagaatgtctttcttttttaaggcttcatagtattcctttctgtaagtatgcaacattgtctttatccactcatttgttgatgcacagttaagttgattctgtaacttgctattgtgaatagtgctgcaatgaacatggggtatagacatctcttcaacaaactgattttaaacctttttggtaaatacccagaagtgggatttcaagatcatatggcaattttatgtttagttttttgaagaacctccatactgttttccatattgactatactaatttatattcccaccaacattgtacaattgttcccttttctccacattcttgacaacatttatctttcatatttttgataaaagccattctgaccagtatgagatgatgtctcattatggctttaatttgcatttccctaatgattagcaatatcgagtatttttcattatatctgttagccatttatatgtattcttttgagaaatgtctttatctctggaatgcaaggagggttcaacatatgcaagtcaataaatgatatgccacattaacagaataaatgacaaaaatcatatgattatctcatcagaagcagaaaaaaattgacaaaattcaacatcccttaaccataaaaacaatcaccaaattaggtatacaagaaaggtagctcaacaataaaagctatccagagatgctgacagctaacagtgactcagcagtgaataactgaaagcctttcccccaagatctggaacaagacaacaatgcccactcaacatggaattggaagttctagacagagcaattaagcaagaaaaagaaattggcaatagatttaaccaaggagacaaaagacttatacaacgaaaactataaggtgttgatgaaataaactgaataagacacaaataaatggaaagatatttcatgttcatggttcagaagaactaatattactaaaatgttatactacccaaagtgatctacaaattcaatgcaatccctatgaatatcccaacatcacttttcatagaaataaaaaaaaaatccaaaacttcatatggggctggacatggtggcttacacctggaatctcagcacttcgggaggccgaggtgggaggatcacctgagatcaggagttcgagaccaacctagccaacatggtaaaaccccatctctgctaaaaatacaaaaatcagccaggcatggtggcactcacctgtaatcccagctacttgggaggctgagggacgagaatcacttgaagctgggaggcggaggttgcagtgagccttgattgcaccacttgcactccagtttgggccatagagtgagactccatctcaaaaaacaaaacaaaacaaaaattcatatggacaacaaaaacctcaaacaaccaaggcaatcatgaacaaaaaggacaaagctggaggtatcacaccaccagatttcaaagtatactacaaatctatagcaatcaaaacaacatggtattggaaaaaaaaaaaaaaaaaaagacagacacattgactaatggagtggaatagagagcttggaaattaacctactactatacagtcaattgattttcaacaaaggtaccagaatacgcaataggaagaggacagtcccttcaataaatagtgttgggaaaatgaaatttccacctgcagaacaataaaattggacccttatctcacaccatatatagaactaaaaatcaaattaaaatgaattaaagattcaaacgtaataccagaaactctaaacttactggaagaaaacacagggaggaaaaactacatgacactctctgggcaacggttttttggatgtgaccccaaaagcacaggcaacaaaagcaaaaatagacaaatcagattacatcaaactaaaaagcttctgcatagccaatgaaacaaccaacagcatgcagaaacaactcacagattgggagaaaacagctgcaagccatacatctgacaagggattaatatccaaaatacagaaggagctccaacaactcaatattaagaaaacaagaaacccaattagaaaatgagcaagggacctgaatacacatttccactaaagtttttaagacataaacatactttggcataaacactgtattatatgcaattactttttgtaaataatttttgtaaagccatcagatatatatccaaatgatttttcacctgagtgtaagacaggaaaatgtttaaattaatacataaatcaaatcatctgcactggcattgttaacctagaagaaagtggctgcatagagaatagtaaaagcaaggatatttagtccatactttcaaatggggcttgatgatttgaaacaacaaagttgttcactggcagaatttcccaccaagtctgtataaattatgtgctatttgataaaagatagcctgaatgaagctaatttttttatcttcagtatttgctttaagagaaaaatcctgaagcttgtagggatttctaatgccaaaaaagatgatgaaatgggagagtatatttagcaatcatggtgactaagctcatggtaactggcatatgtaaaattttagtttgcattccaattacttaaactgagatgttcttgatcagttgaacatactgtgagtagacgatctctttctcagagaaacaagatggagagatcttcagagaatggccccactgaagctcattggtaaatgagctttctccagattttgttgatttcctgagtttttccataattcctcagttccctggccattttctgatagaccatggtcttcctattgccctttcttattcctcaaagtttggcaaatttttcttcattttttgatacaaactggaaactgcctttggttttatctacttactgaatgcagatgccatcttgggattatactgagatttgtgaagttattcaaacagtcagagaagcttcccgccttgtcctccctgttgctggaaaacagcagactgcaccagctggctttcagttatgttccacaaagatcaatgaatggttccttcaaaatagaagtctgcagcattatttattaaagttctccaattataaatagattcctctgtaagcaacattccatagcagttggaatctcctctgacatgggtacaatcactgatgaaaaccaggtaagttttgaagatctccagttgaatgttgcctcagtacctcaaaagcatcttcaaatgcttgagccagcttgtctcgttcacacaagttatgcttcactaataaactgatgattctgtccatcagtgcccaatctagcatgtacttgtagatgtggagataatcttccctcctctgaaacacacatctgcactccccaccacccactttaattttgttaaagcagttttgagttgggtttctgtcatctgcaaaggaaaaagtcctgagtcatttatacctaagaatcagataatttaagtaacaggctctaacatatgaaaatagctgagatagtgtggggtgcaaaacagagaggagataattattcccatccctaaataatatttgaaaagttttgttatacagtagaaatgcaactggctatccaatgatttgttaaatctttggactcagccccaagaaaaatagcaagatattgaacattacttgtggcctcaaataatattatatgagaaaagcagaagttcagtccaagctatactatctaaaagcagagagggaataatgaaacttcattttttagaaaaatctttatacccataccttgcaatccttgaggactgggagtcagaatttgaaaaggccaaattctgcatcctaagctaaaatttgtgaagacaaaagcaaagagataaagaaataccatactaaaatattgggaaagaaattgaaagggacacaacaaaatgaaaagatattccagattcacgaactgaaatacttaatattggttaaattataatactactcaaagcaatttacagattaaatgcaatccaattacattctctacagaaatagaaaaaaatcttaagacatatatggaaccacaaaagaccccaaataaccaaagcaatctgagcaaaaggaacaaagctggaggcattacactacctgacttcaaattttactacaaagctatagtaaccaaatcagtatgacactggcataaaaacagacagaatagaccaatgggacagaatagagaacgcagatgtaaatccacacatttacggccagctcatcttcaacaaaggtaccaagaacatataatggggggaaggataggcttttcaataaatggtgccaagaaaactagataactatatgcagaagaatgaaactggatccttctctcttaccatatacaaaaagcaaatcaaaattgattaaagattaaatctaaatcctcaaaccatgaaactactagaagaaaacattgaggaatcactccaggacattggtctgggtgaagatttttttatgtcagatctcaaaagcataggcaaacaaagtaaaaatagacaaatgggattatttcaagctaaaaacttctgcatagcaaaggaaataatcaataaagtgaagagaaaacccacagaatggcagaaaatataactaaccacctgagacggggttaataaccagaaggtatggggagctcaaacaactcaatagcaaaaacaaacaaacaaacaaaaacaacataatccaatttaaaaatgggcaatagatctgagtagacatttctcaaaagaagccatacaaatggccaacaggcatataaaaaatattcaacatcacaaattattagagaaatgcaaatcaatgagatatcatctcgccccagttaaaatggcttttatcaagaagacaggcaataacgcaggctagcgaggatgtggaagaaagggaacccttgtacactgttggtgggaatggaaattagtacagctactacacagaatagcttggaggttcctcaaaaaactaaaaattgtgctaccatatgatccaggaatcccactcctgggtatatctccaaaagaaaggaaatgaatatatcaaagagctatctgcacgcccatgtttattgcagcactattcacaatagccaaaatatggaatcgatctaagtgcccatcaacgaatgaatggctaaagaaaacgtggtatatatacacaatggaatattattcatctgtaaaaaggaataaaatcctgtcatttgcagcaacataaataaaactagaagtcattatgttaagtgacacaaagagacaaatactacgtgttctcactcatatgtggaagctaagaaaaagtggatctcatgaaggtagagagtagattggtggttaccagaagccagcaagggtagcagaagtaggggattcaaagaagttgataaatcaatacaaatataaagttgagagaagaaataagctccagtgttcaacagatgagtagggtgactatagtttacaaaaacatactgtacatttcaaattagaagagaaaaattcaaacatttctaggataaagacaaatattaaggtgatggatatcccaagtacactgatgtgatgtatacaaattatatgaatgtattaagttatcatgtgtgccctgaaactatgtaacttattatccatcaattttttaaattgttgaaaaaatgattaaatgaataaataaaatattgggtcttggatgagccagaaaatttgggaagtctgattctctctcaaatattatattctaggtattctttgccagacaaaagcatcatatcccttataaaaatgcatccagtaggttataatcttgggggaaatgccacattatttagcttcattttccccttcaagtctttcacattgttcaaagcagacagcaaagtgaaagcattattttgggagatggggaaaagccagaatagattattggcaagaaatagaaaccacaagatgaggatcaagagtcaaggtccaggtttagacaagatctctggatgtggttattatgccacagaatcatcaaatgtcaactgaggttttaaatactgcttaaaaatgccaagcctggaaataggtgcctgtaattcttcagtccttcagtaaatacccaggctattaaagtaggtaattcccaggaatgaaatcctccttgcacctctcttaggggtggccatggaggacacaaaacacagatatttatctttggaagaaggaggtagaactgtttttgaaaatatatataaagtatagttgtgtttggagaagcagaggcatttttgaaactatatgtataattagaatggtatgtgaatatatatacaaccaaagacaaaggggtaaaatggggtaaaaatctactattattcactatacggcactcattctcaactaccttctcagatctaaactctacttttctgtagagaaccccttccctgtggttaggacagggccaacactgacttgccaccatgacgacatcagtgggtacatgacctagactcagcaaattatgctacccataacatcggctaccatgatcatttaagatctggacatgaaatctaaactaggttctccctggacattttctgaaaggtattagagagtgggtgtagtggctcacacctgtaattccaacattttgggaggctgaggtgggaggattgcttgagcccaggagttcaagaccagactgggcaacatagggagaccttgtctctatgaaaaacaaaaaaattagctggaggccgaggcggacggatcatgaggtcaggagatcgagaccatcctggctaatatggtgaaacccgtctctactaaaaatacaaaaaagttagctgggcatggtggtgggcgcctgtaatcctagctactcggtaggctgaggcaggagaatggtgtgaacccgggaggcggagcttacagtgagctgagatctcgccactgcactccagcctgggtgacagagcgagactccatcttaaaaaaaaaaaaaaaaaaaaaaaaattagccaggcatggtgatgcacacctgcagtcccagctactcaggaggctgaggtgggtggatcacttgagcctgggtggtcaaggctgtggtgagctgtgattgcaccactatactccagcctgggcaacagagcaagaccctgtctctaaataaataaataaataaatataaaagtaattttttattatacattaagttctgggatatatgtggagaacgtgcaggtttgttaacataggtatacacgtcccatggtggtttgctgcacccatcaacccgtcatctacgttagatatttctcctaatgttattcctttaaaatggaaggtattaggaagatttctttccactgtcggtcaggaatgagatggatgtggtgctactgaaggtcgccttgccactctgtagtaaaagaaacctctgcaacgaatttgaggaaatcacagctgacagatgtaaagaggacacagagccctcctcacattgttagaattcctggaactaaacaaatcactccttttaccttccagctgtgtaagcctcctcctcaaaaaaaagaaaatcattttttgtgtaagctagtgttttctgcaatttaaagctttaaaaatccaactcaacaacaaaacacaacccaatttaaaaagggacaaaagacttgaatagacatttctctgaagatatataaatggccaaaaagcacacaaaaagatattcaatgtcattagtcattagagaaaggcaagtcaaaagcacaatgagatataccattttacacccactaggatagccatttcttaaaaatagagaataaatgttggtaaagctgtggagaaattggaaccttcatacattgctggtggggatgaaaaatggtacaaccactgtggaaaacagtttggtgattcttcaataaacacagaattatcacatgacctagcaattccactcctaaatatgtacccaagagaagtaaaagcaggtgttcaaataaaaacgtttccatttgtttacaaaatgttatacaccagtgaacacagcagctctattcacaatagccaaaaggttaaaacaatctaactgtccaccaacagatgaataaaaaaaatgtgttttgataccataaagttaaatgttcttcatccataaaaaggaatgaacgaaaaatacaacatggatgaccctcaaaaacactatgctaagctggccgggtgcagtggctcatgcctgtaatcccagcactttgggaggatgaggtgggcagatcatgaggtcaggagttcgagaccagcctgaccaacatggtggaacctcatctctactaaaaatacaaaaattacctgggcatggtggcgcacgcctgtagtcccagctacttgggaggctgaggcaggagaatcacttgaacccaggaggcggaggttgcagtgagctgagatcgtgccactgcactccagcctgggagacagagtgaggatctgtctcaaaaacaaacaaacaaacaaacaaacaaaattatgctaaataaaggaagccagacaccgaagaccacatattgaatgattccatttataagaaatgtccagaataggcaaatccatagagacagaaagcagattagtggttgccaagtgctgagaagagagagaaatggagagtgactgcttagttagcatttctgtttagggtgattttttaaagttctggaccgagatagaggtgatggctgcataacatgggtgaacaggcttaatgccactgaattgtacactttaaaattgttaaaacttcaccgtgattttaaaaatgttaaggtccctgactaatttaagcccactctgcaccgtgtagtcaggaactaggacttagagctggcatagagtgggaatttgtcaaataatcaccatcattttggattcttaatgagttgccaactgtcctaagtattactattttacatattgtaatgaatgctttgtgaaacaaaagcttttgtggttgttgctgttgattacaaattttatctctttttttaacttttattttaggttcagggtacacatgcaggtttgttgtacaggtaaattgagtatcatgggggtttggtgtacaaactgttttgtcacccagctgataagcatagtacccaataggtagtttttgatccttagcctcctcccactctccaccctcacaaaggcctcagtgtctactgttcccttctttgtgtccatgtgtactcaatgtttaggtcctacttctaagtgagaacatgcagtatttggtttcctgttcctgcattagttcacttaagataatggcccccagctccttccatgttgctgcaaagaacatgatcttgttcttttttatggatgcacagtattccacgatgtatatgtgccaccttttctttatctggtgtattgatgatgggcatttaggttgattccgtgtctttgctattgtgagtagtgctgcaatgaacatatgagtgcgtgtgtctttatggtagaacaatttattttcctttgggtattggtatggtttggctgtgtctccacccaaatctcatcttgaattgtagctctcataatccccatgtatcatgggaggaacccagtgaaaggtaattgaatcatgggggcgggttcttcccaagctgttctcatgatagtgaataagtctcacaagatatgatggttttataaagggcagttcccctatacacactctcttgcttgctgccatgtaagatgtgcctttgctcctctccaccttccgccatgattgtgaggcctccctggccatgtggaactgtgagtccattaaacctctttttctttataaattacccagtcttgcatatgtccttatagcagtgtggtctactgcaggtatatacccaataaggagattactgggtcaaatggtagttctgtttgaagctctttgagaaggctccacaatgctttgcacaatgactgaactaatttacatttccaccaacagtgaataagcattcccttttctctgcaatctcaccagcatgtttgttgttgttgttgttgttgttgttgttgtttgagacggagtctcgctgtgtcgcccaggctggagtgcagtggcgcgatctcggctcactgcaaactctgactctcaggttcatgccattctcctgcctcagcctcccgagtagctgggactacaggcgcccgccaccacgcccagctaattttttttgtatttttagtagagatggggtttcaccgtgttagccaggatggtctcgatctcctgacctcatgatccacccgtctcggcctcccaaagtgctgggattacaggcatgagccaccacgcccggccagcatctgttatttttcagctttttaataatacctattctgactggtgtgagaggatgggacatttagaggaaaaatcagcctttcttgtttcttccctcacagtcagtattaataaagactaatccctttagactatcacaagaagatactgcagaggaaagatgaagcttcttttaactaaggggtcacggccgttataatttgagcatcaaaagactggatgaaaacagatgtggccagagttctagttcttgttttggaggactagacggtatcagattaacccctctgccaaaattatttataaactctgggcaaaatataacaaacaggtctttgaagggactggagataaaccttagcaggcagaaactgagcagggaacagacagtcctcaaaatgaaggaagcacgtgagatgagctccacatttaccaagatttttctcctgagggacttcccagcttgctgctgctgcacacagcggaagagatctcaaacagaaagaagcaattttaggggatgtggagctagagattcgatttggggctcccagagaagctggaaattgaggaggaaatccccagaaaagggggacctatggaaggaaaataattgatagaacaagtagatgaaaaatcagtaagaacatagatttgaacacaattaacagacttgatcaagtggacattcacacaacacagcacccaacactgcataccacacactcttttcgagaactcacaggacctttacaaagtgaatcacgctggacgataaagtaagtctcaacaaaattaggagattgcaatcaggcaagacatgctatggctagtatgagcaaacaagccagacatcaatagaaatgacctgttttgaagatggcatggtattaacacagggattgacaagtagaacaattggaatagaagaatggacagcccagaaacaggcatatatggacacttcatttttgacagaggtggtgttaccagctgagggtagttgtccaggttcttggcgttttgaacaaagaactggacaaaatggacaaagcaaggcagcaagagcagagatttgttttaaatgaaagtacactccacagggtgggggtggctcatgcaagcagctcaagattcttggttacagaattttctggggtttcaattccctctaggagtttcccattgtcccccgaccagtctgattggttgcaggaggggaccaatcagaggtactttcatttttcaaccgccaggcagaaaaaggaggggcagcaactgtcgcgcagaaaaagggggtgttgaagagtagcctctgatatccagtgagcatgaaccggccttaggtttcctgcctccagaccctattctcctgcctcatttccccccctgagagacaggatccccgtaagtctttatgtgagacagagggactgatggtcttttttctgtaactgcgtcacactgacttgactgacagtccctgcctattggaatcacagaactctcaccctgctctgtctagtggagacagggtagtttcttgatggccaggggtggtgaattcatttggaactggctggaaaccttactgcacaatcatctccaggcaagaggaaatgaatggttaaaagatttcatgggaacttcaggaggtggacacctatgctgtcaggaatgtttgttatagaaatgaattaaaagattctacttaattactatgaaggaagtgattccaactgtttgaaagaaggtaattaatctgcaaaaaaaaaaaaaaaaaaaaaaacatggctactattatccagcctacagtaactatgcaacaaaaacaccaaggaacgttggtaggcatttctcttttggctgtcttctaaacaggtacttcagggctgccacaggttcacaggtgcagtggctgatgggaacttcaggttccaggtccggggcttcaggtatcacagacttgatccttgaaaggtgtatccaactatctaatcccagtactttgaccgcagaaggcgtggccagtatcactgaaaacggtgccttccattggggttgtaattgttgaggaggtgacccctccgtccatgctttaacaagcaccttatctgctggcctgatttgaggtggctggttagcttccagtaccggaagcctttgagttccaaacttctgtataaacctgctgacattgtcctaggttaactaggtattttactaaaccagctgtttctgaatcagtaattacatcatcagttaagaatagccttctgtaatcccagcactttgggaggccaaggcgggcagatcacctgaggttaggagttcaagaccagcctgaccaacgtggagaaaccccatctctactaaaaatacaaaattagccgggcatggtggttcatgcctgtaattccagctactcgggaggccgaggcaggagaatcgcttgaacccggaaggcagaggttgcagtgagccaagatcaaggcattgtactccagcctgggcaacaagagcgaaaattccatgtccaaaaaaacaaggccgggcacagtggctcaggcctgtaatcccagcactttgggaggccgaggcgggcagatcacaaggtcaggagatcgagaccatcctggctaacacggtgaaaccccgtctctactaaaaatacaaaatattagctgggcgtgctggcgggcgcctgtagtcccagctactcgggaggctgaggcaggagaatggcgtgaacccgggaggcggagcttgcagtgagccaagatcgtgccactgcactccagcctaggcgatagagagagactccgtctcaaaaaaaaaaaaaaaaacacacacacacacacataaaaacaaactaatagccttcgtataggcttatattaaattttgctctaggggtattacagatttttaagagagctatgggcagtaagctgacccaagcttctgatgtttcctgatcgaacttagctaacgatccttttagaggttgattagccctttctactttcccagaggattgaggcctccatgctgaatgtaaatagtatttgattctgagagccttagcaactacttgagttatctgggagataaagtatgggccgttatcactttggagacgctgaagtaacccaaactgggggattatttcttttaagagaaccttataaccacagtagccttctctgatctggtaggataagcttcgacccaaccagtaaagatatctattagcactaacaaaaacttataacctctgccagctggcatatgtgtgaagtctaatcgcccatcttttcctgggtatgttctatcagcgtcctctaatacaactcccctctggactggttctattacaggaggcattctgtttcctgggctgttcagtgcacacagtgagcaggtttgacagacatgcttaaccacagaagctaagttaggctcaatgaagagcctgttaaccacggccagggtggcttctctccccatatgcaaagagtcatgcagagtttttctaattctccatcaggctgcttgagggagatgtggttttgatgccatgtaccaccagcatcctgggttttgtcccccttgctcctttattaactgttcttcctgtggtgtgtattcaggctccattggggaatcacagaaaagaagtagagctggaatctgttgggattgcaccctgagaactacagctttcgcttctctatcagcctttctgtttccttgtgctataagggttaaggccctttgatgctccctgcaatgaattacagctacagcctttggcaggtgtattgcttccaaaagctgcagaatttcaggcctatgctttacaggggagtgtttgctagttagcagccctcttcctttccagattgtagcatgagcatggcaagggttacctggtccggtggaacctcccttacttcatcatcacttactgccttagttattccctttctcattcctccaaggagagcctcaagaaatttagcccagtttttcgttcccacgagagcattagagtctcaattaggatcagttgtggggactgtgtctgggcccaggtgattgccctgagggttttgggcaaataaatcgtctgcttcccagtgggcagcctcaaaagattcattccttttcaaagggggtgcaagaggttgctagaatgaattgaacatttctctgtgagagatcgaaggctgaggtcaaagtttggaacccatctgctaatttcctgggattcttagaagagcttcctagctttccctgacaccgttgtatatcagttatagagaaggtggcctgcactaggactggcccctcggctcctgctacttcctgaaggggtagcagggctggagggagagtggaatgtagtgtcccctccgagcgtgagggggacctagtagggtgtccagggtttgggttttagcctcaggagcacttggcaaggggctacgtgggggcggttatgttcaccctgagagacaggtggcccttataaaagggggtcatctatactatctagtcctgtctttggactttctttgcggagatgattaggttttggcgtagggccgtgaaggcctgtacatatggtatttctgaccatttgccctgccaggaaacagctgctgcaagactgaaaagaaaaggactcaggtccctcacccaaaccgggtggtggtgatcaggcgcttccacacggaaccctttcagtttccctggagagtggccccaaccacaaacctgcggttgcctccatgcctaggcactgtccaccgagagtcccgagttggaaaggaaaagagagagaaagaggacaaaaaggaaaataaatcccaaacgttgggcttacctcctggctggctcaccaaaatacgttaccagctgaagggtagttggccaggttcttggcgttttgaactgagaattggacaaaacacacaaagcaaggcagggaaagcagagatttactccaacagaggacagtgggctcaagcaagcagctccaaagcctgttactgaattttctgaggtttaaataccctctagagggttcccattggcccccgaccagtctgattggttgcaggaggggaccaatcagaggtactttcatttttcaactgcctcgcagaaaaaaggaggggttgaaaagggatgaatcgggcttgggttccgaacctaagcccaattcaacccctcctttccctcataagcagcatgaatcagccttagcttccctgcctccagaccctattctcctgcctcagtggtagtgtagatcaggcgaggaagtagaaattctaatagacagtggtgggacagggaagtgtccatatggaaaaaaatggacctttatatcatacgtaaataaatttcaagtagattaaaggtctaaacataaaaggcaaaattaagcaatgcatatagaagtgtaaaactataaacatttgcaaggaagtgattgtcacacgtttggagagtggttacttccgggaagaggaagaggtttgttgcaggtaggggatggagtggggaaagggactctgtccatattctaactcttggactgggttgtagctatctgggtactttttaatttgctttaaattattttttaaattgtatataaatatggtggccttttgtgtattctatacagtccacactaaaaatggttaagaaaaaaagcatgacgtatttaaagataaccaccaccgtaagtcaaatcactgagtaacttaaagctcacaagtaatatttaagagtacccagaaacttgttctcctcctagaaaatatatacagtcaaaaaaaacaagagccctcaaaagtgttagtccaaactgcaccattatgtaagtctcccgccatttcacagaccttggtcaaagtggaacattccacgggggttcggaccgtgagaaacagcctgcctcttatcttattctgctaggagaaaatgcaaggaacaccacactccaccagaacaagggccaaaccgcctgatcaaaggaacatcttatcaatatcctatcaggcagcaagccatactgcccaggcccctcccgcccatacctataaataccccagcctgtaagcagtgggcactgacactaagctggtcccccacctctataagtttatcctggacataaatgcctgcatttgctgttgagccattttctctctctctctctctctctctctctctctctcactctctctctctttttttttttttttttttttttttgagatgtagtttccctcttattgcccaggctggagtgcagtggcacaatctcagctcaccacaacctccgtttccccggttcaagcgattctcctgcctcagcctcctgagtagctgggattacaggcaggcgccacaatgcccggctaattttgtatttttagtagaaatggagtctctccatgttgatcaggctggtctcgaactccccacctcaggtgatccgcccgccttggcctcccaaagtgctgggattacaggcgtgagccactgtgcccagccaagttgttattatctaaggacctgaaatcaatagaaaggaattgtctgggttaagataaggggttgtggagaccaagattctgaggtgggaggcaggacttgactccagaggtggggctaggacactagaccagttgaaggctagctaaaaacaggtcggggtgcggggtggggtggggggcagaagcaccttctcataagacacacccaccagtgtgccaagtcagttgaccattgccatggcaacacctggaggttactgcccctttccatggcaacgacctgacaactgggaagctatcaccctcattctagaaatttctgcataactcctttaatttgcatataattagaagtgggtatgagtgcagacctgcctctgagctgctactctgggcacactgcctatgcggtaaccctggtctgcaaggaggaggacctccgctgctgctggtacactggtgcttcaataccaacctggccaacatggtgaaacctcgtctctactaaaagtacaaaaattagccaggcatggtgtgtgcctgtaatcccagctaatcaggaggctgcggcaggagaatcacttgaacccgggaggcggaggttgcagtgagcccagatagtgccattgcactccagcctgggtgacaaagtgaggctctgtctcaaaaaaataaataaataaaaaagataacataactctttcaaccaatttccagtcagaaaatctttcaatccacctatgacctggaagctgctgccttgagttgtcccaccttttcaggctgaattgacgcacacctgacacgtattgattggtatctgtgtaacttctgtcaccctaaaacgtataaaatcaagctgtggcccgagcaccttgggcccatgttcacaggacctcctggggctgtgtcgtgggccttggtcactcatttcactcagaataaacctttttaactatgttacactttagccctttttgtcgacagcctcctgtcactttcccttgagaagacgctgttttcgagaatactcccagtacctgcctttcttgtgccaactaagaacactcctattcatcataacctgcattctcacggagggtcgcttgttactcaccaggcaaacaaaccctggctttccaggtaacagtcggccctctgtatccacagattccacctctgccattatagagggctaagtatatgtaaaacctgtcatttagagccatgtgatttaaagaaaaatatctcactcatggatttgatgggtactgatatgcacttggctataagctattggtgtatccacaagctcattggaacagaaacccaactattacaacagaccctgaaattttgtgagctctcaaaaatttctgctcaaaaaatagattctcactttctgcttaatttttccgtaaatctaaaatttctcttaaaatgaagtctattaattgaaaaaatatatactctggaaatgggcaatgttgtctttaagaaaaacttgtagtcggtgtgtttgttgttaagcagttacaaaatttaagttatagcatttctgatttcgattcttagaaacaaaactagatttgttttgctttagaaagaatgtaaggaaagctaatttgtgaagtaagtacttcctaaaatgaagatgaattcctgtttagataaaccaggagaggaagttaaactgagtgagtgtgggaagaaaaaaaaaaagattcctttgagagatgcgccttttgagcataattgaaagtgactgagatgtacaataacgagggaaccaggcaataattcattaatggagcagcagcattactctaaacaaatatttgcttttacataattaaccaaactaaaatgatctgaatggaaaagtagtttacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacacctcatacaaaaatcaattcaagatggattaaagacttaaacgttagacttaaaaccataaaaaccctagaagaaaacctaggcaataccattcaggacataggcatgggcaaggacttcatgtctaaaacaccaaaagcaatggcaacaaaagacaaaattgacaaatgggatctaattaaattaaagagcttctgtacagcaaaagaaactaccatcagagtgatgaacaggcaacctacaaaatgggagaaaattttcgcaacctactcatctgacaaagggctaatatccagaatctacaatgaactcaaacaaatttacaaaaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagagaatgtggagaaataggaacacttttacactgttggtgggactgtaaactagttcaaccattgtggaagtcagtgtggcgattcctcagagatctagaactagaaataccattcgacccagccatcccattactgggtatatacccaaaggactgtaaatcatgctgctataaagacacatgcacacgtacgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcgctcataggtgggaactgaacaatgagatcacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacaatgtgcacaggtaccctaaaacttaaaggataataataaaagaaaaaaaaaaagaaaagtagtttggagtattaactatgtacatgattactctcaagcagattacaggcataaatggcggttgtatttcacataactgcacatcaatagctttcaaaagaatctcaaccctccactgaccacagttcagacagattttccatttagatgcctgtttgatgcctcaaggccttagacattgccagaaatgacaaatgacagttgtcctggatatttctaggaacaccagctattatgctcagaatgttataataactcttctatttattacctacagctaaaaatctaatgatggttattttatagtgtctctggaaattggaaaggtaatcatgacctcgaacttctacaaacagagtggggggagacttaaaagaaaagggcttgaattatataattaataaatatcaatttttaagcataaaagccattgggttttttattattttggtagtgttaggtacatagctataagaaggtatcccaagcccgttttctcctcccagtcctgtgtcctaaagttttcctgatgtgtcaatagagtgtcactatagccctgtgaattagtagatatcgctctaatgagatatttacgcaggatgaagttgggagaaagtaaaggaatgcctaagccagagatctctgccaagattcacaccagcacctttcaaaactttgcagcctatgaagagccaaatattgcataatccagatcatgttttccaatattgtcaatggaaaatcctaaagtaagagattctcagaatcagagatactacttcaacccagattcttgtctcagtgcaggtcgtaaagacaaacaggcttgactctgacttggtactttcttctaagttcctaagctataacataaatatgcaatactagaaggtcataattattcacaataaaatgtcaatgcatttatttattaatatgcttcatttcagacagaattaacaatcttattcttctaacatatagcacttagtgagcccaatgaataaactcttgagagaaccttaatcagactctgactaaatacatgttttggcagatgtcttagtccattttctgctgctataatggactgtcaccaacttggtaatttataaagaatagcagtggctgctgggtgcagtggctcatgcctgtaatcccagcactttgggaggccgaggtgggtggatcacgaggtcaggagatcaagactatcctgtctaacatggtgaaaccccatctctactaaaagtacaaaaaattagccgggcatggtggcgggtgcctgtagtcccagctaccgggaggctgaggcaggagaatggcgtgaacccaggaggtggagcttgcagtgagcccagatcatgccactgtgctccatcctgggcaacagtgcaagactccatctcaaaatatataaataaatttaatttaatttaaaaagaatagcaatttatttgactcacagttctggaggctagaaagcctaagaacatggtgtcagaatctggcaaggaccttcttgctgcatcaacccatggcagaagggcaagcaagcacacaaaacagagacagaaaatggagacctaactcccacgacagctaagccactcccatgataacgtcaatctattcacaagggccaagccctcatgacctaattaccctttaaaggtcccatctcttaatactatcatgatggcaattaaatttcaataagggttttggaggagacattcaaaccatagcagcaggtatgagcaggtttaagtcagaagtccattgctagctatgacttactgacgggagccattgaaacagttaaacacctaggaaactaccttcttttgactcttcaagacattttgtaccagattatattggattatacgtagggtggaagcaggttttcgcatgccctcacttacagtacatatttcctatgttaggctcttctgtgaaaacttcttgttaatttttcaaatctgatacttactgagtacctctacatttttgcacttctcatttccagtaatccattttatctctgattatttctgtttgtcttggttactgcagttttattgtaaccttgcagtctatttgatcttttcactaatatttcctagtcttttttactcattttctatgaattctaactcatgcttcagctactttggtacccctttaaattcttcagtttctaatgagctttccaaaattcctaaggatagctaagtaattaaacgttgaaaaaagtgcctttaattgttataaacaatcactgttatgtcacctattaaatgtaaacatttccataagtaccagtgtagttttttcttgatcactggagacttgcccatttgtgagctagagtgatcacgtgaaaacctcaacaactaaaccatttcccattttacgattttgttttttgtgaaatttttttaaattattagattataaactatatcagacataccaaaaagtataagcattttatatgaagaaatttcataagagtagtctcttgttactctttttatcatcttacactgaatgaccttcttattttttctatttaaaaggtttgggagccaaatgcttttgtgggggtattaaataaaatgtatcggaggccattggttttgactgagctcctatactaagtccaacagaccaaaccaaaatggagtcactcatgctacaggcccacatcatcaagacaaaactaagttgtttatctgaccttccaagaaatcaggagagtgagacataatagccaaatccccaaacaacccaattttagctggtataataaggaagtccactctgctttaatctttacgaggaaagtaactctgaaacaaccagtctaccttttattttctatttctgctttcctcagccattttctgcctaccaccacctctgctcagcaactcagagcactcattctattttgtaggatgaggtgttaccttactctagaatggcaaataaaaaccaattaaggtctctaaatttgttgtaattttgtcttttgtcttttgatgggggttagccacttttgtatcctctgataatattttattgtatacaacttgtacacctgtacaccattctccttcatttgtttacaaatatggcaattttttcttcatgtcaaaagtatctacatccattgtaaaaaaaaatttaggtaatttggatgaacagaaaagaagaaaaataatataaaaaccatacaaaattctaccaccttgagatgtttcttttttgtatatttccttttgtgtaaccagggaggaggcctacactgcttatttctccttataaaggaatttccactcatataactcctgttgctaatgctgccttattttgtgccacgtggccccattccacaagtcacacaaatcacactgacgatgaaaaccctacctatattagtcaaggtttagtcaagaaaacagacaccaccctagacttttcaaaccaaataaagaggaacgttaataaggaaattggttacacaggaaatggaaaagctgagaagccaaacacaggatgagatgatgaggccactgagaggtcggcaacagccaaaagcaactgccaccctggaactaaagggtcaacgggatgaggtagtttcatcagagcacagaagttgaggccaaacagaaagagccagaactaaggagagggtatttcccccgcaggagctggaaccacagagagagcgtttggttgggaggaattggagacacacaagaaaagctgtcacggaaaacagagaaatagggggcaatatcctaggctttcccctcctcccaccctccagtcatctgctatcatctttctgtggccaaacttacccaaaagacttcaggcaaaggaaatgatgggaggtggggtgggatgggagcaaagcacaggcaactggccaacaattgtctaagagtagcccctgaagtgactggccacacatcacctatggcgtagtcttgctaaaaatgtttaagctgaatctaatcatgaggaaacaatcaggcaaatccatattgaaagacattgtactaaacaaccagcctagactctccaaaatgtcaatgtcctaaaagacaaaagaggacagagaacttatctaaattaaataacattagggaggctcacgcctgtaatcccaacactttgggaggcagaggcaggaggatcacttgagcccaggaattcaagaccagcccgggcaacatagtgagaccccatctctatatacaagaaaaatcaaaaaatgaggcgggaggatcacttgaacccaggaggtcaaggctgcaatgagccatgatcaagccactgcattcctatctgggcaagggagtgagatcctcctgtctttcaaaaaaacagaatattagggggacatggcaactaattttgatgtgtgatcacagattaagtattggatcaaaaaagaatggtatataaaggacacgacggggcaattgtggaaatatgaatatagttagtacactagatgatagttgtatagaaatgttaaatttcttgagtgtggtaatttggttgtggttatgtaagagaatgcccttgttctcagcagatatatgctaaagtatttaaaggtaaaatgtcatgatgtcttcaaccaactccatatatatatgcttggagaaagaatgtgtgatcaaacaaatgtggccaacgttaaaactggtgaatctaagtgaagcgtctataggcattcatggtactgttcttacaactatcccaaaggcatttttttttttttcagatggagtcttactctgttgcccaggctagagtacagtggcacgatctcggctcattgcaacttctacccgcagggttcaagcgattctcctgcctcagcctcccaagtagctgggattacaggcacctgacactgcacccggctaatttttgtatttttagtagagacggggtttcaccatgttggccaggctggtcttgaactcctgacctcgtgatccacccgccttggcctcccaaagtgttgggattacaggcatgagccactgggcccagaccctaaggcttttcaaaataaaaactcaggaaaaaaaaaaaaataggatggcctctgacctccgaccactgacacgaggtaaagagatgaattaaaccaactgttcttaggaatttaaacctaaacaaaaagaatttgctacttagcaataaagttggaggtgacagaaaaacatgtggagttcggctatagcaaattaaaattacgtacacaccaaaattatgaggtggaagaaaagatatggcaaattgtttgcaaaaatagttgccacagatgcttctcatctagtaagcaattctcccatcatgagatgaaatctatgtctccctgcgttctagactggtcttgtgacttactttgaccaacagaatgcagaggtgacacggtgccagttcttgaccacgaagaggcttgacatcttgcactttccttctcttggagccctgagccactgcataaagaagaccaactgcccaggaaacaacagatgctggagaggatgtggagaaacaggaacacttttacactgttggtgggagtgtaattagttcaatcattgtggaagacaatgtggcaattccttaaggatccagaaccagaaataccatttgactcagcaatcccattactgggtatataccccaaaggattataaatcattctactataaagacacatgcacacctatgtctattgcagcactagtcacaatagtaatgacttggaaccaacccaaatgtccatcaatgatagactggataaagaaaatgtggcacatatacaccatggaatagtatgcagccataaaaaaggatgatttcatgtcctttgcagggacatggatggagctagaaaccatcattctcagcaaagtaacacaggaacagaaaaccaaacaccgcatgttctcactcataacggggagctgaacaatgagaacacatggacacagggaggggaacatcacacactggggcctgttggggggtggggggctaggggagggatagcattaggagaaatacctaatgtaggtgaccggttgatgggtgcagcaaaccaccatggcacgtgtatacctatgtaacaaaactgcacgttctgcacatgtaccccagaacttaaagtataataaaaaaataataagaagaagaccgactgcctgctggagagattggtctggccagtcttttgctgttctagacacctctgctgagccacacaggtgagtgaaaccacccggaccctccagccccaggcaaggcggcccagccaacaccacatgaaacaaaaccaagctgttcctgtcaatcccttcccaaagttcagcattgtaaaccaacaaataagtagtggttggtttttttgtttgtttgtttctgttttcttttttggagtctcactctgtcgcccaggctggagtgcagtggcgcgatctcggctcactttgcaagctccgcctcccaggttcacgccattctcctgcctcagcctcccggtagctgggactacaggcgcctgccaccacgcccggctaattttttgtatttttagtagagacggggtctcaccgtgttagccaggatggtctcgatctcctgacctcgtgatccgcccgcctcagcgcctcccaaagtgctgagattacaggcgtgagccaccgcacccggccggttgttattttaagacaatacattttggggagattcgttatacagacaatccccaacccacgatggttcaacttggtgtttttcaactttaggatggtgcaaaagcaatacacattcagcagaaactgtacctcaaatacccatacaaccattctgtttttcactttcagcataatattcaataaattacatgagataggcaacactttattataaaatgggctgtgcgttagatcattttgccaacttgaggctaatgtaagtgttctgagcacatttaaggtaggctaggctaagctaccttagactaggttaggtgtattacatgcatttttgacttaacgatattttcaacttacaatgggtttatcaggatacagccccatcataaacagaggagtgtctgtagagctaatagagaacagagcagacagacacacagagatgcctgtaggaaatgctaagttttactattccggttccttccgtgcgtaggctcaaaacaactcctactctttttgagatacagcaaaaaaagagccagagaaaaaaaatgtctcttcctggctgctctgcctatggagtagccattcttttattccttcactttcttaataaatttgctttcactttaaaaaaaataaaatgtagggccgggcgcagtggctcacgcctgtaatctcagcactttgggaagccaaggcgggcggatcacgaggtcaagagatggagaccattctggccaacacggtgaaacccccagctctactaaaaacacaaaaattagccaggcgtggtgacaggcgcctgtaatcccagctacttgggaggctgaggcaggagaattgcttgaacctgggaggcagaggttgcagtgagccaagatcgcgccattgcactccagcctgggtgacagagcaagactccgtctcaaaaaaataaattaaataaataaattgtcccttcttatcctttctctttgcaggtatttttgttatccaaagattcagaataaatatctcttatttctaattgtttcattgacttccccttttattgagtaacagcacctgatttttttttgagacagagtctcgctctgatgcccaggctggagtgcagtggcgtgatcttgcctcactgcaagctctgcctcccgggttcaagcaattttcctgcctcagcctcctgggtagctggggactacaggtgcccaccaccaagcccggctaattttttgtatttttagtagagagggggtttcaccatgttagccaggatggtctcgatctcctgacctcgtgatccgccctccttggcctcccaaagtgccgggattataggcatgagccaccgcgcccggccagcacctgattttttaaatggtttgttgtaaaatgcatcatacaaatagaaggatggataaaatttgctcgacagaaatatttaaaagtaatggcaaacgccacaattacttttgcaccaacctaatataataataaggtaaataatcatctacccagtttaaggtataaaacataaccagtcctttagaagcctctgcttatccctcccaaattgtggtctcttctccatccgcagtgataaccacgatgatgacttatgttaatcattctcctgtttcctttacagttttccaccaatatatacatccctaaacaacatgacttagttttgaaacactgagcagcaagcaccaatctagaagaataaggaaagggtgatgttaccactgtttgaggaaggctcaggaggagaagataaactgaacagcctctcggtcattgtctggcttcagcttccctaagcatttataagagctttttatgggaaaatcattgagtaagatgatgagtaacactgggaatcactgggctcagcacaggtgagacatacggtaacgctggagaatgggccgagttttagatgtttggccaggatatagtcagaaggagatggctgttgtgtatattctgctcatcacgacttctcctccacttcccagaagaggtcaaggcagaacatttctggatgacacccacagtagatcaagcatcagagcactcgaggaatgagcaggaactttatcagcatgtggtcaaaataaagaaagtacaaaggaaaaatctgggccagactctgggtattgagtccttgatttaaaagttagcatgatggcagtggggatggtggtgatggaagccctcagtgtgtctctccctggagtcctggtgtcccacttcttcaggctggacttgtttccttctgcacctagtgcataactgtcattctggactctcccatcacccttaccctagagtcccttcaccactctcctgtgtttgattcctacctgttgtgtcccatatgttctttcttggcttgtcctctcattcaagaagcacagcctccagtagccccttaagaaagaacgcatgggaagtaaatcttgcatatctgaaaatgcccttattttacactcatatttgattgataatttagctgggtgcagaattctaggctgggaatagtttttcttaagaattttgaaaagcattgctctggtgtctcttgcctctaccattgtttattgaagccggcaaagccaaagctgattcccgatcctttatatttgatcttcgtatgtaccctctcccttgctctctaagcttttaagatctcttggactttgttctgaaactccatgataacgtgccttgacaggtcttttttcatccgtttctctgggcacttgaagaaccctttcaatctggaaactcatgtccttcttgagttttgagtaaacttttctgtatggttttattgatgactgcctctcctacatattctttttctctcttgagcaccaattattcaaatattgaacacaccggtttttttttgttttttttttttttttgagacagagtctccctctgtcgcccaggctagagtgcagtggcgcgatctcggctcactgccagctccgcctcccaggttcacaccattctcctgcctcagcctcccgagtagctgggaccacaggtgcccgccaccacgcccagctaattttttttgtatttttagtagagacagggtttcaccatgttagccaggatggtctcgatctcctaacctcgtgatccgcccgtctcggccttccaaagtgctgggattacaggcgtgagccaccgcacccggcctgaacacgccagtcttaatctctaatcttctgtatcttttctcttctattgttcatctccgtgtcttcttgggcgatttcctcaagtttatcgtccaactcttctgttacatttttcaggtctactctcttgctttaatttttaagggcccttttttcttctcttaaaattatcaggatcttattctgttcttataacatgggtgcaatctattctgtacctttccaagtatattaatagtagacttttaaagtttttgtatgcttgtttattctatggggttgttttgtttttctttacttttgttttgggcttcatagtcaatgtctgaagcagcatctgattcttctttgaagaactgctgcctcccatattctcaatccatgtgagtgaatgcatcatttgctaattctttcaacttaaataataaacttgctttagtttggatgtttgtctccttcaaatcccatattgaaatttgatccctaatgttgaaggtcgggcccagtgggaggtatgtgggtcatgggggtgggtccctcatcaataaattagtgccttcgctcaagggtaagttcttcctctgttcattaccgggagaactgattgttaaaaagagcctggcaccgcctccacaccttgcttcctctctcgccatgtgatctccacacacgctggctccccttcactttccaccattagtagaagcagcctgaggccctcacctgatgcagatgccagtgccatgcttcttgtaaagccaaagacccataagccaaattggcctcttttctttagaaattacccagcctcaggtattcctttatagcaatgctaaatggactaagacaataattaacctgcctgagcttcagtttcttcatccataaaatgaggatggacacagaatctgtttcactaggattgccaagagaatttagtgaaataatacagaggacacagattatgtgttcttttctggcttaggaaggttaaattgctcaaagttacacatcaaatcatgggactcagactcataatctgacacataatcaatattcaataaatttcagctatcattattatgacatagttcaaatgggactcacacctcctctcagttaaagagaggagtacatgagccagacctggccaatgagattcagccctaggatttttgctagaatgatttgaaaggaaattctcttgtcctgttaggttatcaagttggtaaagcacaatcccagagctgctggtagctctctttaacaatgcttttagagggtctatctgaaagtaaagccaaaccaagagacggaaacagattactgatgatgaggctggatgcagccttacctgaaggcactgtggccctggactttccagtattatgaatcaatatcttccttttctttctcttaagccatttttagttgagttttcattacttgcaacagaaagaatcccttgtaatacaaaaaaatactgttttgaaactgtgtatttcactgaatgtaacattatcatatgttcatgttattaaaattattcttcaacattattttgtgtctggtattttattttatgaagtcagtattagtggacagatacattgttattaatgtttcaatattataaataacactgaaatgaatatcctcatagctaaatttttgtgaatatcatgattgcttcctgaaaataaattcctagaggtggaacttctggattaaaagttgcatggaatattaagagttttgttatatatagtaaaattgaccccttgaaaggtggtaccaatttggtttcacaccagaaacatataagaatgcctattttctccatccattgcctatagttggtagtatttctcttaaaatctctgccaagttagtaacctctgcacaaaaatggtacctcattttacttcatatttatgtattgagttatctaccatgcacatatttttcattaatttgtgctagattcagttggttactgttttatttaggaatcctgcatctatattctgaaattggttcttctggtactcttatgtgctcagggttttttctagttttatacaataaattttaaacacagaagtttgaagatggaaaacctgggttcgagtctgaattccacaatacgatgtggaagcttgggcaattcaatcttccttaccctgaagaagaataacgcaatggcaagtgagccactaaacccccgcagaacctggaaaggctcggccctgggaggttcaatgtggaaaggtgagccatagagcaacaatcaagggggtgcctaacagtgtgtcatagaggatcaaccaccaaatcccctcctaccccacacacacaggtgaaaaaactgttgtgtatactcaccgtggtcgtggttacatgaatctatacaggtgttaaaatgtgtagaactgtataccaaaaagctaattttactgtatgataattttaaaataaaaaaatttgaaggccaggtgcggtggctcacgcctgtaatcccagcactttgggaagccaaggcaggtggatcacgaggtcaggagatcgagaccatcctggccaacacggtgaaatcccatctgtactaaaaatacaaaaaattagctgggcgtggtggtgggcacctgtagtcccagctacctgggaggctgaggcaggagaatggcgtgaacccgggaggcggagcttgcagtgagctgagattgtgccactgcactccagcgtgagactccagctcaaaaaaaaaaaaaaaaaaaaatttaagagacataaaaggataccaaaggaaggctagggaactgttagattttaatagagacaagagaccaaatacagtatgtggccctggatttgaacctggattcaaggcacctaatttgattgactgattgattgattgattgatggattgatacagagtcgctctgtcgcccaggatggagtgcaaatggcgcactctctgctcactgcaacctccgcctcccgggttcaagcgattctcctgcctcagcctcacgagtagctgggactacaagtgcacgccaacacgaccggctaatttttgtatttttagtacagatggggtttcactatgttgaccaggctggatgcaaactcctggccctcaagtgatccacctgcctgggcctcccaaagggctgggatcacaggtgtgagccaccacacctggcccaaagtaactaattttaaaaagacatttttaaacataagtgaaaatataaatgcataataactattaaataatatcatggtattatatattatgatatgataaatgatatggtagttatgtatgaaggctatgtatttttaaagtccttatcagttagagacatatactaaaatattcaaaggtgaaatgacatgatgtctgggatttgcttttaaatactccagaatatatatatatatagtaaatatatggtgtgtaacagaataagagtgggatttttgtctctttgtttactgctgtgtcttcaatttctagaagtttgggagtttgtggtagatacttagcaaatattagttgaatgaattagttgaatgaactcctcttattgcctgtctcacaaactgtgacggtacatacctctacggatgtctctatctcttagctcaactatcactcctgacttctcccatgtacagtactgcaactgcgcattgatgaatccatgtctaaaatcctgctcagatagaaagaaaagtcttcgctggtaaagttcaataagcagagtcatcacgagttttccattttcttttatagttttcactgtacatatgagcccatggtaatctggcccctgactaactttccaattacatactcccactgtctccttccatgaaacctacatccaagtcccacaaaaaacttaactgtccatcacaagcaccttgatatattaaatttctctgcctttgtacctggagttccctctgtttaggatgcgattttctcttcatacatctagtagtgagttctgttcattcttcaaaattcagtccaggagtgaaatcagtaacatggcagaataggatgttccagctctcatccccccatagaaacaccagttaaggcaggcagtgacagatgagaatcattatgtgggaggcctggagtctggctgaggttccagcaccccactggagcaaatcaacccaagagtggaagcatcgaaaagggtaagaagtgcagttccactttacctgcatcagccctcccccaaggaggcacagcttgtgctgagagaagctcctttggctttcaatctctccacaggggaaggtaaaagcatagtcaacacctggcttccccagacttgaataacattgcccaggaggctcacttctgtctccctgcccagaatacagatgatcagcatgaagaacactgaatacagaatacagatgatgagcatgaagaacactgaatacagaatacagatgatcagcaagaagaacattgcccgggaggctcacttctgtctccctgcccagaatacagatgatcagcatgactgatcatctaggaacagggagaagggaatggactgcacagcaaccagcatgtggtttcaacaaccaaccacagattctgccacttagctcacagactccagcaggagacttgcccacaaatcccaccagatgactcacgtgaggaccctccacccaacgagtctatgcaacctgcatgccccaccccaccatgtatggggcccaacacaccactgtgcatggc

SEQ ID NO: 346 - DNA, 112133 bp, Homo sapiens
atagaaatccccgcagggaaaaatctgaaggtatctggtcttatggactgtataattaaactttcttatcattgtacctaaaccaaaatatgcttcctatacaaagaaggtttctttcaagagttaagactgcctcctgccatcctccttaacacacacacacacacatgcacacacacacacacacacacacacagagagagagagagagaattgagagcattagtccttttctcccttagactgattttttcttactgttattttcagccactttgttaacggtggggttaaagggcaggatagatgtaacacccatttcacatacatattgcaacatcagagatgctggttttcattaaaaacaccagatctaaattccttctaaaatatattttaaaaaatcagtacacttggcaccttggaaatgctgaaatgttatcatgaatgctcgttatttgttatgagtcaattgaatattatcttcaatataaactataatttactggtctgatagctcttcctatcttacctgtatatactcaaagggagcgatttctcatgtttagcaaattgttctttaggtaatttgttctttaggttttttgtacaaaagtacaaaatagttatcacagcaaactttccagtatttgttattttgaagctatatggtttttttttttttttttgccatgtcaggcttgagcaggatagcaaatatataaattgagctctctaattataatctcaatatatgaattcttgctaattaaaatactttgcaccagcaaaaacaattttcatgtatgtgtttaggaggtagttaagtaactctatataaaaataagtgcactttcccctcctttcttcagtgactagaaaacgtccatatttttaaaataatcaaataataattttagagagcaacagccctcaactctttgctggtgcttatcacactgcctttcttcactccattcttagctctgctagtttcttcttgtctgtaatgataataagggaatgtgggtgggtcagcacttctgtgtaggtcccctttccaaatttaccttccaaaaagccaaccaaataaacaaccaaaaaattgtgcaacaaaacacaaatagcgttccaatagcaagtgatgcattcacctgagattaagtggttttaggtggtcagtaacaaaatgctgctttgctgtcatagtagaaaggcaacaaattcttcaaagaaaccaagaaggttacaaccttgacaaagtctctcattaccttcctcctcttgtgtcttttttctccacattatctgttgcgtatctactatagaaggctgcaaaacatacagcagaaaggatggcttgaaggcaattgatgtttgtaaaaaaatccacaacaggatccaagctgaagaggtgaacacgtcagcctggtgggacaattctcagcatgtgcaaacataggtaaattctagcctatgttacattaaaaacaatgtcagtgcattttttcatgttaaagtttttttcaaagctaaagtgtgttccttgttgtgctgaccacaaacgagttttaagagttttgaaagtctggcaaaaatagaaaaaaaaaaaaagctgtagtgacattgaactgctcaatgtaagcattgggcatgcacaaattttcaaaacaaaggaaggaaatcatccctcttacaacatggttaggctgatctttaagaaataaaatgtaagaaattagaaaagcaaatgtttggcacctacatatccaatatctggcaccgtgcagagtagaagagtgaaagaaataacgaagaacaaagtggttactttgcttcaggagttcatgatctgtagttagaaaccaatataaacattgtgagtatatttcaaagaaagagaaaagcaggccgggcatggtggcttgcacctgtagtaataacgctttgggaggccaaggtgggaaaattgcttgagctcatgagtttgataccagcctgagaaatatagtaaaacctcatctctataaaaaaaattaattaaaaaaaaggcagagcaaaaacaaatatgaaagaaaacattagaaatcagagcttgggcaaagagttaaatgtgagcaaagcatctctgccttggggggcctctggagcatcccggcttcctgtagaggccccaccacatggccctttcccatcactgggaactgtcttctgtatcgtgccaggattttcccccaaacttctcaacctaatttattcagccaaaacatatatatttcttgaatccttgctaagagcaaggcactgttctacataatgaaaatatggcaatgatataaaacaaaaatatttaccctcaggcaaattacattccagtgagaaaagacagatcattaataaaataaatatgtaaaatatagaatatgccagaaggtaataagtggtacagagaaaaattaagcatggaagggagctcaggaatgctgggagtgggtagatgtgaaggtagttagaatgctcaaggagggagtaataggcagaagaatggcctttctacatgtccatatccctatatggcaaaaaggacttgtggatgtgatgaagttatggatcatgagatgaggagattattctggattacccaggttggctcaatgtcatcacaagagtacttaaaagcaaaagagggaggcaggagagtccgaggcaagaggcgtgacagctagggtcagaatgacgtggtggctgcctggaagggggccaggagccaagggatgcaggcatcctctcaaagctgcagaaggtaagaaagtggtctctctcccctagagagagtgtgtgttctcttagcctactagaggtgtgttaatttattcctgcagtcatagaaaacatatagaaggtctcactgagaagacaacatttgaacaaagattccaaggaggcgagggcaccagctatgcagatatctggggaagagcactcgaggaagaaaaggcaggcaaacagcagggtgcacacctagcccaggtgcatgaagtagagaacactgggagtcagaaggctaacaggagacaagtcagagagagggactggggtgggtcaactcacactcagcctcactggctactgtaagaacttcaagttattctgagacactcagtataggagagtctatgaatatttatagaaattctgaatgtttacaagacgaataaaagtggtatgctagtaaacttattggttgggtggggagaagcccagatttgtagcatttgctgatttccattgtgtaaatatttctactgatggtttgacaaacacttcataaaattcctgggtacttaattatcagctccagtagagcactgcatgtatgacatcccatttgccaattccacactagattctgttggggacaagctgtatgagagtcaactagcaacagaaataaggaagtcctcaataaaaatcagcatttacttttgacagatgtgagattctggaatgtatttctctttacttgctctgcctggtgattaaattatgattttaaaagaaatagttttaattccttatcagaatgctgccaccaaataaataaaatacgtactttaactatatgcaatcttgtctatattatactgttgtcaacggaaacattatcaggggccagcttcatgaaaggagatatgtgatagaagctggagttgttggagtgaaaaaaaaagtcaaattttactttggattaatcagagggaagaaagcagacagataggaaaggaaaggcaggcttagccaagttgaagaaagaggctgaactcaggaggcagtgggagaataggatcatagtttgaagagagctgcaaggctgtttagtccaggtgaggatcataatcccagaagacccagtcacaaacaccataaccctgaatgttgaaatcctgaaagatcaaaattcctaaggtctaaattcatttctttttagtagagatggagtgaattagttcattcttgtgctcccaataaagacatacatgagcctgggtaatttataaaagaaagaggtttaattgactcacagtttggcatggctgggaaggcttcagaaaacttacaatcatggtgaatgcaaacaagaagcaaggcactttttcacaaggcagcaggaggtgctgagcaaaaggggaaaagccccttgtaaaaccttcaggtattgctcactgtcatgagaacagcatgggggtaaccacccccctgattcaattacctccgactgggttcctcccacaacatgtagggattatggaaactaaaattcaaggtgagatttggttggcaacacagccaaaccatatcattctgcccccagccccttccaaatctcatgtccttacattttaaaacatgatcatgcctttctaacagtcccccaaagtcttagctcattccagcattaacccaaatgtccaagtccaaattcttatcttagacaaggcaaggcccttctgcctatgagcctgtaaaatcaaaatcaagttagttacttcatagatacaatgagggtataggcattgggtaaatacacctgttccagatgggagaaattggcccaaaatgaagggactgcaggccccatgcaagtccaaaattcaatgggtcagtcaaatcttgaagctctgaaatgatttcctttgacttcatgtctcacatccaggtcacgccgaagcaagagttgggctctcatggccttgggcaacaggggtgcctgttgatttgcagggtacagcccttctcctggctgctttcacaggctggtgctgagtgtctgtggcttttccaggcatacggtgcaagctgtcagtggatcaaccattctggagtctggaggatggtggccgtcttctctcagctccactaggcagtgccccagtggggatggtgtgggggcccacatttcccttctgcacacattgccctagcagaggttccccatgagggctctgtccccgtcacaaatttgtgcctgaacacccaggcatttccatgcatcctctgaaatttaggcgtagattctcaaacctcaattcttgacttctgtgcacccacaggcccaacacctcgtgtaagctgccaaggcttggggcttgtaccctctgaagccatggcctgagttgtacattggccctttagccatgattgggacacacggcaccaagtcctgagactgcacagagcagcaaggccctgcaccgggcccatgaaaccattttttcctcctaggcctcctgtcctgtgatgccttgagctactgtgaaggtctctgacataccctgaagacattttcccattgtcttggtgattaacattcagctcctcgttacttatgcaaatttctacagctggcttgaatttctctccagaaaatgggttttccttttctgtctcatcatcaagctgcaaaattttttaaacctttatgctctgcttcctcttgaacactttgctacttaggaatttcttctgccagataccctaaatcatctatctcaagttcatagttccacagacttctagggcaggggcaaaatgccgtcagtctctttgcatagtaagagtcacctttactacagttcccaaaaagttcttcatctccatatgagaccacctcagcctggacttcattgtccatgtcactatcagcattttcctcaaaaccaatctgcaaggctctaggaagttccaaacttcctcacatttttctgtcttctttcaaaccctccaaactgttcaaactctgcctgttacccagttccaaattcacttccacatttttaggtatccttatagcaacaccccactacctcagtgccaatttactgtatcagtccattctcatgctgctaataaagacatacccaagctgggtaatttataaaggaaagaggtttaactgactcacagttcatcatggctggggaggcctcaggaaacttacaagcatggcagaatgcaaaggagaagcaagtcaccttcttcacaaggcggcaggaaggagaagtgcaagcaaagggggaaaagctcctcataaaaccatcagatcttgtgagaactcactcactatcatgagaacagcatgggggtaactgcctccatgattcaattacctcccactgggtccccatcatgatatgtgaggattatgggaactacaattcaagatgagatttggttggggacacagccaaaccatatcatggggtctcactttattgccctggctgatttcaaactcctgggctcaagtgaccctcctgacttggcctgccaaagtgttgggaatacagacatgagctaccatgcccagtcctaaagtctaaattcttaacatctaaaatccagaaaatcacaatcacaggagagttgtaccacgttagttgcatcatgttaggtacaactcttgctttgttttcttcttatttggaaattatgtatggtttaagggggtccatatgggtgccaaatctacaaggggtggacttgcagacttaatttcaggtgtcaacttgactggattaaggaatccctggaaagctgggaaagtattattttgggtatgtctgtgatggttttctcagaagagatcagtgtgtgggtctgagcggactaggtggggaagatctgctgtcaatgttttgaatgtcttgaatatcacagaagtgaaaatgaaagtaaaaaatgcacaaaatcttgtctgccaaattatgtaatcatgtaccaagcacctctacacgtagcaccatgcttgtcttcacaaaatgccttttgtcagataataaaaagagttcaacaaattcagtggccttctgaaccagacacctgctggcacagagcttcctccagtgctacaagacatattaaatcatgaactattcttgattagggatttgactgtcaaaaaagataaacatatttatttaccactaagtctaacataacaaaactggtgcatttttcactttggctgatgaatggcactttcaaaactgtccccagtgggtttttataatcaactttatacagtttatgcccccaatgaattacaaaattctataatttaatcttcatgtttatggtttaataactggaaaaagtgaagtactttataaaagcttatttgaagatttggagggctttgcagaagaaaatagatttcaatcagatccccaaattataatgacaagtttttaattaggtgtgatcaaggcttctaaaagtgaattgcaagttgttaccagtaaagtttgtatcttccattcagcccagttcatttgccagaaaattcaggtgagtggattggccaggccatatggcaatgatgaaaattttagttttaaaatgtgccatttgtctgtattggcattccttccacctgataaaactccaggagcttttgataaattaaaaccacaattgcctgaagaagccagaaaaattacatactagtttgaaaataatgatgtgcaaggtgggataagaagtcattcaggcaacggtgttgctgttcaatcaagagtattgtttctgccaaatgagtggcctgtatatgagggcctgcaaaatggatttccacatactcaaaacaatagacaagaatggcatagaagattggaaaatataataggaaatgctcatgtcagtgtgtatcaaattatagaatttcaaaaagagcagtgccacatagaaaatgaatgtgaacatattttatgaggagagtcaaatcctaaaaacaaaaaaggcatcatgatgaaagacttcaaaatacagttaatgataatgagagtcagccagctattatgaactctgcaattgcccataatctatccatgtaatatactttttatatgtcaattttcgttttagttgtttctttttccattttttccactattttaaattgtcagcattttttacaacttggtatgctatgtatttcatcttagtatcatttccaatactggaggtataaattttgcaaagacttttagagagttctaatttgttttatgcttttatttttgcaaatttgactccacaagagtgcattatcacaacactgactttgtgtgtaagcattgtacctgtacataaaaacattaaagcttcctcaataaatgagaagatatcctttttgcacatttgtatttgggaaagagaaaatttctcaagatctcagctctttgactgcatattagatggtgacccatcccagcttttgatgaatctggtcaaaagacttaggttgtctgtcacagtattccagatgacctaagttataaagctgagtgcacccagttaccaaccatgcttttatacattttgctttttgacccatttctttacgagtacaactcatctgctcattactgttatacccataagacgctctttagcatacctgagttttatgcttgcaaatatatgtatgttattattgcctattgattgtgtaaagtagcctaggaagtgttctgttgtgtttttatacgtttatcaaataaattccatcttaaaaatataaataaatgcttttttgttgtttttagacagagtctcactgtgtcacccaggctggagtgcagtggtgcgatctcagctcactgtaacctccacctcctgggttcaagtgaatctcctgcctcagcctcccaagtagctgggactacaggcacccatcacgatgcctggctaattttttgtatttttagtaaagatggggtttcaccgtgttggccaggatggtctcgatctcctgactttttgatccacccgctttggcctccaaaagtgctgggattaaaggtgtgagccaccacgtcctgcccaataaatgctttttaaagaatgtgttaataatttttttccagaattgtattttcagaattttgttttttgaggattgtaattttcaggattttagactgtacagatttagatcttttgggacttcaacatttgggattatgacgttcaggattgtgtcttcctgggctgtgacccaaacccatgtggtccaacgctatttcacatgagaggaaagcaaaccacgtgcacagatgcaatgaaggcttaaataggcgtcatgtattgattatatccctggaaaacatgattaagatgatacgtagcgactttttttttccccagtgaaaaagatccacattctttttcttgtgtggaactaaacacaatttctgaatcaatgtaagtgaatgtgaatcaccatgttcacttagctgatgctcctttattaacggggatagaagggacgtgattcaaagagatggcggcacaggacccatgacctaaggaagctgcagtgggtgaaggggagaaacagaggagcaggggctggagaaagagtggggagtcatcaactaccctccttgctcccggcatctggtgtttggagcccagaggtcttctctaaggcctcggagaagcttccaagtctgttcatttctctttccccacccctgcttgtatcacaaataaagaaattattgacaactgagttcctgactaggtggcaggattttagggatccttcacctcgtccaaacctcatgaaggtagtgggagtcccatgggttagttagcaatagtccttgagattatttgttcatataaataatcacaatactcatagtcatcttgcttttctcataatgcccagctgggggacggtgggggcagagaggactggagtgagaagagatagaacaagagctggctttcatgtatggggctctccagagcaatcaggcctaaggacaatcaagagggatcttgaagcagctctggcaagggcagcctggactcaggccccagcttgcaccaagcacgtcacctgtccaactgggaagcctaagcaatgtgtttctgtttttgttttgttttctggtaaagaattcaatgtcgttagctacattcacaatgctgtgcaatcatcaccactatccatttccagaacattctatcatcccagacaggaactctgtgcccattagacactaacctcctgccagccctgaaaacctctattctactttctgtctctgttaatttgcctgttccaggttcttcatatagatggaatcacgtagtctgtgtctgatgtctcacttagcataatgtttttaagttttatctatgtggtagcaagtatcagaatttcctcccttttcaaagatcactaatattccattttatgtctataccacattttgtttatccatctatccctcaatagactttttaggttgtttccaccttgtggttgctgtaaataaggctgctgtgatgctgcaatgaacacaggtgtagcagccaggtgtggtggcatgcgcctgtagttcctgctactcaggcttctgaggcaggaagatcccttgagcccaggagttctgggctgcagtgtgctgtgttgatcagatgtctgcatgaaattagacattagtacagtgacctcccgggataggggactaccaggttgcctaaggagtggcgaaccggccaacaggggggtcgcgcccgtggacagccctgcagagggggtgggggggaggcggggttgtcgcacccgtggacagccccgcagcagggggctcgtgcccgtggacaggcctgcagcgcggggcgggggggcggggctcgcgcccgtggacagccccgcagcaggggatcatgcctataaacagcccctgcactccggcctaggaaacatagtgagaccccatctattaaaaaaaaaaagggtacggagagaacacaggtgtacaagtatctatttgagtaactgctttccattcttttgaagataggtataggtagatatagatacagatatagagatttacagatatgagtgggattactgaatcatatggtaattctatgtctaaatttttgaggaaccatatgttttccacagctgatgtactatttttcatacccaccctcaatgcacaagagttacaatttttccacatccttgtcagcacttgttattttctgggtgtttttgctttgttttgaggccaaatctccttctgtctgcaggctggagtgcagtggcgtgatctcggctcactgcaacctgtgcctcccaggttcaagcgattctcgtgcctcagcctctcaattagctgggattacacatgtgtgccaccatgcccgactaattgtgtgtgtgtgtgttttgttttgttttgttttttggtacagatgaggtttcaccatgttggccaggttgctgtcaaactcccgacctcaggtgatccacctgcctaggcctcccaaagggctgggattacaggtgtgaaccagcatgcccagcccctgatttttttgttttttcttttttgatagcagccatcttaatgggtgtgcaggtgtgtgtgtgtgtgtgtgtgtgtgtgtgtgtgtgtgttttaatgtcacattggtgattctaatgtgtaaccagcaaagaaaagcatggattctgggtctcaatttttcatctaggtaaaccagagcaaataaaacctatcgaagagtcctcctgatgattgaatgagttcccccatagaaggcaaaatttacaaatgttggttcctctcttattcccttggaattctactaaacttcctgcctcaacatacagagaaactccctgaagcctaaaactatgcagatttgacatagggctgattttaacttctgttttgcttttaccatatagctagctgcagaggtcacatgtgtcctccatgacatctaaatagcactacacctgcaccagctttcctctcaaattaactactcatcagttctattattaaataaacagggagcagctgtaatactcaaggagtgtgtgggattgtgctttaaaattacatctctgccaacactttgtttgcttgttgaataactacaagttttccagttaaattaatagaatacattatacccataaaatcctgacatatttggcaatacacacaacaaaatatttacaagtagagaatataataaatgtatgacactttagaaatgcattgagataagtttaaacagtgtttacttttaattggtgtgctttctttcatctcacagtaataagctatggtttagtttatcggctgaatactcactatgcagtcctttgtaaaattttggaggtccgcagtaatgtgattattgagcttcaacagaatacacagaagatcccaggaaccacagactaatccatccactatgcagtatctaaagtatttgcaaaaataaaaacaaacaacaacaaaaaaacacctgaacaattgactcgtagcaaaactatcaggttagtgcaaaagtaattgtggttttgccattgaaagtaatgaaagtaattgaaagaataggtgttctagctggacattctacaatgcatgccacaaccatggatcaattgtgtattgaaaacccaaaccaactgaggatcactgctgtgcattattcccatcgtgtcataatgtggcaaactaaaactaaggacccataacaagggattttcagagggaaagcaaacatattggttaaagcaaacaaaactggcaattttcaatttgctcaaactattcacatagtttgtatgcttctctacaaaatacagaattttgatataattacccttaggtaaaactctaaagtgagcagcttctgatcaataggcctcaactccttttcccttctgtatcacagactgtgtgggtgaatccaacacatgacctaatacgatttggccagttgggaaaggtctctttaaagaactaaccctcaggctgggatctagagcaaagcaccgtaaacttgaatgtgcataggaaccacctggggaccttgtcaacatgcagattctgattcattggatctagggtggtgcctgagctctagcaagctcccagggatgcctatgtgactgccttggacatcagttacagtagcaagaatataagcagataccagccaacaaagcaggagtgaacgcatcacggcccaggcagccctggaccaggccagctcagggatctgagaaaagagtaactggactgaggtctatgagtgctgccatgagaggtgaggctgagaaggtggacaagatctaggtcaatgtgttaagttcctactaaatgcaaggctaggctctgcataaacagaaacaaataaggcaaacctactccttgcatctttagagcttgtggtctagcagaattacttcatgggtagaaaatcattaaagatttttaaatgaaggagagacatgatctaattgaaatttttgatgaacctctctgggtgtgccatagagaaggtattggagaggcaaaaagttggaaagaggagtatatgtttgcagaccaggtgaaacatgcggatgacagaagtggataattttagcacatattttgaaggtgaaataacaggacttggttgcaagttgtgatggtaggggggtggcaggaagaagaaagcatcaaggatgatgatgctttctggaagaagcaaatgggtaaatggagataatttttacgaagaatggtaaggctgaagaagaaataaactaacaaaagggaaatgattgaggaagtggcatagatttgggggcagaactcaagagttttgaattctgattttaggaatgcctatgaaaatcccagtggagatttcaagatggcaggtgcacataatgttttggagcttgggaggagagctctgtaggagccatatgcatataaacagtatctaaagccataggaattaataaaaccttgtctagagtctgtgtaggcacgggcgtccaatcttttggcttccctgggctgcactggaagaagaattgtcttgggccacacataaaatatactaacattaacaatagctgatgagctaaaaaaaaaaacataaaaaaatctataatgcttgacgaatgtttacaaatttgtgttgggctgcattcaaagctgtcctgggccacacgtggcccacaggccacaggttggacaagcttagtatggaataagaacagaagaggacccaggatttaggaacttcaacatttaaagtttgggcaaagaggcaggagctgataagaaaatagttcaagctagaggaagagatcaggggtctactctactgaatgtttctgagacgccattggacttatatattacataatatgtacaatatatgttacttgggtgatggataccctaatagctttgaactgaccactatgcacggaacaaaactgcacctgtatcccgtaaattttatataaacaaaagtaaataaatagaaggcaggaagggagaaggagaaggaaggaaggaaggatggaaggaaggaaagaaggaaggaagaaaggaaggaaggaaagaaagaaggaagggagagcgaggaaaggaaaggaaagggaagggaaggaaagaaggaagggagagtgaggaaagggaaggaaagaaggaagggagagcgaggaaaggaaaggaaagaaaggaaaggaaaggaaaataaatgaaagggagggaaggaaggaaggaagaaaggaaggaaggaagggggaagagagagaaagaaagagagagaaagaaagaaagaaagagaaaggaaagaaggaaggaaggaaagaaagagaaagaaagaaaagaaagaaaggaaagaaagaaagaaaagaaaagaaagaaagaaagaaagaaagaaagagaaagaaaaagaaagaaagaaagaaagaaagagaaagaaagggagaaagaggaatagtgttcatgatgtttatgaatcaccaattctgggggcactgaattgtgtcccccaagattcctatgttgaagagctgatccccactgcctcagaggggactgatttagagaaggccttcaaagaggtaagtgaggtcaaatgaagccgtatgggtggaccctaaaccaatatggcaggtgtccatctaaaaagagattgagacacaggcaacacagcctgaggacacagcaggaagggagccgtctgcaaggcagcagttctcagaagaaggcaaacctgctgacattccatcctggatttccagtcttcagagctgtgagaagataaaccactcaatctgtggcagcttgtgatggaagcccctagcactcttatatggtgaccttagcacaagcagtttaacaggcttggtgaaagtgaaagccaaactgacctgaataaagagtgaaaggaaaaggagcaaaaggagacagtaagtgtggaaaatccttgaggaaaatttgccaagaaaggaggagatggcttgatagctagaaagacatagagagtcaaaggtaaggtttctccaagatagaagatttttttaaatgaaaaatttatatttaaatgctgacagaaggcatcaaggaggagagagattgaagatgcagttgacaaatggaaaagcaatgaacagaatccctgaaaagtcaggaaaagaagggagattattagagggatgtccttttacagtaagaagaatacttcctccaccgccccaggatttaaaaagcttataaatgacaggtaacattctacctaattatagagctttacacttttcaataaattttgttgtacatgatacagtcactctgtgaattcagtgagacagacagttatccacattttacataaaaagaaagaaaaggcagaaaagaagtgatttgcttgaagtgacacagaaacggctggtagaaccatgcactgtgtagatggcagggctcctgacttctcatttcacaccacaaatgtagacagaattagatataatgacagttattatatttttaaacctttcaaataagaatatccttagattttcattcattaacaaagcacgtgattagcatctgaaaatgttttattatacgatcactagacaccaaaagaggtttccattttcctgtgtatttgaaagagttcaacagccctaagtcacacagttggaggaaactcaaacaagagaaggttcgtttgaagtgatgaaattagcatgatgaagtttacaatacaaagatttttgtttcaagactctgaggtttggtagggaggaaggggaaaggcagatgacaccaaataggactggttggagaggggatgagaagcatcaattagaaagctcttcaaattcaaatggactgttcaaaccatcctaggactagactccaattgggaaagactctgaagaaaatgatctcctactcccacgagatggctaacgtgatttaggtaaaaagcttttagttttatggctggggaggtagcaataaagaaaatgaacttcctgccagtgattctttgtcaagccctgccaatttctgtgtctggggaagctataaagaatgtccagcctcatgtcaaaagaattgccacagatctccagcctgcctgcattcaagcatcgaaacatccctaagcctgttcccaggccagcctggaattgagaatccaggagagtcttttctgttctgctgctgcagctacactatctgcttgttagcataaccagggccaccagcaatagatgctagagaaatacacagagaaaaaatcaacagctgatgaaaagcagaatcttttctttttggcagcaataccaatagcatgaagcacatcccttttggagctttccaaaccacttcaaaagcgagttttctggtgtggatcaagaaagctaggcaaattgcccctgagggcatagccactggccaagatattgatgagtgtaggcagctcaggacccatcctcggccccggtgctgtctttctcagagctctgtttaattccatcaggcatgggcagcgtttggagaaagctgtgttcatttttgtgatcttcagccagcacggaggtggccagttccctagcctcccagcaccgtcctcctcctgccctgccccttcatggcctgcctgggctcactggacccacacttgcctttcacccctgtcaaagcctcacagtcctgtgtgtctgtttccctttgaactacacaaactaactaatttggtgaacccattaagtgaacttctttatactcatggtctagagtgcattgaacgctaaagggtttgctagagattgtcaaaatcaattctgtcttcttccaactggaccaaggcttctttgagttaacaaaactgagaaatctgagttgatttttcgtagtacctctttctattcttttggggtttttttgtttgttttttacttatcatggagattttccttaatttaacccaaaagatatacccatatgacatttgaactaatatgaaagaggtagtaggacaaagaatttgaagacagcctttcagagccccacaaagtacttgaagtttatcaataaacccctcccagtgtttcccaccatgttccacattccatctccatttttagccatgcagcttcaagtggcatctcctcctgtgaaacctacagtttggagataaattattgatgactaatgacttagaagaaccaaagaaaggatcctctagtggagacacagcatagaaatggtggtccagggtgagacagaactgcttccaatcccagtgccacctgtgtggttccagctgtgtgctgctcttcctctaatcttgtttactcgtctccaatacgggactaataacatatacatcagactattgtgagggttgaatgtaacaatattccaaattgttgcatgtgtccagtacttaacacagtgccaagaacaaagcatgtatcagtaagtatgaatggccttcccagcgcacacctccaaacagtggattctggccgatgacaggcaatggttccccgcggtcctacaggccacggtttaacttaccactagccaatcagtaagtttgcctcagaccacatcacgattcttttgcaagcctggagcttggtgaaaaacaagggggaaaataatccatgtccctaaggcagatgctgaaagatttacctcataacataattctctcaccagacttgtttcctgaatgtccatttaaattttaattctgcaaataaaataaaattggtaataatgaaagtgattaagatggtatttgtccagggaaccaatctccccacaagatacctaagaaagagatatatgtacagaaaatgaagcacagtaaaataccacttcattactatctggagattttccccaaacacagagaaagctctacagagctgagcttaaggcagaagaactctgttatttacttggtctaatgccaaaacaggccagagacccctctcacttacttctctttaatcccaaacccatgtctcaatttggtctaagaaagagccgaacacccaggaggcaccagggtagagaaaagcagccagccagagagtgacctccatgccaggggagtgtgtctgagctttgttttatttttcttatttgtctgtagttgtgtgattggtagaagagagtagatatgaagtctactgacacaggattggtcttcaggcatgtcttaccaagcataggggttccacaaataagagagcaatgatcagactttcttctaaaaggagcagccacaagctaccttaactctccaacttgcccataaatcttcacctacagttaggaagatttcaccattagctgtggcccataaaagatccttaagcttgaccaaccacagaggtccatctccttgaggaggaagtgaaaggggtatggacagaagctgtgagctttctgtcctccacaggcccccagctgtgtcttctacttcttgtacaagatagtctccaaatgatgttttctggcagacaatgccacagaactgatccttatctcactatggaaatgaaagatttcaaagaatttgttgcctgaaatatggtgccctaatcacatattaataaagctgctatccaggaagaaggcagatttcaaaagaaaggctgttagccttctcagggacctaaaaagtacatattgtagaacaatggtaaatagatcttggaatcaggtagactttaattcaagccccagctatgccagttattaacttatgtgacattgggaaaggctctcaaatttagttttgcaaaatcagaataatataggtagccaacaaatagggtttaatggaggtaataatgaaggtgattaagatgataaaattaaataatgaatataaagtgcttagcatgtaataaattttattgtatgatttcaaagcacatgctttacctacagtgctataaagctgcttgcaatagtcaaagctaatagaagctctagtcagagctaatagaagccttgtgtatataattatttaagaattctgtaaatatacataatagggtaggaatgagaaaatctttagaggaaatattcaaatatgcttggtttctagcaaatccagatagaccgttttggcaacaaccaagtcataattttaagtcttgttataggagctagaattttattcaaggggcaactgatttgattagataagatgctgtggactgcatgtttgcatcaacaaatgcacatgttgaaactctaacaatagaatggcattagaaggaggacctttgggaagtaatttggttttgatgaggatggagttcccacgatggggttagcatcctaataagaagagaaggagactagagccctcttctctcagccatgtgaagatacaacaagaacacctgcaaaccagtaagaaggccttcaccagacactggctctgctggcccagattttaatctttgatttctcagaactgtgagaaacaagtatgtgctgtttaagccactcagtctacagttgtttgtaacagcagcctgagcagacaaagacatagggttccttttattttcagaattcggtttagctgtaatcacctaccatcctgaaatgctgtttcctccttctgcccttgaaatataagctctgggactacagcttcatggacaaattctgaagaatttgtctctgctcctgtgggatgctaacctaatcaatcaaggaatgtttgctcaatggaatgaaacatcttaatgcagcttgccagccaatatctgcagagcacacctcatgggttctggctggcttggatttctgagactacttcatcctacccatcagactgtggactcagattcagccagaaggcctgattctagcgtcagttttgcctttgggatataaatgcatgccctacttcactgaacatgaaaccctgaatatttggccattactctggcaattgccctccctccctgtgccaattgccagtcaacccaactcccaggcagccttggcagttatgtctgctcggcctgctgtagcagccaatgacttagtaaaagtcagaacatagatctgctagctcccagtccaggatttccccttaactcatccatgtatatattaaacaactaggcttgcttttaaattctttttcatttagcctcttcttagaactgatcattttgagaatcctgacctgccaatattccataatctttctaaaagtgacacagcaaatacgacgcatgcacagtgctaactgcagctgatttcatttttccatcatctataaagcacataaggtaatttctaaaccagcagtaaaatctatttataaagaatgctgatttgttttctgcactttccaacacagagcttcaatttatttccttaccataaaaaaaccattactttttaaaacaatcatagttagtatattttataaatgttttaatttttgtaaagtccaacttgcaaattggagtgtaaatagctttcttaaaatggaaggaaccgtgttagacccagtatgctgactgatttcactgtgcttcaaagcagacgatttcacagtcattcggtaatgagtttttataaagcaattgatatcactaaaaatataattataataaataaaattataggaaaaaggaaatcttcattcagacaatgccaaattttttaactcattgctaaaagattatgtttgtacatgaaaaattttacacattctttctatgagataaacctgataacaccttgaaaacttaatagttatggaaaaggaactactgtgatattttttagagaatgtcgtgttcttgatgttcttgagtgagctgtctcatgttattagaagggaaacagcaccaccttgtggggaaacaacaccaccttgtggacaaacaaagaaagtgaatgaaattttagggccgggtgcttaatcccagcacttttgggagacctgggaggagggtaacttgagcccaagagttcaagaccagcctgggcaacacaatgacacacccatctttaccaaaaatttgaaaaattcgctgggcttggtggctcacacctcaggtcccagctacttggaaggctgaggtgggaggatcgcttaagccctggaggtcaaggctgcagtgagtgtgatcataccactgcattccagcctgggtgacacggcaagaccctagctcaaaaaaattatgtttatgtagcacttcctacaaggaatatagtatcttgtttgtatttaaatgacatcgggaccagcatggtggcttacagctgtaatctcagctcttcagaaggcagaaggcaggaggatcacttgaggccaggagttggaagaccagcctgggcagcataatgaaataataataatagtaataaaaagctaggcgtgctggcacacacctgcagacctagctactgtggaggctgagtggcaggatcgctttgagaccaggagtttgattgtactgcgtattgtgagctacgatcgagccactccagtccagacaacacggcaagacccagtctctaagcaaaataaagggacatcagagcattgcttacagagatttataaatgatcccaaaatgtcttcagggagataaattatctaaatatagctatatggactcttcctaaattccaaatttgggtggaaaaataaatgagatagaagacttcttgaaatgtatcaagactcagaaagacaaaacaaaaactttcattaggcagctaaagaggaaatcccagcgacaagaagccaaaggaaagggaaaagaaatgacaacaatgaccatactttctacacatccaacctcttctctaccaccactcagcaagacctcccacagccaatcactgccttctcttgtggacttaccctctactctgtgaacacatgagccagagaaccctgagaagtccctgggtcccttccaggggctctgcaaggtcaaaactcttttcataaaaatacacaggttttgttgaccttttccaatttcattctctcacaagtataattggagtttcccagaggctacctgacgtgggatgtcacaagaaattaaatgtagaagcagaaaggagaacgaagttttcttctattaaaccagacattaaagacatacttaaaaatataaaacaatgtcaatgttctcaccaactttactgtttaaaaatgataactttaaataaaaatgtgatttatgtaaacatataagtatatttttttaatttctcagctttaatgtttaatatgataaatatagatagatataatccaagtaaataaaagctctttggggtcctcaataacttttaaatgtaaagtggtcctgaaaccaaaaatttgaggacagatgctctaaagctcatactctctgatgtagcttccacccaggtcatttcttaaatacttgatcaatcatttcccatgtccctcaccctatccttgttgcaaaattccattttcctactctagccctccctgtcatgagaaagttcccaggttgtagacattatttactaaatatttcttaacagctttatgatgataacatgacatataaaaattgtgtaaatttaaggtaacttaatgttttgatattttatactttttgaaatgatcaccacaatcaagcaaattagcatatttattatctctacatatttaccattgtgtgtgttgacagtaattaatttatgatctagtcctttagcagaacacaagaatatgacacagtgttgttccatgttgtacattatatctccagaaattattataacttgaactttgtacaatttaaccaacatcaccccgtttcccctccctgagcccctggcaaccactgtcctattctctgtttttatgaatttgactgttgtagattcctcatgtaagtgagatcatgaagtatttttctctgtgtcttgcatttttgcttggtgcaatatcttccagctccatccatgttttcacaaatagaaggatttccttcttttttaaggtcggataatatttcattttatatatacatgccacattttctttacccattcatctgttcctctgccaaaggacatttaggttattttcatattttggtcattgtgtgtcatgctgcaatgaacaggggatgacagacacctctctaagactcttatgtcaatttcattggacatatatccagaagtgaaattattggattgtggcagttcttttttttatttttgaaatggggtctcactctgtcatccagggtaaagtccagtggcaagatcatagctcactgcagccttgaactcctgggctcaagggatcctcctacctcagcctcccaagtagctgggactacaggtgtacaacaccatgtctggctaattttaaattttttcagagatggggtcttgctatgttacccaggctggtctggagctcctggactcctgccttagcttccccaaatcctggggttacaggtgtgagccaccacaccaggccagtgctagtttcaattttctttggaggaacctcaatactgttttctgtgttttactaatttgcattcccatcaatagtgtataagggtttccttttctccacattctcaccaacacttatctttggcctttttgataatagccattttgacaggtgtgacctgatatctcattgtggttttgatttgcatttctctgaagtttagagatgttgagcacattttcatatacctgttagccatttgaattccttcttttgagatatatttatttagattctttgccttaaaataaaattaggttatttgtaattttggaattgatgtgtatgtgtccttattttttgaactccttataagagatatggtttacaaactttttccccatttcataggttgccttatcatttcattagttgttttctttgctgtgcagaagctttttagtttgatgtaattcatttacctattttgcctttgttgcctgtgcttttggcatcatatctaaacaaattattgccaagaccaatgtcaagaatgttttctcctgtcttcttctaggagttttatggtttcaggtattgcatttaaatgtttaatccattttgagttaatttttatgtatgatgtgagctagggatccgatttcattgttttgcatgtggacatccagctttcctaacaccatttgttcaagagcatatcctccccctattgtgtctccttgtcaccctccagggtgatcaattgctgcaaatgtgtgggttatacctaggttctctattttgttccactggtttatgtgtctgtttttatgccagtaccacagtgttttcctttctacagctttgtaatttaatttgaagtcaggaagtgtgatacctgtagctttgttcttgctcaaaattgctttggctactcagggttttttgtgattctatatgaattttaggattattttttctatttctgcgagagacaccattgggattttgatatggattacattaaatgtgtagattgctttgagtaatatggacactttaataatacagtactcactctttcaatccatgggttgtctttcaatttacttcaaatttccatcatcaatcttttgtaatttgtagtgtttaagtctttcacttctttggttagttaattccaaagtagtttatttgatattgttttttaaatttccctttcagacaattcattgttagtgtttagaaatagcaatgatttttgtatgtctattgtatatcctacaactttaataaatttattatatagtcagtccttcatattcatgggttctgcaaccatgaactcaaccaaccatgaaccaaacttgtacatattttccatctgtggtggtttgaatccacagatgtggacccatggatacacagggccaactgtacatgattttacatgagggagttgatcatcacagattttgttatctgagggggtcctgaaacaaatccctggcagatatgaaagactgactgtattatttctaaccaattatttctaaccattttctgtggagtctttagagttttcaatgtataataatcatgtcttctgttaacagagataactacatctttcctttcaattttgatgccttttatttctcttgcctgatttctctggctaggacttccagtactatgttgaataggagtggtgagagtaggcatccttgtcttgttccagatattaaagaaaaagctttcatttttccccattgattattatattagatacaggtttttcatatacagcctttatagtgttgaggtaagtttcttctatacctattttgttgagagttttatcatgaaagtatgttgaattttgtcaaatgtgttttctgcatctattggaatgttatttttgtctttcattctgttaatgtggtatatcacattattaatttttacacattgaaccatccttgcatcccatagataaattccaattagtagtttattgagaatttttgcatctatattcattaaggatactggtctgtaattattttttcttgtgttgttttcatctagcttttaagtcatggtaacattggcctcatgaaatgagtttgggagtattctctcttctattttttctaaagagcttaagaagttttggtgttagttcttctttgactgtttggtagaagttgcccatgaaagcatctgcacctgggcttttctttgttgggaaattttttattactgattgaatctctttgcttgcttttggtctgttctatttcttttttgttccaacttggtagattgcatctttctaagaatttatccatttcttctaggttatccaatttattggcatataattgcttaattgtcctttataatcatttgtattcctgtacatttgttataatgtctccattttcatttctgattatatttacttgagtctctctttttttcttaatgtagctaggggtttgttatttttgtttttatttccaaaaatacaactctagctttgttgatttttatattgttttttattttaaagttattttatttatattctaatctttattatttacttcattatgctaactttgggcttagttagttcttctttttctaactgtttatttgtaaagttaggttgttcaattgagatctttcttattttttaatgtaggtgtttatcactataacatttccctcttagcacttcttttgctgcatcctgtaagttttgttgagttgtatgttcatttttgtttgtctcaagatacttttaaaattcccttttgatttctccttttacccaatggttgttcaagagtgtgttgtttagtttctgcatttttgtaaatgtttctgttttctttgttattgatttctaattttattccattgtggtctgagaagatacttggcattatatcaaacttcttaaatttgtaggatgccttgtgacctaagatttgatctatctcagagaatgttctgtgtgcacttgagaagaatgtatattctgatgctgttggatggaaagttctgtatatgtcagtgtttaatgtaccatgttgttcaagtcagctgtttcctcttttttttcttttttttcctgcctagatgttctatccattattgcatttggggtactgaagttagctactattcttttattgttactgatttctccccttagctttgttgatattaactttatatatttaggtgttctaatgttgggtggatacataatcttcctgttgaagcgaacttttatcattacataatgaccttcttagtctctagtgacagtttttgatttcaagtctattttttctgatctaagtatagatacccttgctcctttttggttaccatttgtgtagagtgtctgttcccatcccttcactttgagcctctatgtatctttatatctaaagtgactcccttataaatatgtactgatgagtatcttttatgcattgtgccactctatgtcttttaattagatagtttaatcctttcacatttaaagtcattgttgataggtaaggagtaacttgcattttgttaattgtttttcatatgttttgcagttcttttttttttcctctcttgctgtcttcttatgtttggttatttcttgtagtggtttggtttcttttcttcttcttcacattttgtgtatctcctataagtttttaatttgtggttgcaaattaacatcttctattaaaagctgtcttaatgttatcagcttttttggaatcattttctttctcttccctcttcagacatatttgcaaatagtctgtttttcaagacacgagtaaatagggctctggttagaaatttatcaatatggaaaaaaaaagatcctctgagtcttttgataagttagaaaataatgatagactgtggcagaatgtcatgtatttcaagtatttcatctgtgttactctgcaatatattttctgtgtgcatttgtcaatgttatatatttataaggtaaatccataaagcatacattctagaatctcctaacttaggtccttaagagatatgctccttataaccttcttggcactcttgaagtgttaaatatttccattgaagaaggttgcatatggtttctgagatgaagtctagacaggttacgattattttttgttccttttgcccacacagcacccactgtcccctccctttgttattagcctttatctgataccctagatgaagccaccttctgtccttcagttttggcgtgggggctgatttcacccccagtttcaggaataagcacaggacagctactaacaagtatgttgttcactcaaggaagaaacccagctaagggagaaaggggggctgaaatccggcctacatgctcttctccaagccacatgccccgatacagggctgcatctaactgcagaaagggtagccattttctaatacttgcaaaggcactgtgtggacagtgcaaactctgtatgagctcatgacacaggcctggccaataaatatacttctaatcctggcacagatcagactagagacggacatgaaatccaagcgtcacacccaaagtcaatctctagtctcttattgagactattagaagtgtttctgtgtttgctttattctggggctgtggaactaaggaagtgtaaactggaggagtgatgatggccacattgcagaacaaagggaaaacttgtctgagaataaagtcaatggggaagaaaaaagcaagaaagctgagaagagctaagtcctgagtccctacgttcagccattctgaagctacaccctggatttttccattatacgagtccacaaattaatattttttttttggcttagaccagtttgagtttgaattctattatttataaccaaaggagtcctaccatattatcatagctggattttcataaacacggtatatgttgatcaacaaacttcctagatgtttcaagttcactccgaagagtgaggggaaaaagaaaagaagggaagaaaatggttacttatcatccacagtagtcaaggaagctacagaagcatcaagcaaaagcagcggaagttagctttgtactcccacaaaccctgctctgaagtactccgcctagtggcccacagcagaagctgcatttctaaaatctttaaaaagatagaacaggaatcaccacttaccctgggaaccctaataggtgagcaggccacatgggaatatgtcccattggtttgaggtagataagtccattttcaaagcggtagtaattccggaaacaagaacatattaattttactttgatcacacaatgcctagttatattaaaagtaaagagacattcaataaataccttttatggaaataaaaacagacaatttaggagagaattaactatcaatgcgttattttcaaaggtaaagaaaaaagaaattattctgaatgcacaaaactattttatcaaatatcatggtaaattatcattatatactaggtcacttaataaatttccagagatgattgtaaacagtttccacaatagattttgtttcaccccaggaagtttcacaaaaagttagttacttatctccattgttactagtgccaactaatcctatcattctgagtcaaattaaaaataacatccacacttttctccagtgagatcacaggagatgcctaagtggagtgtgttttaatgtgaggggataattggtttatatttttcactgacaataacaaataaattctagacaacttaagcaaaataggaattcaatgaaaggatactgaatagttcacaaaatcactgaagatgctggagaagcaaggtaagagctgagggaaacttggcacagccaagttcatcctacggaagcagatcttgggatgccacaactaggatgttgccatttgacactcatcaccatgtagctgggctctgctgaacttaggcacttcctgccacattcctggacctgcatctctgctcagttgctcagaatcatctctgattctttcaggtcttttgcatcatttcgtcgggttccaagttctaataaagagacatccattggctgggcctagatatgtgcccacacttgagtggccaagaaactggaaaaaggatcatgcactccctttcagcttttgtaatggaaggtggggcctgtcctcatactttgcttggggttcaaaaaactaggaagggtgttttgttgaaatgaaacccaaaactatagctatccatttatagcaccttattagtacaggaaaaaaccatgagacaaaatgtataaaagtgcatgggaggtctaaacatatgagggggtttctgaggagaggaagatcatacttgattggtgctgtggtttcactgtgcctcctccgagattcagcgttgacaatgtgatagtgttgaggtggagcctacaggaagtgattaggccatcaggactcctacctcaggaatgggtttaggagccctcatgaaagggcttcatggagggagttcattcctcttgccctcccaccttccaccatgtgaggacacagtgttccttgactctggaggatgcagcataaagacaccatcttgaaaggagagaacagcccttaccaaacatcagacctgccagcaccttgatcttggacttcctagtctccagaactgtgagagataaatgtctggttttcataaattgcctagtctctgttatttcactataagagcataaattgactaagacaactggggattagaaaaagtaatatgaagcggcatttgagaagggcttgatagataagatctctacaaatagaaatagagagatggtttcacatcacccaggtgaagggaataacatagccatgttcagtctgaatgcaaaatggagatggtaaaaaaagtacataggattccaccaccagtgggaggacagaattgcaatgtggcagcaatctgtaaattaaaatatttatcactcattcccatttatttagagtctaatgtgttctaggctctgaaattaagcaaagaaaatctagatatgagtaagtccaagactttgcctttgtgacagtcaaaataatgaccccataaagatgttctagtccctggaatctgtgaccatattactttacatggggcaaaatggattctgtagatgtgattaatccttgagttagggggattatccttgattatcttgggggccaatctaattgcatgtgtctataaaatcagagaatctttcctagctgcagtcagaaggtgacatgaccacagaatataaaatcagagaatctttcctagctgcagtcagaaggtgacatgaccacagaacaatggtcacagatatcccacattactggctttgaagatagagggatggtcctatgatccaaggaatggggacagcatctacaagttggaaaaggaaatggattctctctagagcctccagaaagcaatacagccctgacaataccttgagttaagcccagtaagaccacggtcagaggtttgccctacagaactatagggtcgtaagtctttgatttaagccacaaagttgtggtaatttgttatggcagcaatagaaaattgattttaaggagtttattgtttggaagataggcagaccagaaaatccaaattataatataattcgattaaaacctatggagatttgggctaggtgttttagaaaagaactgagtattaacaagactaacagaagaaattgttctaaaatttacacactaagtacatcacatttttctaatgatcacattgatagagcaacttagaatccatgctttcaacaaaccaacaggcttatatacatatatatataattttatatatatataattttatatatatataattttatatatataatatataatatatggaatagccccacgggcatgggcagccctgggccacagggcagcactgtactagcagcctacaccccaccttacctgcctaccctgagctgacttgtctgctaaatgctaaataaacctgtcaacctgtcgggtttaactcagaagggcctggatgcaacaagcctgagggctgtgactggggtaagagagagcacagacggagctcctcctccttccaccactgcccaccagctgaaaaccaccaactgaagtttgctaagattctcagcctacaccttgttcccaacaaaactcatgcaatactttggcccccactacaatctcttgaataaaatattctacggatctgctttttgagctgcaagttatcttactaaattccaagaagctcatgtaagagaaaaccaccacataatataagattttcaatgtgatcatcattgctacttttaactagaaaatatccagtaaatgtattgtgaactgctttgtgactatggtgatttatttagtctttctgatccttggtttgattatctcaaatatataagtatcaccaattttataaagttgctctaaaaattaaatgagagaaaaataattctccttctccacatactgaacacttacaaaattataggcattgtgtccaggtttttacatacttacctgatggaagtctcctaacaaccctctcttttaaattacaagcattttgccacgatttttacacatgtatgttatggaggcctcgcaacaatcacatcttttataggtgagcaaactgaggctcagacgagttaaaaacacattcaccatcaaatcataatgagggacggaactgggattcaaatccagttctctctgatgccaaaaatggtgcaatttaacaaggaccaagttacacccagaacatggagggatcataacatgtggattcccttttctgccccctcatgtgggaatttcaatagctttcactgcctcagagcaatcctaaactccctcccaggtgccttgcaatggcccccttattcgtgggggtgattaggaatctgcatttttggaccacgagcatccataaacagttgtgttgatcaagaaataaaattttctaggccataggttactgtgaattgtctagcttctctgcaaaaaataaaggggctattccatgtaaaaaaatcacaggatccactgaatttgtgcagaaaaacttagaactataccgcaggaggatcttactgacagctgtgcctgaagaccagcccaaccacacaaagcaatagcacctccaatggccaggtgtggtggttcttgcctgtcatcccaacagtgtgggaggccaaggtgggtgaatcacttaaggccaggggtttgagaccagcttgggcaacacagtgagaccttgtccctacaaaaaaatcattttttattattagaatcaagaagagtacctctaaccccctgtcattgctttagggtagagagctctggtctagaactcaagatatgaaattgtgaatcccagtgtagctacttaagcttaaattcaagagctgccagacatttcctctacagcaacgaaatctgtagcatccattttgtattttgaaaacttagtttttggccagcctctgggaacaaaaggacccagaattgggcatttgggtagggagggaaaaagaaaccggctggatgcaaaaggggaagacgaaggggtggggacgccaggcagagccagtcctcatgcttggggcctggacctaggaaaggaactaggtgaagaagggaggagccccaggctgtggatgtctctgggggaaccttggttcagcaatggccagaggaggtcctgaggccaagcggtatctgtcgcctccttacctttgggtgtcttctggtcgccaatgtgctgcaggtcatggctccggaatcaaattgggctcaaacggggcaagctccaacacagtggagcctggcgctactcccacctccaccttgcggatctcagagctgcaggatggctctgcccaccgcaccctgagctggccccgcttggggctggcattgggggacagtgtgttctgggcgtctctgctcctctctgctggtgcctgtgcctctgctggccgcccactcatagatgtcagagccacaggacggccccgcagaatccctgcgctgaccctgccgggggctggctttggtgcacatgcaactcgtcatcgtggtccccatggggcacctctgctcttctcgaggcagcttgggccttcgcttgcccccacgtctgcagagctgagcacctgccacctctccccaggaaaggcaaccaaatgccaccaacttaaggcacccactgaaggcactaactgaaggccaccaacggaaggccggttgccctgccagccagatcgcgtactgcttaggaagaaccaatcaggccttgagttccctccacgtgctgcccttccatttgtgatgtggaagtccaggcactggctcacaaaaccgcgccccccagtgatgccgccccacctttcatttattggtagctggtagcaactttcaggtttcctcactgtgaattatgaatatgaattatgattaaattactgtatgctaatgtacctcatgcactatctgacagtcaaagtcccctcttcccccatggcctctgagttttttggaaactagaaagaagacacatttctgcaggtgctttcagaaaaaaacattgccacgacctaatgttactctgtgacgtcaagtcatatttcatatatcatacatattcatatttatattcataattcaaaatgcacatattcaatcaaattaacaggactaacaaaggaaattttctaaaacttatacactaagtacattatatttttctaatgatcactttaatagagcaacttagaatctatggtttgaacaaatgaagaggcttatgcaagagaaaaccaccacctaacacaagattttcaatgtgatcatcattgctacttttcactagcaattgtccagtcaatatattgtgaactgctttgtgactatggtgatttatttaaacttactgatcctttatctcaaaaatatgaataataccaattttataaacttgttctaaaaattaaatgagagaaaaataatcctccttctctatatattgaaaacctacaaaattaataacattgtgtccagatttttacacacttaccttattgaagcctcatcacaaccccgtctattaaattataggcattattcccagatttttatacacttaccttatgcaagcctcgtaacaatcccatcttttatagatgagcaaactgaggctcagacgagttaaaaacacattgaccatcaaatcatagtgagtgatggaactgggattcaaatccagttctctctgacaccaaaggtggtgcaatgtaatgaagaccaagttatatccagcacatggagggaccaaaacatgtgaattccctttctctaccctcttacgtgtgaatttcaatggctttcactgcctcagaaccatcccaaactccctcccaggttgccttgcagtggatcctttcttcttggggatgattaggaatccgcatttttggaccacaggcatctataaagagttgtgttgatcaagaaataaaattgtctaggccataagttactgtgaattgtctagcttctctgcaataaataaaggggctattctctttattttttattattccactattcacaatagcctagaatcaacctaagtgtccaagaagactcggtttaaccctggggattactaatgttttcattgtggtcaatgtggtagattatattaccattctcccattatctggtcttcctactgcagtggccctatctcctagaagattatacatttctgtcctattgaagtaagggtcagatttagacatgtgaccggtttggccagtgaaatgtaggtagaagtggcatgtgtaacttgttagcagaaaatttcctttttcaaggatctgggagccatccctttcaaatgtaatcctccagaaagataataccttatttcccagtctctatgagagagtaagagcctaatcttgctccaagttgtaaaaattaccttatattataaagataaaagaaagtttatttttcctttgagaaaagacagttagcaaagacaggtggcctatgatcacccccttactctcgctttcaaaaactccactgccctttgtatcaggggagctgagttcagactaggttctggcctctctcccctgttgaataatatcttccttacttatttaactttttccagtgcaattttttctttgactctttcctccctctctgaaacttgcattgaaattttagtaggatacaaggcaggcaatctcgacccttgaatatataaaagaaccctttaggattaaaaaacccatgttctcttccataagttatttcttcagactattgccttattaaaagtttctagttcttatttttgcattgaaaaggagaatgatgatttttaaataagttcctactcacttttaatttctactatcacaattttattgcttttcatggcaatagatttctctggttcaacaagaaggccagaacaaggaagtacagaaacatctcaatatatcttaaaaagttatttaacatggacagtgtcatttaatatctttaacatccctatcaaatggatgctattattatcccccttttacaggatattaaaacttacatactgtaaataaccagctgaaagtcatatagcatggaaaatacaataagcatacaaagaagcaatggcattagaagtggaggagagttaaggattaaaaggctaaacttagtttggttaagaaaaaagaaaactaggaggtggcaaactcttgttggaaaggggaaggatttgggcagagcaaggtagtggagtcgatctctccagtaatcttacccctacggacacatctatatgaacaactatccacatataaaattacctttacaagagctaacgaaccctgaatacatgagtcagtctatgaagcccctttggactgcaaagagtagaaccatgcttggacagtaagggaaccagtactctgtgactgtgatactcctcccccaggccataatggtattatatgcagaaagtcctccttacagttcttacactgaataaagtgagcagaagttgaatatttttttccaccatactgagtcccttcacagtagactcctgcatcagcccacaagcagcaccatgagtgtcaacagagctgaaccgcccgaggcatgctagggacatagagaaggggttgggttagcaatactcattatatgaaacttagcagtggctagccattcctaccagaggaaacactacaccagagaggttgtttatgggcaccatgctgtgggaaacatgatacacagactgtccagatttgatagcctgacttgttctcccccacagccaggagcctttctgtggatcacccatgggcccattcagttacattgcatcagtggtgaagccccattgtgagacttatgtctaacctttgctttgggcacctcctaatgctaaaatggaatataatggaaatccacaccgaatttctaaacaagcccactgagaaacagtcaaaaacaaacccagactgagaagactgaaataaatatttaattcatcaatgtgtagacagagatatacatctacaaaaaataagaatagcctaggaaaaactgcctcaccaaatggagaaaataaggtgtcagcaactgaacctaaagacatgcaaatgaatgatgtggcagacaaaaaaaattcaaatagctgattttaaaaaaaaaatcggtgaacttcaacaaagtacagagaaacaatatggaaatttataagaaattcaacaaagaatttaaaataatgggaaaaaatcaagtggaaatcctggagttggaaagttcagtaaacaaattgaaaaatgcactagagggcatcaaaagcagaactgatcaagtagaagaaaaaaacagtgagctcaaagacaggctctttgaaaatacactgtcaagagtagaaaagagaaaaaaatgagaagaaacaaagaaaacttatgagatccatgggacaccatcaaaaaaaaaaaatctacagtgttaaagtggaactgagaatgaaaaagagttagaaaattattcagagaaataacagaaaactttttaaacttagagaaacattaagatgtttaggatggccaaagcgcactaatctgatttaatctgaataagacaaccacaagatatattataattgaactttcaaaggtcaaaaacaaagagtaggtcctgaaagcactaagaaaaaggaagcatataatacataatgtgcctggcagcagacttctcagcagaagcaatgtgggccaggagagagtaggataatagaatcaagtgctgaagaaaaaaactgtcaaccatgaatgtagtatccagaacagctctcatttgaaatgaaggagagattaaaacgttctaagacaaacaaaagatgaaggaattcattgtaaccatacctgccttaaaaaaaatgttaaagaaccgtcttcaaagtgaaagaaaagggcactaatatgtaatgcaaaaaattggaaggtataaatccacaggtaaaaataaatattcagacaaattcagaatgctctaatatagtaataattgaatgtaaaccacttacatatttttagtaagaaggttaaaatacaaaacaaaaataataacaactacaataatttgttaagggataagtgatataaaagatgtaaattcagacatcaaaaatgcaaaatgtgggggagtgattgagttaaagagcagagtgattgtttttccccatttcttattatcaaaattaagttgttatccattcaaattacctgttgaaaccataaaatattcttcacatgcctcatagaaaccaaaaggcaaaaatatttaatagatacactaaaaataaaagaacaagaaacaaaaacacacagaaaaaatcacttaactacaaaggaagacaataaaggaacaaaaaggtacaaaaattctaaaagacaacaagaaaaccacgtacggcagtacaagtccttatctatcaataattaccttgaatgtaaatagattaaattatccagtaagaagacagagaatgggtaaatggattaaaaacaagacctaactatattctttctacaagagactcccatcacctttaaatacacgcataaattgaaagtgatcagatggaaaaatatattttacgacaatggaaatcaaaagaatgcaggagtaggtatatttatatcaaataaaatatacttcaagtaaaaaaactataaacacagacaaacaaggccattatgtaataataaaggggtcagtacaacaagagaatacaataattgtaaatacataatgcactcaacattggagaacctaaatatataaagcaaacattaatagttctaaaaggagagacaaaaaactgtgcaataatagtaaaaaaccttgacatcccattttcagtaatgaacagatcattgagagagaatgtcaacaaggaaacatttaaactgcactctaggtcaaaagaatttaacagttatttacataacatttcatccaacaattgaataattcagtcttttcatctgcacatggaatattgtccatgatagatatgttagaccacaaaacaagtcttagctaatcaaaaaatcaaatcatatcacatattttttctgaccatatggaataaagctagaaataaacaataagagaaacttcagaaattgtgcaaatacatataaattaaacaatatatccctaaacaaccaacgggtcaatgaaaaaaaaaatttttttaaatgtcttaagacaaataaaaatgaaatcagaacatatgaaaacttatgagatacagcaaaacagtccttagagggaagtttatagcaatacatttctacatcaataaagaagaaagataatgaataaaccctctaattatgtatttcaaggaactataaaatcaagaacaaactaagacccaaattagcaaaagaatataaagatcagagcacaaatatacaaaatgaagacaaaaaatacaaatgattaattaaagaatcttttttgaaaaggtaaaattgacaaacgttttgtcagactaagaaaaaaagagaaaattcacataaagtcagaaatgaaaaaggatatgctatgatggacactacagaaatacaaggaatcatgagtaagtactacaaacaattatacaccaataaattgaaaaacttagaagaaatacatatgctctggacacatataacctatcaaaattgaagatagaagaaatggaaaatgtgaacacaccaatgacaaataatgagattgaaggagtgatttagtctgtcagtcaaggaaaatccaaaagacttcacacagtagctcccacctgtaatctcacattttaggatcccaaggcaggagaatcactagaggccaggagttcaagattagcctgggcaacacaacgggactccatctctaaaaataaaaataaaaattccccaggtatagtggtgtgtacttatactcaggaggctgaggcaggaggatcacttaagaccaggagtttgaggctgcagtcagctacgactgcaccactgtatgccagcctcagtgatagagtgagactctgtctctaaaaaaatagaagaagaaagaaaagttcatgacttgatggttttcactgacaaattctacaaaatattttaaaaacttatacagattatttacaaactatttcaaaaaaatgaaaaggagggaactcttgcaaactcattctatgaagacagcattacctgaatccaaaatgagacaagaacagcaaataaaactccaggccaatatcattgataaacatacatgcaaacattcaaaaccagcagtgctagcaatgataattcaaaagcacattaaaaagattattcaccataatcaagtggtatttacccggggaggtaaggatggtctaacacatgtaaatcaataactgtgatacatcacattaaacaatgaaggataaaaaacatataatcatttcaatagatgcagaaaaagcatatgacaaaattagacatccttttatgatcaaatcttttgacaaattagttataaaagaacataataaaataaagaccatatgtgataacccacaggcaacattatactgaatggtgaaaagttgaaagctttgcctctaggatctggaacaagacaaggatgttcactttaatcacttttttcaacatagtactggaagtcctagtcagaacaattaggtaagagaaagaaataaaaggcatccaaattggaaaaaaaagtctaattgtccctctttgcagatgacatgatcatatatgtaaaaaaccctaaataccccactgagaatcagaaatagtaaatgaatacaataaggtttcaagatacaaaagcaacataaaaaatcagtaacatctctattcaccaatagcagactatctgaaaaaggaatcaagaaagtaatcccatttaaaatagctattaaaaaaaacaaaatacctacaagcaaattaagccacggaaagatgaaaattattaaacattgataaaagcaattgaaaaaaattaaaataaatagaaagataccccatattcatggactagaagaattaatattgttgaaatgaccacactactcaaatcaatctatagatccaatataatctctatcaaatttccaatttcattcttcacagatattaaaaaagatcttaaaatccatgtgaaactacaaaacaccccaaatagccaaataaatcttaagcaaaaagagcaatgctagaggtattacactatctaatttcaaaatgtattgcaaagctatcctaactaaaacgcatggtattggcataaaaacagggacacagaccagtggaacaaaaatagagagcccaggcataaatccacacgtttacatgcaacttatttttgacaaagatgcaaacattcaatggggaaaagacagtattttcaacaaatggtgctgggaaaagtggatatccccatacaaaagaatgaaagtagacccctatctctcatcatatccaaaaaccaactcaaaataaattaaatatttaaatgtaagaccccaaactatgaaactagtagaagaaaacataggtgaaatgttatatgtcattggtctgggcaaggactttttagaaaagacatcgaaagacatgcacaacaaaagcaaaaataaacaaatgggattacaccaaataaaaacttctgcactgcataggaaacaatcacaagagtaagcagacaacctacaaaatgggagaaaatatctgcaaactattcacttgataaggggttaatatcccaaatttatagaaaactcaaacaactcaatagcaaaaatacaaataattggattagaaaatagtcaagagagctgaatagacatttctccaaataagacataaaaatcaccaacaggtatatgaaaaaaatgctcaccatcactaataatcagagaaatgcaagtcaaacctgtcaggcctctgggcccaagctaagccatcatatcccctgtgacctgcacgtacacatccagatggttggttcctgccttaactgatgacattccaccacaaaagaagtgaaaatggcctgttcctaccttaactgatgacaatatcttgtgaaattccttctcctggctcaaaagctcccctactgagcaccttgtgatccccactcctgcccaccagagaacaacccccctttttcctttacctacccaaatcctataaaatggccccacccctatcttctttcactggctctcttttcggactcagcccacctgtacccaggtgaaataaacagctttattgctcacacaaagcctgtttgatggtctcttcacatggacgcgagtgaaatttggtaccgtgactcagatcgggggacctcccttaggagatcaatcccctgtcctcctgttctttgctccgtgagaaagatccacctataacctcaggtcctcagaccaaccagcccaagaaacatctcaccaatttcaaatccggtaagtagcctctttttactctcttctccaacctccctcactatccctcaacctctttctcctttcaatcttggtgccacacttcaatctctctcttctcttaatttcaattcatttcattttctggtagagacaaaggagacacgttttatccatggacccaaaaccctggtgctggtcacagactagggaaggcagccttccattggtgtttaatcattgcagggacgcctctctgattattcacccaggtttcagaggtgtcagaccacacagggatgcctgccttggtctttcacccttagtggcaagtcccacttttctgggggaggggcaagaaccccaatcccttctctccatgtctctaccccttctccacttttctgggggaggggaaagaacccctcaaccccttctccttcacccttaatggcaagttctgcttttctggaggaggggcaggaaccccaacctcttatctctgtgccccgatcccttatttccgtgccccgacctcttatctctgtgccccagctccttatttccacgccccaaccccttctctgcttttctggagggcaagaaccccccaccccttctccgtgtctctactctcttttctctaggcttgcctccttcactatgggaaagcttccaccttccattcctccttctcccttagcctgtgttcttgagaacttaaaacctcttcaactctcacctgacctaaaatctaagcatcttgcatcttattttcttctgcaatgccacttgacaccaatacaaactcaacagtagttccaaatagctggaaaacggcactttcaatttttccatcctacaagatctaaataattcttgtcataaaatagacaaacggtctgaggtgcctgatgtccaggcattcttttacacatcagtccctccctagtctctgttcccaatgtaactcatcccaaatcttccttctttccctcccacctgtcccctcagtcccaaccccaagcattgctgagtctttctaatcttccttttctacagacccatctgacctctcccctcctcaccaggctgagctaggtcccaattcttcctcagcctctgctcctccaccctataatccttttatcacctcgcctcctcacacccggtctggctttcagtttcattctgtgactagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatggctcgtttggcagcaaccctgagatgttttacagccctaagagcctaaaagatcaaaaggccgtcttattctcaacatacattttattacccaatctgctcccgacattaaataaaactcctaaaatgaaattctggccctgaaaccccacaacaggacttaattaacctcaccttcaaggtgtacaataatagagtagaggcagccaagtagcaacatatttctgagttgcaattctttccctccactgtgagacaaaccccagccacatctccagcacacaagaacttccaaatgcctaaaccgcagtggccatgcattcctacagaaccgcccccactaggagcttgctacaagtgccagaaatctggccaccaggccaagaaatgcccacagccctaagccatgtcctcctaagccatgtcccatctgtgcaggaccccattggaaattggactgtccaactcacctggcagccactcccagagcccctggaactctggctcaaggctgtctgactgactccttcccagatcttcttggcttagcggctgaagactgacactgcctgatcacctcggaagccccacagaccatcacagatgctgagctttaggtaactctcacagtggaaggtaagtccatccccttcttaatcaatatggaggctacccactccacattaccttcttttcaagggcctgtttcccttgcctccataactgttgtaagtattgacagccaggcttctaaacctcttaaaactccccaactctggtgccaatttagacaatactcttttaagcactcctttttagttatccccacctgcccagttctcttattaggccgagacactttaactaaattatctgcttccctgactattcctggactacagctacatctcatttctgcccttcttcccaatccaaagcctcctttgcatcctcctcttgtatcccccgaccttaacccacaagtataagatacctctactcgctccttggcaactcatcatgcaccccttaccatctcattaaaacctaatcacccttacccctctcaatgccaatatcccatcccacagcatgctttgaaaggattaaagcctgttatcactcgcctgctacagcatggccttttaaagcctataaactctccttacaattcccccattttacctgtcctaaagccagacaagccttacaagttagttcaggatctatgccttatcaaccaaattgttttgcctatgaaccccatggtgccaaacccatatactctcctatcctcaatacctccctccacaatccattagtctgttctggatctcaaacatgctttctttactattccttttcacccttcatcccagccttcttcactttcacttggactgaccctgacacccatcaggctcagcaaattacctaggctgtactgctgtaaagcttcacagacagcctccattacttcagtcaagcccacatttcttccttatccgttacccatctcagcataattctcataaaaacacatgtgctatccctgccaatcatgtctgaccaatctctcaaaccccaaacccttctacaaaacaacaactcctttccttcctgggcatggttagatactttcgcctttagatacctggttttgccatcctaacaaaaccattacataaactcacaaaaggaaacctacatgaccccatagatcctaaatcctttccccactcctctttctgttccttgaagacagctttagagactgcccccactctagctctccctgactcatcccaacccttttcattacacacagctgaagtgcagggctgtgcagtcagaattcttacacaaggactgggatcgcgtcctgtagcctttttgtccaaacaacttgaccttactgttttagactggccatcatgtctccatgcagcggctgctgccaccctaatacttttagaggcccttaaaatcacaaactatgctcaactcactctctacagctctcataatttccaagatctattttcttcctcacacctgacgcatatactttctgcttcccagctccttcagctgtactcactctttgttgagtctcccacaattaccatttttcctggcccaacttcaatctggcctcccacattatttctgataccacacctgacccccatgactgcatctctctgatccacctgacattcactccatttccccacatttccttcttccctgtttctcaccctgatcacacttggtttattgatggcagttccaccaggcctaatcaccacacaccagcaaaggcaggctatgctatagtacaagccactaacccgcctcttagaacctctcatttcctttccatcgtggaaatctatcctcaaggaaataacttctcagtgttccatctgctattctactactcctcagggattattcaggccctctcccttccctacacatcaagttcaaggatttgctcctgcccaggacaggcaaatttgctattctactacttctcagggattattcaggccccctcccttccctacacatcaagcttaaggatttgaccccacccaggactggcaaattagctttactcaacatgccccgagtcaggaaactaaaatacctcttggtctaggtaagacactttcactagataggtaaaggccttttccacagggtcgaagaaggccaccacggtcatttcctcccttctgtcagacataattccttggtttggcttcccacctctatacagtctgatagcagaccggcctttattagtcaaatcagccaagcattttttcaggctcttagtattcagtgaaacctttatatcccttacagtcctcagtcttcaggaaaagtagaacagactaatagtcttttaaaaacacacctcaccaagctcagccactaacttaaaaaggactggacaatacttttaccactttcccttctcagaattcaggcctgtcctcagaatactacaaggtatagcccatttgagctcctgtatagacgctcctttttattaggccccagtctcattccagacaccagatcaacttggactatgccccaaaaaacttgtcatccctactatcttctgtctactcatactcctattcaccattctcaactactcatacatgccctgctcttgtttacactgccagtttacactgtttctccaagccatcacagctgatatctcctggtgctaccctcaaaccgtcactcttaactcttaaagtaaataaaaaatctttgctggcaaagctatgctgaacctccttaggcactctctaattagatgtcctaggtcctcccaattgttagtcctttaatacctgtttttctccttgtcttattccgtttagtttttcaattcatacaaaactgtatccaggccatcgccaataattctaaatgacaaatgtttcctctaacaaccccacaatatcaccccttaccacaaaatcttccttcagcttaatctctcccactctaagttcccacgccgcccctaatcccgctcgaagcagccctgagaaacatcacccattatctctccataccacccctaaaaaattttcactgtcccaacactttaccactaattcattttatttttcttattaatataagaagacaggaatgtcaggcctctgagcccaagctaaggcatcatatcccctgtgacctgcacgtacacatccagatggccggttcctgacttaactgatgacattccaccataaaagaagtgaaaatgccctgttcgtaccttaactgatgacattatcttgtgaaattccttttcctcgctcatcctggctcaaaagctcccctactgagcaccttgtgacccccactcctgcccgccagagaacaaccccccttttgcctttacctacccaaatcctataaaatggccccaccccatctcccttcactgactcttttcggactcagcccacctgcacccaggtgaaataaacagctttattgctcacacaaagcctgtttagtttagtggtctcttcacacagatgcaagtgaaaaaacccacagtgagatatcatctcaccctgcttagaatgccttttatgaaaaagccaaaaaataacaaatgctggcaaggatgtgaagaaaggggaatgttcatacactgttggtggaaatgtaaattagagcaattgttatggaaaacaatataacttccaaaaacattaaaaatagacttaccacataatccagcaatccccctactgggtgtatattcaaagaaaattaaatcagtatgtcaaagagatttctgcactctcatgtttattacagcactattcacaatagcctagaatcaacctaagtgtccatcaatgaatgaatggataaagaaaatgtggcatatatgctgtatttggccattcttgcattgctataaagaaataactgagattggataatttataagaaaagagacttaattggctcctggttctgtgggctctacaggaagcatagtgccaacatctgcttctggggcctcaggaagcttgagaacttgttcactatcatgaggatagcaccaagccatgagggatccacctccatgacccaaacacctcctaccaggccccatttctaacagtggggattacaatataacatgagatatgggtcaggacaaatatccaaactatatcatatgcacacttggccataaaaaaaggataaaatcgtgtcatttgtgacaacatgaatgagtagagaggacattgtggtaagtgaaataagctaaccacagaaagacaaatatcacatgatctcattcatatgtgaaatctaaaaacactgatctaatagagagtagaagagtggttaccagactgggaaagttagggagaagaggttttaacaatgtatcatgtatcaaaataccacattgtaccccatcaacatgtgaaattatcatgtgtccacttaataaaaaaaaagaaaatggaagagtcaagatactggggcacttgaagagatagaaggtgaattggcagtaaggaagagagagtctgaaagagcaggtcacagagtggaacattaaagtttataacattagaaatcaatttttaagttattgaaaagtttatagccatgaaagtgagtagctcaattgaagtgaaagtaaaagtcaatgaaagattaaattagaaaatatattgcttggcatttagtagttacttcagaaatattaataaatcttaagaaaattaagaacgccaaagcattcatagtgggccattatcataatacaaatgtatgtggtaatattttattctttctagtgaagggagtaattcaacagtcttgattataggttagaaaatgattctccaggtgtgacccactgaccacattcattgtatttgaattgcttgagcaacttgtttcagaagaaaatggaaagattttaagatggaccaatgaaattaccactgagtgtcttcaagaaatctcagccttgcctagaataacctgggttatctgtttctatggggtctttttgccttttgttttctttgttatttgcaatcctgttagtcatagattactgatagtaatgcaaatattcttgtccatagacatgcaaatgactgatttgggtggaagtataattaattttccttttttcaccttccatcaagaagtcagttttgaacctatcaagaaaatttatttcagtgttccttagtgcatagagatgtgtggctcttttaattttccataaaactcattataacatcttactgactccctcattaaataaatgagttaaacaaaaatcttagacaaatgttcattttatatttgtaagtcataatttatcctacttgaagcaattttcctttaacattcctaaaaatacagattcctatgccccatgctagacctactgaatcaaaatctcaggcctaaggcacaagaatttgcattgttagtaagcttttcaagtgatttttaggcatactatattatattaaccattaccattctaattctttaaacttgaattattgtgtttataattccaacttcatcaaagtaaactttttgttagcaaaaacggtagaaacccccttattcaataagattgggaccagtaataaatagattaataacaaatttaagttagatggaggaatcataagaagtattagatgtaagtccttaaaacaactttaatttaaaagacatgtgtaaataaatttgccactattttgatgacaaggtcaaagccttgcacggattcaatgagtggagtttcttgtggaaactatgccaatgatatgttgtcattcatttctcgttcactttctgtgaagacaactggggtaaagcaatctgaaatcctagagtatacaatttttcccatttgtttctagttgtcttgcccactgttaagttggcagcaactgtttgagtgtctcattttcccaacacatttggtttatttctcaaagaaacaacaatactactcttgttgtactcattttctcagtttacataatatttattttttattttatttattttttttttgagatggagtctcgctctgttgcccaggctggagtgcagtggtgccatctctactcactgcaagctccgcctctcaggttcacctcattctcctgcctcagcctcccaagtagctgggagtacaggcgcccgccaccacgccctgctaatttttttgtattttcagtagagaccgggtttcaccatgttagccaggatggtctcgatctcttgacctagttatccgccctccttagcctcccaatataatatttaattaaattgcataactacaagagcaagaacaaatggtgtaaacatatttaggaatgaacacagcttcctcttagaaactatataatttctgtgatggaaggagaaatgtacaggcattaaaagtagctcaaaggctttcagtttgcaatggacatcagtcaataagttgtacaggggtaccagaaagtgctaattgtaaatcagttaagtggaggtcagttaaggcagcatccactgtatcttaatttgtgaagtgaatgttctaaaactgggttcacttttgctataaaggaccagatgataaatattttaagctttgcaaaccatacggtctctatagcaaccattcaactctaccattgtagcaggaaagcaccatagatccatggatgtgctccaataaaactttattaaaacaggcagctggtctgaggtccatgtatatatcttgctgttttcatacaattttctaagttagtagtttcctgcctttttaacaatcacggattacttttaatcctctcctctgattttatgtttcaaaagccttaagaaaaacccacaaaatatatttattttgtaattttgggggtggttcttattttattaataagtaatcaatgatatataaaggctacccattaggtcagtatgaaataatcaacattactaactctaatgacttagttctggatagaaataaaatatattcaactatatatacataacttaaaacctgtatagctgtttctggtgtaaatatataacttttcgagattttttcaagtattaaatacaacttttgggaatccccacacctggctccctatgatgacgttcaagaattccttaggattctgggaatcttagaatgaaagtcactgctctgtaggaatgaatgaatgaatgaaaaagaaaacgaaggaagaagacagagcatgtctactaattataaattaatcatcaatgaatgtttattttataaataaatttgtcaactttaggttgccaaatctaacaagataccaacatggcattcatggtgatcacacctctagtcaaattttattttagttcattgactatactattaatatcctgaaatactcaaaacttctgtctcaattcggtgaataattcacttattaatcaccgtatacactacttaatgaatggaatggtgcttggaataaagataattacagggctaaaaggtttttctctggaggcagggcatagaattttgttgtctgactggaataaaacaaaattaatcaatattttctgcaaccagtggcttttgacttagtcgtctattaatatctatcaatcactataatctcagtcctatttcctccatttttctttttgctatcataaaaacttgtccatttttttcctgttagatctatatgtttctcctcttttcttttcatccaaacaactggacatcaacttagtacacatagtccaatttatccgaaccttacagaactcactgtttccatttacataacttacataactgtcaagctgaaatcactctcaaatttttttaattcaaaattttaatttaatttaataatatttatttattcattaattaatttattttgaaaataattttaacttgtattttacattcaggggtacatgtgccagtttgttacatgggtatatctcataatgctgagttttggggtatgaatgatcccatcatccagatgctgatttggtatgatttgactctgtgtccccacccaaatctcatgttgaattgtaattcccaatgtagggggaatgacatggtgggaggtgattagctcatgagggcagatttcccccttgttgttcttagatggtaagtgagttctcatgacatctgatggtttaaacatatggcaaatcccccctggctcacttgctctccttccgccatggtagaacgtgccttgcttcccccttcaccatctgccatgattataagtttcctgaagcctcccagccatgcttcctgtacagcctgtggaattgtgagtcagttaaacctcttttctttataaattacccagtctcaggtagttctctacagcagtgtgagaacagattaatacatgagcataatacccaataggtagtttttcaaaccttgccttcctccttctcccctctagtagtcccggtgtttattctttccatctttatgtccatgagtacccagtgtttagctcccacttataagtgggatcatgtggtattttgttttatgttcctgcattaattcacttaggataatggcctccggctgcatccatgttgtttcaaaggacatgattttgttatttttatggctgcatagtattccgtggtgtatgaaatggtttggaaggtggcccctataaatctcatgatgaaatgtaatcctcagtgttggaggtggggcctggtagggtcatggggatggatctctcatggcctgatgccgtccttgtgatagtgaattctttcaagatctggttgtgtaagggtgtgtggtacttacccccactcccattttctcttgctcctcctcggaccatgtgatgtgcctactccctctgtgccttccatcatgagtaaaagctccctggggcctccacaggcgccatgcagatgccatcaccatgcttcctgtacagcctgcagagatgtgagccaattaaatctcttttccttataaattacccagcctcaggtatttcttcatagcaatgcaagaatggcctaatcatactgtgtagatgtaccacattttattgatccaatccactgtcgatgggcacctaggctgactccatgtctttgctattgtgaatagtgctgcgatgaacatgcaagtgcatatgtctttttggtagaataactgattctctttgggttatataccagtaatggaattgttggcttgaatggtaattctattttaaatgctttgagaaatttccaaaccgctttgaacagtggctgaactaatttacatttgcaccaattatgtgtaaatgttcccctttctccacagcctcccaagatctgttgtttttcaatttttgaatagtagctattctgactggtgtaggatggtatctcgttttggttttgatttgcatttctctgatgattagtgatgttaagactaatctttgccaccaaaaaactaggaaaatacagtgtcacttgtcaaaataaattgttttactttgctttaaaaataatcaattgagtagtatatttcttccagcaaaattaagaagtaaacatttagaattgtacagtaccttgctgttaagtcttcgcacaagtataccaatcgaacataaaggccaccttaaactttcatttgaaatgaaagacaatttttaagaggttaagggctagtaatttcttaaagtcctgaagttaaattagctcaagtaaatgcaaagactttcctttaattaaagacttttaaatgaacactttaaagcatagttggtttctccctcaaatcttgtccaaagccactgtttacaactcagcatatcaaagaaggcttcagacatgattgtgaagctccctcaacttacagtgtgctatttgcaaccttagatgctatcattctggcttttctaacttttagcaacaataagcacacccttctcatttctcccccaccctgacttacccctcttttcatttaatatacaatttttctcagagtgttcttacacatctttaactgtaaatatgacaaaagcacacagtatagtacatttatcacatgtataaatgctgtatctagtcatacaattttccttttaaaaaagaaatattttattttcaaaaagcaaagactctaggaatcttttctagctgccagtcataaaaacataaattcctggttagtttcccaaatttgcctgaccataagaaccacttgtgatacttgtcaaacacatgtatgctgagtcccatccatgatctcctgaatcagaatcaccaggtgagaggcctgggaatacacattttaaacaaatgtccacagtgattatgattagtaaagcttgaaaaacatttcactaggatctttatgactgaataacctcacaaacataggaaagttactggaaaaaaatatgagcagaatttcagaattctgcctttgctgaaagtgtttgttccctcctcctctactcatcaagacctgactgcttatgcaactcccccaaaccatcaatgggaagagctgaaaatgattttaatgaagaagaaaagctgatgtttaatttcaaaactgacggtttgaatagaagggagaggcatgaatttatcttgattctaacagaaagcattgtatttgggtctacaaacgaaattggtttcatttttattttttgtaagttttcgccaaactctgtgcatatatagaggctgggcaagaaagaaagaaatccagaaatacggcatatgccatcccttatttatttccccatgcgaccagccaacagcttcttcacctagtccctgcttcaagctgactttcagtctacttctctatcggaaatggagcttccccaaagactgcctcaatgtcagttacccagaggccttttttccatcttgggctcctaaacttctatgatattaaatgatactaccctttctggaaattctccttagctttgatttctataatttaactctgtttcattccttcttttatagcctttcttttctctatccctttactgtagacatattgtacgactttgttcttgaccttctgatctctccacattcattccttcagagcatgtatccattttcttggtgtcaggcttcctgactatctgattattaccatcatataacgatgttggtgatgagcatagctaacatatcctaggcattttccatgtaggttataataagcaccctatataactcgtaccatttaattcttcaaccctaaatgatactattactaaccacattgtatgagacgaggaaacagattttcatcaaaaccctggaaagccaacgtgaggagcccctgtgtgtctcctttgttaatgactccgggcatcatggcatgtggattgccatggaatggggattaggaagcgcagcactgtgaaaacaccagaaaatacgttgatagcggtaaggacgctcatctctgcacattgtgacggttttgtttctgagtcaggtttgagatgagccaatcctgactccatggtgccaccagggatcacgaatttaataagatcttcgtggatgcttggaacccaactggtctcggttttctactttagggaaagagccacagcttgagtggggtggttttggtgtcacatacgcgattaataacacccaccgctgcagaggaatcaccgtggactactcctcctttcatcccatgctcttgcgatggatccctctcacctgtttactgatttcattcaaattcttcagcgaccacaggaccccgacttgccttctctatcctggttccctcactctgctttacaggcctggcctgctcgctgctcctcacaccagcgctgcacggctccctccacgcctccgccctgtttcctccatcagacaggactagcttcctccatctctgtcgggcaaatgcctgcccagccttcaagaccctcctcagatgccgcctccacgattaggcttctttcagacccctgagcctgtaacacgggctaccataactctccacctcagcccacattcccacagcactcgcgacgtccgcgaccctcaacatggcgcttcattctcttttagggtatttcctgcttgtttcctgcacacacagtcgcgcgaggcgcagtcctgagtgacccacgcacgagtggcccgcgcttccagccgcgccgccgcaggccagcgagggcagcctgagccgcttcccgccccggcgaggaccgtcgccagcccgctgctctagcaggaggcggttccacagcgcacccggcagcccagccaccgtcagcaccgcgcctcgggcgggcttttctcccttccgggaggcgcgaatcctcaggggctccttgagagggcgccagggagcagctgcgcgcggatgccttttggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagaggtgggtcctgcagcttgggcgggagcctcctccgttcttttcggacgcactccacccccgcaactccggtggaagccgtggcgcggagagccggctttgtggcctcccaggcttcgccctggcccctgtccgggctggacggaggccgggccgcggttcccggcgtctgtgcagagaggggcagcctcccgcgcggacgaccctggaaacaggatagacgggcaggtgacccgtgaccccgtacccacgagtttgggtcccctgaggcatctctccaggcctctgcctggggggtctgcattagtctgatctcgtagttcatgataatttcctttattagggattattattttctccattgtctcttttctttctagaaaacttattaattttttctaatctaatatgtacagtgaaaccaggatgaatcacacagtggttgaggtgtatatgggctttagggatatgggctcgaacctgcactcttgtcatttactagttttgtaatttgtggcaaattggttaatatgtctgaacttccatttactcattaagagatcaaatatctgaacctccgtttacacatttatactttcagacgttttttatacttttagaagactgtgaggattaaatgagagaacatatatgcagaaaataaattgagccaaatgtgaggaggaggtcgtaatggtaatttattagctttttaggaaaaaatacctgtgcactcatatccccgcttcttttttaactggcagatttgcccgaggtacatacaaatgtcgagtatttcctcctggtctccgtgataaacagaggttttgatatttttaggcgagatagaaagtatcaaggagtgagttgaagccactggccttgagaaccctctcgaggagtctggcctcatgaagatgccagaataaatggcaggtttatcctgaatgaatgtgagatttttactctgtgaatttcctgggaggagaggagagttatcttctgaaaactttataatgaaaatgcagacacgggtgtcttaagatcatcgtaataatcataattaatgctcatatagcactgtcaatgtgccaagaaattgttgtaggcactttgcacattaactttttttcaaatcactcttggttttttatttttttattgagatataattcataattataaaattcacccttttgtacagtcaggggtttttagtatatattcaagaggttcaccactgtctagttgctcagcattttcatcatctcagaaggaaatctccccctacccattaaagcagtcacatcccatcctccccctctcctagtccttggcaaccactaatccgctctctatgtgaaatcgcctattctgaatatttcctaagaaatcatgcaacatgtggccttttgtatctggctcctttcacttataacattattgaggttcatcattgttgtagcgcctgttcctttttatggctgcatagtattccattgtatggatgtatcattttgttcatccattcatcaactgatgaacatttgggttgtttcccctttttggctattgtgactaatgctagtgtgaatattcttatgtaagtatttttgtgggtgtatgttttcatttcccttgggtatacatacttaggagtaaaattgctgggtcatgtggtaactttaactttttgaggaaccccaaactgtttcctgtagatgctgcaccattttacatttccaccaggaatgtgtgaaggtacatattacctcttaatcctcacaatagccttaagagttaggttaagttactatcctaattttttaagtggggaaactgactcagagagattcagtaccttttccaaaaatcacggagctaagaagtgaaagaatcaggatttaaaatctggcagtgtggctctacaatctgctttgaactctaacgtaatatgtgcaaagcctgaagcaacttctcagtactgtatttaagagggcatatcaatgtaagtcttcctaaatcaataatttataaatgaaacagcttaaaagactttcaagtttcaatcttacaatatttatcgtacaaatcaatatacctaaactcgtctatataaattatgtcctgtagtaagaagaaaaagagcaaagataagaaaagaaaaagagaagaagatgaagaaacccagcttgatattgttggtgagtcagttttcagtgctctattctgaaaaaagttaatgtttcttgagatctccttgaaagtgttttcctagttagaaatttatgatgtattcatatttgtcttaaagtgcttaaatattacctacagttataaattccatttattctttaacacagtagatgctactgatgcctttacttcattatcaggagagaaaaattataactctctgacttagtaggcaccattagactgcttaatagccagagattctaatacataattttaaaggcctaatgtaaatgttattcaaccaaatatcttttacaagttattttctttgcacatgtatgcattttaattgtagaagtcggttgtctcttaaaggaagtatcttcacaggaaaaatcattattttgtgaactctgaaatgaatgaaaattttaaatacaacatcagggtagcctgtaaatgatactagaaataaactgacctaaacacacttaaccagcctgttttccgtttagttcttttccatacatatttttttctcttttaaaacttggcaagttgcattttgaatcttcataaattatggtaacttaatatataaaatatggaatggtataaagctaatgttctggaagaatcattgctttcaaaatggcaaatcaacaattctaaaattagggtaaatatctagggtagatatgtagatgtggaattgctgtgtcaaaggataggtgaatgtttaactatataagaaaatgccaaaagttttctaaagtggttgtgccattttaccctcctaccaagaatgaattagtgctccagttacatccttgccaagagttgatggtgttatcagtcttttctcccagtctgagttttaccttttcagtttcttaatggtggtttttggatgagcagcttttttttgagacaaattctcactctgtctcccaagctggaatgcagtgatgcgatctcggttcactgcaagctccacctcccgggttcatgccattctgctgcctcagcctcccgagtagctgggagtgcaggtgcctgccaccacacccggctaattttttgtgtttttagtagcaacagggtttcaccatgttagccaggatggtcagaagcttttaatttttataaagctcagtttattttttttttcttttatggttactgtcttatgtctttgatctaagagatctttgcttaccccaaagtcaggaaaatattctacattgtcttttagaggcatcatagttttagtttttacattaaatctgtcattcatctcaaattaaattttggcatgatgttgtgagttcggtttcaagatttactttttttttttaaacatcttgatagccagttgtgccagcaccactggtgtttcctttttccattaatccactttggtatcttcataaaaaatcaattaactttctatgtattggtctgtttctggactctgttctatcgatacgtttgtctgtttttctgttggtatatttctcttgattgctataatttcatgaagtcttgagatcaggtagtgtgagtcctccgactttgtacttattaactgttaatttattaatttctgcagtgaagtttgttggattttctcgagaactgtattgagtccagatcatttgggggagatcaacatcttaatattgggcctcaatatttcataattttcaatgtagccatcttgcatgcctgtttaaacatttattcttaagtattttataattttacattactgtcaatagaacctttgaatttgattttccagttgtttgctgtcagtatgtagatatacaattgatttttgtatagtgactttgtagtctaagtctgtttcacttattacttctagtggtttgcttatatagaaaactaagaaatttgcaattatgtttcctgtgactatcgttttacttctttctttctaatccttttgtcttgtctttctttttattggtttattatactgtccaggacttctatagcattgaacagaagtcatgagaatgggcataattgcattgctctcaagcttaggcagaaagctttcagtagtccaccatatggtatgacgtctgtaggatctgcagagaaaacttttatcaaaatgaggacattccttttaaaactttgtttcttgggagtttttatcataacgatgtttaatgctgtcagatgcctctttctgtatctgttgagatgattatacagctttcttcattctgccagtggattatattggtttcattttcaacttttaaactaactttacatccctgagataaaccccacttggttgtggtgcgttgtcctttgggatattgctagatttgatttctaggtgtttgtgttttttgtttttttttaagatttctatattggtgttgatgggagatattggacttttgtatccttttcttgtaatgtctttttttgattttggtgtcaaggtgatactgggtgtcacaaaattagatggaaagtgctgtctcctttcctatttttggaaatagctgtgtagagatgggtatgagttgttctttacatgtttgatagaattcaccagtgaagtcagctgaacccggagggttttgtttggtttggttttagttttttgtgggaaaattaaaattttttaagagatattttcagatttttctgttgtgtcagttttggcaatttgtgtcttttaagaaaatttcatctaagttgttggatttattggcatagaattgttcagaatattcctttaatatgcttttaatgtccgtagaatctcatctgtattgcagtctcttcatattggtaatttgtgtttttgctatgttttcctggatcagtcagtctagctggaggtttctcaattctttacaagatcatttattttagatcgttaatgatcgtttagtacaggtgtattcaatcttttagcttccctgggccacaatgaaaggagaggaattgtcttgggccacacataaaatacactaacgataagctgataagccaaaaaaaaaaaaaaagcaaaaaaatctcataatatttcaagaaagtttatgaatttgtgttgggctgcattcacagctggcctgggccacatgtggccctcaggttggacaagcctgtttcaatattacttattttctctttttttcattttctatttcatttattttcagtcttttatttttttcctccctttaacttattttcagtttactttgctcttgttttattgcttcttaggaagggagttagatctcttcattccactttagtttcagttatagtcaacacattttgttttcattttcattccattcaaaatatcatctagttttccttgtgatttttcttttcatggacacgtgagttatttaaaagtatattgtttttaatttctactacatagagatattataggtatgttattgttgctgatttctaattcatttatagtatagttggagaacatactttcttagtgaatttccatgtagacttgaatgtgtattctgcagatgttggttcagggttttttgtttgtttgtttgtttgtttttttggagatggagtctcgctgttgcccaacaggctggagtgcagtggtgcaatctcggctcactgcaacctccgcctcccaggttcaagtgaatctcctgcctcagcctccggagtaactggaattacaggcacctgccaccacacccggctaattttttaaatatttttagtagagacagggtttcaccacgttgaccaagctggtctcaaactcctgacctcaggtgatcctcccgcctcggcgggatccaggcgtgagccgcggtgcccggccagttcagtgttctttagatgtctgttagatcaactggtagagcttgtgactatgcatatcttctgtgtccttactgattttttactaatgctacagtgtattgatagttatgttaaaatctccagcggtaattctagatctgtctacttgagcagtttttgcttaaagtattttgaagccgtcatgtgtacacatttaggattgttaagtcttccttataaattcagtctttcattttcataacattttaaccttatttctgttaaatgtcttgatgcctagtcaaattatttgaccacccttttgctcctgtcaagcctgggcctttgttagtttgtgcttatttattagggttttgctcgtagacttagacagtgactcttagtctaggaaaggttcatcctcatgggcctcagccacatgttctaggtatacttagtgagttctctccactctgctgtgtcccaaatttgtgtgatctctggcatctccagtcagccctcagaagtgccagccactctgcagaggccttgtggagcctgcctgctgcatgcactccccccagcccttggccacagacctgcagagaacttttgcgtactcttttgaggcctcacctgtatgtagttccctcttctccagtaccttattctataaactcccaacatgttagcactgtaagactctcagcttagtgacagtgacattgcctcatttctggaggtctctacctctctccgtgtggtcaagaaactgccattgggcagaaaacacaagtgtgtatgagatttgcctccagtgttttcctgttctcaaatatcacagtcctgttctgcctgtgttccaatctctgaaaacagttttctcaaatattctatccagtttcagttttctcgttggtcatggtgggagggcaagtccatcttggctggaagaggaagtccttctgcgtctttttctctttgtccttccacatggttttgcattgtggattttctaaacttgccgtataagtaagcatgtgcctatttgtgaagggaaagaaaaaaaaccttttaattttttaaagctgttctgttggttcctcacaaggatctgaagggattggtaaataggatgaaagaaattctgtctttcacatggagaaaaccaagtgtgacattaataaaaacgagcatgtctgtaggcaaagagtttcactgagctctgctagattcagaagcagttggacttacaacatcgtactttgcaaaacacatatattttatttacccaggaactaaagctaagtcagctgtggattaatagaaggtctgtgaagggtacttagactacagtaagattggggaagaaaattccatttccaaatctaagatatatcattcctttgtgccaagcacataatgatagtagagatttaagggggcccttagcacggaagcactgggttagtcagaaggtgaggtgagctgtcacacagccttgatgctagaatgagggtgccctggtactatcttatcagccatgacactggtgcattgggccatttttttgttttgttttttttgagacaggctcttgctttgttgctcaggctggagtgcagtgacatgatcgtggctcagtgcaccctcgacctcgtaggctcaagcaatcctctcacctccgactcccgagtagctgggaccacaggctcgtaccaccacacccagctaatttcttaatttttttgtagagatgggggtctccttttgttgcctaggctgattttgaactcctgggctaaagtgattctcctgcttccacctctcaaagtgctggattacaggcatgccagacatatgtaaacattctaaactatgtgacaatatgtgtaaagctttctcatgcattgtgagacaacacagcaggaatatttcaccatctgcctaaggtttaaaaggaaataactttaagcatgtgtctaaatagcaagtaatgttttagagcggattctcttaaattcagcttgggcatctgcaccatatacacagcttgagctgtcacctgacgtagagacaggcaacttcagtgcccgtgttcataggatccactgctttctcacagctaaaaccccagagtggcaccattaagtattatgttatgttactttagtcgataaacatataagcatacctccaaaggttgaatgtaggccacttgcagaaagtaggcagaatgctcacatttaattcttgatgatactgtgtttatatttcttattctttgaaattgcattgagaaaaaatactggcatctgctcaaagtaatttctttttcagttgacaatattaaagtaacgttattgtatcatttccctacttggacagagtgtgaaaattttaaggagcttgtctgccagaaatttcttcttcatttgcaaaacattaatgagttattatatttaaatgattttatttaatattaagtgtacttggtcaatgtggcatagaacatacaaaataaatctaatttaaaatcattaactattatatttataagaaagacttgctaatcataacactgttgataatgattctgaataaagcattatttcttttcctgaaaacaattgtagctataattcaatcatctaaattgcttattagttttatttctttttaattgtctttagctgaaattttaattttgattaattttctttttctccattggttttgtgtgtgtgtggaggtaaaatatacagaatatagaatttgccagtttttctatttttacgtgtatgcttcagtggcatttaaatacatgcaccattttaccttcccaccagcattgcacagggtttccgtttctccacatcctgcccaacatttgtttttctggctttcttggtttctgttttttgtttgtttgtttgttttgataatagctattctaatgggtgtgaagtggtattgcattatggttttgatttatatttccctagtgactagtgatgttgagcgtcttttcaagtgcttattggccatttgtatatcatctttggagcaatgtccgtgtatatcctttgcccagttttgaattgtggtatttgtctttttggagttctctatatagtctggatattaattccttataatgtatgtagtttacaaatattttctccattccctgggttgccttttactctgttgatggcggttcttgatgcacaaaagtttttaattctgatgaagtccagtttgtccacgttttcttttgttgcctgtgcctttgatgttctacataagaaatcattgccaaattcatgtcgtgaagcttttcccattttcttctaaaagttttctaactttagctcttacatttaggtctttggtctgttttaagttactttttgtatttggcattagataagggtccaacttcattttagctaaaattttatgtattttaaaatttattatggaaagcatgaaatgtttagttgaatagaaaattttgtgcagtggaattaactgaatctttaaaacctttttattatggaaatatccaaactattccatacatagaagaatataatgagtcccccatgtgcccaggccccagcattaattatcaatattttgccaatctcatttcatttacacacatgcccccacacacattttttcttagaaaattttaagtaaaatcacagatgttatgtcattttacccatgagtacataaacgtacatttcttaacgtggtatgtctttctgtcatcacctgttttgttctttatttttatatattatactatgtcattatcagaccttgtaaaattaacaagaattccttaatatgtcatatccagttaatgattgactcatttctactctagctaaagtacaatttaggaggaggtttgaggatattttttaacattaagatataaacttttataacaacggcttaaataattgttcctagagtctaatatttctattggcaaattggaaattagtatacatagacatagattctgctcattttactttcaatctaaaatcatagttaagattactggccaggcgcggtggctcacacctgtaatcccagcactttgggaggcagaggcgggtggatcacgaggtcgggagtttgagaccagcctggccaatgtggtgaaaccccgtgtctactaaaaatacaaaaaaaattattcaggcatggtgataggcgcctgtaaccccagctactcgggaagctgaggcagagaattgtttgaacccgggaggcagaggtcgcagtgagccgagatcgcatcactgcactccagcctgggcgacagagcgagtctccgtctcaaaaaaaaaaaaaaaaagattgctatgctagaaagtcttcctgtagaggcatttttaagaaacattatgataggcattggctctggaaagcaggcatgaaatagatgactggggtctatcatgagagagaccattctctatatgtcactttgtaccttcacatgttgcctcttgttttgttttggtctttttttgagacaggaccttgctctgtcactcaggctagagtgcagtggcatgatcatagctcactataacgttgaactctgggctcaagtgatcctctttccccagctccccgagtagctgagattacaggcatgcacccccatgcctggctgtatgttgctattttatgttttaaaaacctaatcctgactgtgctggtagtcgcatgaatctctgcacatacatgcaaacaagtacatgtaaaactggtgaaatctgaataagcttcatggattatatcaatttcagtttcctgattctgacagtgtatgatacttatgcaagatttaatcgagacaaagtgagtaaagaatatgtgagatctttgtattatttcttacaactgcaaaataagaagtttttaaaattaagttataataacaaaaaaaagaactctgtgtcaaaactaaaatataaagttgaaatattgattttattttttaggaatctggtggacagtaacaaactttggtgaaatttcaggaaccatagccattgaaatggataagggaacctatatacatgcactcgacaatggtctttttaccctgggagctccacacaaagaaggtttgtgtctggaagggaagaggctgccacaagtgtagattttaggacattcattcacttaggccaaactctaactagtctcaaacattttccaaaggaatggaaccattgcatttgactcttccatttttttttaattccttaatatttaccagccattggcaagtccctctttctaatataagcatttgaaaacattccgtatagttccagaagagtatctttggaaatcaaaataacatgaataattaaaatagtaagtggaaagaaaaaagaaaacctatttgagtcaaaatgtttgaatttcttttttattcagacctattgccaaaactaacctgggtgcgtttaacagtttgaagtttcctcattttctttagcccattagaggaagcactaatgagatatgaagtaattagaagataaaaagcagtatcatttggtcagcaaggccatcccttgaataagtgaaagcatttagctttttaaataagtgcttatttatgactgtattttaaaacataaagagaagctatctcaaaagttattaaataagcattatatcaccctgtcttactcagtgtataaaattaacactgtagttaaaagaaggtaaaatagatcttgattccaaagatacagtattacagtgacatcagtatatctgaatattcttacatttaattgcagaagaaaatagccacattttttaaaacaaaataatgtctttatatttatagcaaatgtcaaatttattttcaaatgttttttctccaatagttgatgagggccctagtcctccagagcagtttacggctgtcaaattatctgattccaggtgagcttatgttgtaatataattagtaaccagttattttaaaaatttaattgtattcattaaaaattttagtatctgtcttaagcccacagggtaattttgatgtaaaaaacaaaatagcttttttgaaaagtagattttgtgatctacttttaatggatttcctatcaatatataatgctaggctggaaaaaaaataagttaaaaagtgaagattaataatttcacataccgaataagatagattaaaaaatgaatcaaatagtacaaaacctggttcactgttgctgtgatatttaaactcactgtttggaagtccaaaggcaaacaggaagactaaaaaaaggaatattgttgaaaccagcagagaatgttacagaatcataacgaccaaaagaatatttttactcactatttttacagtcattttataaagtaaccttttttattctcaccttgtgcaaaagtatagaacgattctttgggcagaagatactgaaagtgaatttacatattttagtaattggttacatcaatatgataatgatttctgttatataatcattaatgtataaaggagtaaaagtcaattctggcatcccaggagattctcggtaaggtaaaagattagaaatcataattttaaaaaatcacattaagatgattatttctgtactttctttgaaagtctgataagtatggtgaaagacagaataaaagcagaggaagaaaaaattcaatagttttaaactgctttacaattataaacaaaaaaggattataaagaaaattaactgacaaatgaggaaaatatttgcaacaatcttaataggcagtgagttcttactcttcatatgtatcttgtatagaattcatagcactgatgaccccagtagaaaaactgcgaacaatcagatctcaatagaaaaatggacaagggacattaccagataatctaaaaactaaaaaggaaaggaaaagaaaaacaattgttattctagttaactactaaaatgcaaatttataggatactgttttttccatatcaggttttcaagtatttttttaaagtcataatgtttaaaaaaaaatgcgtgatacaaaacatactctgttaatttgaggtaagaatgtaaatggaagcagcattttctggaaaacagtttgatgacataagaactttatactcttcgatccagttatttctaggaattttttctaaggataaagcagttttatgtacagaatagatgtacatagaactatttataataagagaaaaagtaagttttagtaatttattcttgaactttataactaaagaggtataattgaagaatgatgaatttcaaaaatatttgttatgtaatatataaggtacaatgtttatattaaaaaagcacaatataaaactaaatttaaaactgcactgtccaacatggcagcaactagtcacatgtagcttttttcttttttttttttttaaaggcacagagtctcactctgtcacccaggctggagtgcagtggtgtgaccgtatctcactataacctcaaatttctgggctcaagcaatcctcctgcgtcagcctcccaagtagctggtatcacatgtgcatgccgccatgcccagctaactttttaaattttttgtagagatggggtctcactgtgttgtccaggctgatcttgaacttcttgcctcaagcaattctcccgttggcttcccaaagcacagagattacaggagtgagtcaccactcagccacatgcagcttttgaagacttggaatatgtgcagtctgaaattttagatatgtacacagccacacacatacgcatgtcctgttttgatgtcctataattaattttctctcagtctttaacttttatctatgttattaatgtacagaatcgccctgaagtctggctatggaaaatatcttggtataaattcagatggacttgttgttgggcgttcagatgcaattggaccaagagaacaatgggaaccagtctttcaaaatgtaagtgctgttattgtttataaaaacttcctgtcagtttaacagaaagtctgttaacagtcaatcataatatatttaaaaagaaaaagtaggatgcaatagtgtaatacattaaataggaataaatcaataagaacatagagccttaaagagatctcaaaatatagtgcaacaaaaatcgcattagtccttttgcccacaattatttctgtatacccttagtgcctagatatggatctcatttccattgaagaaccagtcaattttaggtctcagagtaggaaaacagagtagttcctaagtatctttgtagcagaaatcatggatgctttcagaaacattagagactgtaagcgaacagtggagcttgctaagaccaagttgtgacaatttgtgcataaaataaataataatagttcattgaagtaaattatctctaaaagactttcagttcataagcttaaaatagcatacgaaaagatagttttaatataagaagaaaaaagataatatactaattcttaattttagtaagtagacagttgtatatggatgttttgttaaatctttgttgacacagaatacataatttcctttttctgtttgtgtgagaagtaaagattgaacaaaaatatgtgagtgctaaacagtctttaaaaagtagataactttatcaaaaacagtaaggaccaatgggcaccacgcagagcaagcaaatagaagataagcttagcctttgagtagcagctttggtagtatacactaatgaattgaaaataggaactcagcagtgttttctaagatgacagattaaacaaacatccctccagaaagaggtaatcacttagactaatttcctcatcccctaggataaaatcttaactcagtgacttgaaaactattttggcccaacccattgagaaatgcatttttacattgcagcccagcacacatgtataactgaagcaagagttgtacttaacaatacttacttatccatgtgttatgcaccttgatatttcttattctcttttaccccttcctctgtgagtctgtgtgtattccttcccccgccccccataccgtacaggaaacaacactacattgatttcatgacccgctaatgtgttgcaacccctttgagatgatcctactagttaggatgagatacttctaataaaagttacaccggtagaaaaggccaatatatcataaggccttagatgatgacttagatagtactaataatacaacactttaggaaagttcgtttcattttatttttaggaaggacactaagtttcaaaaatttaaatttaaatgaaagagggtcttaaaactattgcaaaagggactcagctgaataatctgtggcacaggtttaaatcgtcttggaccacaccaccatgttccagggctcaccaggagccatccagatgagagaccacccagcccttgtgaccttgactaagaaattaaatccatgttatcagcacttttttaacttgatgtgatataaggttaacatattttgtaatcattgtatttataaatattttgtctaaatgttatggtattccaagttttccaaaagaatcaaccaaatacaagttataaataaacattatatttgttaagggagttaagctaaccaaatttataacccagatttagatacacaagaaaatcagtctttaaagttttaatagaaagcagtgtaatatatcaaacattaaacaactaaaaaagtatatgaatatttattttcacacacaaaagtccctcagacattgattcttaaattcaaaacaccaaagcattgtatgtaccttttcatgttttctaattgtgaagaaaataaattttacttaaaatgctaatatttgaataaagtatgcattcataattatgttcttgtctttaaagttaatttttcaaactgaactaaatcagttatgtcttcagtagatcttttagaaaggaagcaatcctacctcatctacttagaatttagtcctactaggaagatacactacaaatgtttattgtggtaatctttgaatagtaaaatgataggtgattttggtttcttttctatatgttcttgtattatatttttcaggtttttctctaagttcttttctgtgatttttaaatcagggaggaaaaattaattcagtctaaacacttaatgtttctcccacaagaagtatcctcatggctattttgttatttgtttcacttaggggaaaatggctttgttggcctcaaatagctgctttattagatgcaatgaagcaggggacatagaagcaaaaagtaaaacagcaggagaagaagaaatgatcaaggtaatgatgacattttatacagatgactgcattcacacatgcgatgtgactgtatctctttaaaatgttaaatggtcatttactgtcactttaaagatttacttaatagctttttataatgtggtgtttcaaatagactcatttttaattataaatcccatagttgatgtcttgtttatacaatgtggtagagaaatgagtgcatctaggagctaccttgccattatctccatggattagtatcttcttctggtagttccacatgctctttttaagctttcattttcttgttttcttgcttgtattttaaaatctaatttttaaaatagataacatgtacacgtggtccaacattttcaaataaaagcatgtgaagacgtatgcctgccatgcgtcttactcacctgtgtcccagcacctgttcgtctttccctttgtttttttatagcctcctaaaatttctttataaacatatgaatatgtttataattttcaactgttttacgctaaaggtagcctcctctatagtctagacttcaatttttttttttccttaaaattgtatcttggagagttttctactatgagtttgaatgtagaaagttttctctttttcttgcttttcctctctttctctctctctcaacagccacataatattccatttcagggatgtaccttaatttatttagtcttttatagatggaaatttaggctgtttccagtcttttgctcttataaacagtgctgcagtacataacattgaatatgcatcagtttgtagatgtgcgggtggacctgaaggtaaatttccagaagcagaattaccaggtcggggtatatgcgtttgtatttacgtaatgcttgagcttctgtgatgataatcactctatgaaacataaaaaatcatagcagaacttctggggccttagccctcagattttaaaaatatttttattaatagtacccgtcttctttgcattaggagaaacatgaatcacataaaacatgatttttattttatttttaaaatttgtgtgcgtcactaagctggaaataaaagttccttattccaggctaaattccctcatccgtagtcagacgcgttatccattgcaccagtggcctgtgccctctctaatcctactctttgttttacatcattgtaaaagttacacagacatcttcatatcaaggtgaaattctaaataatactgttaatataacctagataaatcaagtagttaattggaatctgatgaaaacatttaaggcttaattttttagactcacagaagccactgatctttaatgataaacatataccaggatgtgtctaaagaataactccccacttcttgacacatggcttttctgtgtcttggcattccatctcagtactgagcatcctgaaccttgctttgtttgtctctgttgggaatcacaggttgcatccagtctgacccagatttcctctgtaaggcattgtgggggccagagtggaaggctctaagagagggggcaagtgccttttctaaaatgcccttcgttcttataattagagcataaaaatttatgttacatttttctctactaccagtgcaatttaaaagcatctatcaaatctctgtacatacttcatgttagatttcctgtcataagtttgattttctttttagaatagtcttgatttcaaataatttcaaatctaaagctcaaacaatttcaatctaaaatgtaggtattttcttacagaagggaaatgttatattttttcattgcatgcacccagcacatgcgttgtagtcttgaatttccataatgcccctgtgaggtggatgtgagctcagcattacagacaagaagacagcctctgaccctccttacatcctcgtggtttttgtcagtcagttcatggaaatcacagtgatttcaaggtgtggtaagacaggatgtgtacccaggcccagctgactccagaggccactctcaatatttcatagcacattgcttctcaggaaacaggtcattggggaaatgcagatgggtttgtgacttacatttaattttatttatttatattttattgtatcatgtttaaattattttgcatctggatatcatcacaaaagtgttactgaaggcaacaattgcaaatatatgtgcagtgctttgcacttatacaaagatacaaagatacttacacaaagattgcctttttcactatttaaagcaattttcagacgaaatacaaagttttctgggtctctttggttagtcaagtacctggaagctctgaacagtgattatttaggactcttttcctttaccatttaattgcaggctctcctaatctctgtcagcccttcacctttatgaccttgccttatctaccagaacacagatccctcttactaaaggtagccttgtgttacctctgtcagcccttcagctttatgaccagaacacagatccctcttactaaaggtagccttgtgttacaggccctagcagggaatgttttcaggtctgggacccctctaatcagaactgtcacaaagatgtcatttgcacaaacacgttatttgtcatcactttctaagcagccctggaactggactctggccacagagatcccttaggagacatgagtccttaccattgctaattgcctgttctgtgggtgatcctaattgttgaatgcagattaattaacttatgacatgtggtagtaaacatctatccaaacttaggaggatataagaagctagtaaaagaggtgggttccaattagttaaaaacaagttgtgtaatgttaaaagttttaatactttggtaatagtctgtgcaacataaaatagctattaagctttcaatccgatcaaatgaacacttgtctactagggataatttgatcctagtgtattcacttggaggacaaaattaaattagttaatgatcgctttatttcctagcaggatctgatgtgtaaaatgtttctgaaataattttgtctgtagtgtttctgacacaatgctgtggaggaagcatgtgatagcacttactcatatagattatatatatgaagtaaaaacacatagccagaacctttttctgaatatagttgctcagttaattttttcttctgcataagaaatcatctcgaatgttcttatgtgatacgtaaagtggggaaggtggaagataaacatataacccattggattctcttttccaatatctagattagatcctgtgctgaaagagaaaccaagaaaaaagatgacattccagaagaagacaaaggaaatgtaaaacaatgtgaaatcaattatgtgtatgtattcttttccttttagacctacagatttgacagtgaagtgcttctcaaagtgctttcaaaataaattacctacttagctgggcatggtggtacatgcctataggcccagctactcgggaggctgagacaggaggattgtttgagcccaggagttcaaggctgcagtgagctctgatcaccactgccttccagcctgggtggcagagcaagaccgtgtctgaaaaaatgaaactgatggacaagaagagacgacacaatgtagcctctaggacagagcactgagctaaatgcttttcttttcttgaggcttcagttttcctaatcatcctaccacctcccaaagctagtcactcaggttagtcaatctctctattcattcatagaatgggtgtgatgccagtcaaaggctgtgctatggccaggacacaggggactctagccagcatgccctaatagaagtggggccttgtgctacccagtcaatgagtggccctcctcttgagaggtcatgaaggtcatctttgttgaaaagctccagcttatttaaaaaaatacaattagacctttttttttctcccccaagatggagtctcgctctctcccccagactagagtgccatggcgcgatctcggctcatcgcaacctccgcttcccaggttcatgtgattctcctgcctcagcctcccgagtagctgggactacaggcgcgtgccactatgctcggctaatttttgtatttttggtagagatggggtttcaccatgttggccaggctgttctcgaactcctgaccttgagcgatgtgcctgccttggcctcccaaagtgctgggattgcaggcatgagccactgcgcctggcctacaattagacttttttacaagtgaaaaagaaattaacagtatttataaatttaatagtaaatatgtataatcagagtttgaggtatttttcaatgaagacattttctttacagaaagaaatttcagagcttccaagaccacaaacttaaaataagtaaagaagacagtaaaattcttaaaaaggctcggaaagatggatttttgcatgagacgcttctggacaggtagctatttatttacttatttccactattttcagtagccaatagaaatggcatgtagaaaacctacattctcttaaattactgtagtttttcacatttttgtctttatttctaatttatgagtgtggcaatattacctaaagaggacatcgtaagtttgggaaaagactgtcatgaaagaatatctaaaaattataaccgattctaagtatatacttgaagaaattcaggtttgactgtatctacttcataaatttatcatctttttataactattagaaccagagttagaagcagtttgactaatataaaaattatgtggattctgttagagtagttcaggttccttaaaataagaatagatcaactaaaaaactaagtataaaagctaaacaagtgaaattgaagcagttttattataagatttggaagagtgcaggatgtttatcataccacattattaatatttattactcttcctaggtagataagtaatgtcctagatttatgacatagaaaaacagagacgtttagctgtgagtgtacaagtataaatcaattaagtgccagattttgataatcaccagccgctcattcaagtcgtatgttgcaaagttactcttacccttttttttacattacttgataaaggcaatgtttaattacgtatttcctgttaactagctggtagtgttcatacctaaagtcagtaaataatgttaagaattttttccagctgagcaaatgaatatgtatctcattgtaagaaatcaagaagaggatataaaatataatcaggatgtggactctaaaacggaataagctctatgtcctgtaacttttatcacttgtaataatacagcattctcaccctgttaaatggaaatttagagcagccttaaattccggaataattaaaattgctatttggattgaaaaagcccttaggcaacatttattgaatattaggaaataacttttataagattagaatccattttttatagaaaccaaatttaaaagtatacatattttaataaaagtgttgtggtaataaccaaaattgaacacacagttttaaagctttttatatttagtagcagttgaatatatatggcatgttttacatagattaattttatttttctttgtttaaacaggagagccaaattgaaagccgacagatactgcaagtgactgggatttttgtttctgccttatctttctgtgtttttttctgaataaaatattcagaggaaatgcttttacagagttcttgagttgtgaaattattgtttagctagtttaaccaggattaaacaagtttaatcaggattcttcatggatgtactttttagctaactacagtttttcacatggaaatgaaacttacagttcacacttaatgtaccacagaatttttttctggatttcctgtcctgaagcatgaagtgtactagaaaccaattcttcctgcgctacttgtggaatctgtcttactggatcataatcttactttactttatataatagatgcttaatcagtgcctttaatagaagttagaaactcccaatccaatcaacaaggctttggttctaccttctaagtactacccagatcacagacaatccaaatatcagaactagggggctgggcagagaggacaaatcatctattagggagtgggacagaaagcagaaacattacaaaggagcaagtaggctcagaacagaggggagagtagtactggggaaactccctgctgaggacaggttagccacagtggatatgtatgtgatgcctttgtccttgtgggctggaatggaagctggtaagggaataggaacagctccagtctacagctcccagcgtgagcgatgcagaagacgtgtgatttcttcatttccaactgaggtaccaggttcatctcactggggagtgtcaggcagtgggtgcaggacagtgggtacagtgcaccgagcatgagccaaagcagggcgaggcatcaccttacccaggaagaacaaggggtcagggaattccctttcctagtcaaagaaaggggtgacagacggcacctggaaaattgggccactcccaccctaatactgcgcttttccaacactcttagcaaacggcacaccaggagattatatcctgcgcccggcttggagggtcctgcgcccaaggagcctcgctcattgctagcacagcagtctgagatcaaactgcaaggcggcagcgaggctgggagaggggcacctgccattgccgaggcttgagtaggtaaagtggctgggaagctcaaactgggtggagcccactgcagcgcaaggaggcctgcctgcctctgtagactccacctctaggggcagggcatagccaaacaaaaggcagcagaaaactctgcagacttaaatgtccctgtctgacagctttgaatagagtagtggttctcccagcaagcagctggagatctgagaacagacagactgcctcctcaagtgggtccctgacccccgagtagcctaactgggaggcatcccccagtaggggaagactgacacctcacatggccgggtactcctctgagacaaaactttcagaggaacaatcaggcagcaacatttgctgttcaccaatatctgttgttctgcagcctccactgctgatacctgggcaaacggtctggagtggacctccagtaaactccaacagacctgcagctgagggtcctgactgttagaaggaaaactaacagaaaggacattcacaccaaaactccatctgtacatcaccatcatcaaagaccaaaggtagataaaaccacaaagatggggaaaaaacagagcagaaaaactggaaactaaaaatcagagcacctctcctcctccaaaggaacacagctcctcaccagcaacggaacaaagctggacggagaatcattgacgagttgagagaaggcagcttcagacaaactactccgagctacaggaggaaattcaaaccaatggcaaagaagttaaaagctttgaaaaaaaattagacaaatggataactagaataaccaatgcagagaagtccttaaaggacctgatggagctgaaaaccacggcatgagaactacgtgatgaatgcacaagcctcagtagccgatttgatcaactggaagaaagggtatcagtgatggaagatcaaatgaatgaaatgaagcgagaagtttagagaaaaaagaataaaaagaaacgaacaaagcctccaagaaatacgggactatgtgaaaagaccaaatctatgtctgattggtgtaccttaaagtgatggggagaatgaaaccaagttggaaaacactctgcaggatattatccaggagaacttccccaatctagcaaggcaggccaatatttaaattcaggaaatacagagaatgccacaaagatactccttgagaagagcaactccaagacacataattatcagattcaccaaagttgaaggaaaaaatgttaagggcagccagagagaaaggttgggttacccacaaagggaagcccatcagacgaacagctgatctctccgcagaaactctacaagccagaagagagtgggggccaatattcaacattcttaaaagaattttcaacccagaatttcatatctagccaaactaagcttcataagtgaaagagaaataaaatctacagacaagcaaatgctgagagattttgtcaccagcaggcctgccctaacagagctcctgaaggaagcactaaacatggaaaggaacaacctgtacaagccactgcaaaaacatgccaaattgtaaagaacatcgaggctaggaagaaactgcatcaactaatgagcaaaataaccagctaatatcataatgacaggatcaaattcacacataacaatattaaccttaaatgtaaatgggctaaatgctccaattaaaagagagagactggcaaattggatagagtcaagacccatcagtgtgctgtactcaggaaacccatctcacatgcagagacacacataggctcaaaataaagggatggaggaagatctaccaagcaaatggaaaaaaaaaggcaggggttgcaatcctagtatctgataaaacagactttaaaccaacaaagatcaaaagagacaaggccattacataatggtaaagggatcaattcaacaagaagaactaactatcctaaatatatatgcacccaatacaggagcacccagattcataaagcaagtccttagagacctacaaagagacttagactcccacacaataataatgggagactttaacaccccactgtcaacattagacagatcaacaagacagaaagttcacaaggatatccaggaattgaacccagctctgcaccaagcagatctagtagacatctacagatctctccaccccaaatcaacagaatatacattcttttcagcaccacaccacacctcttccaaaattgaccacatagttggaagtaaagcactccttagcaaatgtaaaagaacggaaattataacaaactgtctctcagaccacagtacaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgagacacattcaaagcagtgtgtagagggaaatttatagcactaaatgcccacaagagaaagcaggaaagatctaaaattgacaccctaacatcacaattaaaagaactagagaagagcaaacacatacaaaagctagcagaaggcaagaaataactaagatcagagcagaactgaaggaaatagacacaaaaaacccttcaaaaactcaatgaatccaggagctggttttttgaaaagatcaacaaaattgatagactgctagcaagactaatgaagaaaagagagaagaatcaaataggtgcaataaaaaatgataaaggggatatcaccactgatcccacagaaatacaaactaccatcagagaatactataaacacctctacgcaaatcaactagacaatctagaagaaatggataaattcctggacacatacaccctcccaagactaaaccaggaagaacttgaatctctgaatagaccaataacaggctctgtaattgaggcaataattaacagcttaccaaccgaagaaaggccaggaccagatggattcacagcctaattctaccagaggtacaaggaggagctcataccattccttctgaaactattccaatcaatagaaaaagagggaatcctccctaactcattttatgaggccagcatcatcctgataccaaagcctggcagagacacaacaaaaaaagagaattttagaccaatatccctgataaacatcgatgcaaaaatcctcaataaaatactggcaaaccgaatccagcagcacatcaaaaagcttatccaccatgatcaagtgggcttcatccctgggatgcaaggctggctcaacatatgcaaatcaataaatgtaatccagcatataaacagaaccaatgacaaaaaccacatgattatctcaatagatgcagaaaaggcctttgacaaaattcaacaaaccttcatgctaaaaactctcaaaaaattaggtattgatgggacatatctcaaaatagtaagagctatctatgacaaacccacagccaatagcatactgaatgggcaaaaactggaagcattccctttgaaaaccagcacaagacagggatgccctctctcaccactcctattcaacatagtgttggaagttctggccagggcaatcaggcaggagaaggaaataaagggtattcaattatgaaaagaggaagtcaaattgtccctgtttgcagatgacatgattgtgtatctagaaaaccccatcatctcagcccaaaatctgcttaagctgataagcaacttcagcaaagtctcaggatacaaaatcaatgtgcaaaaatcacaagcattcttatacaccaataatagactaacagagagccaaatcatgagtgaactcccattcacaactgcttcaaagagaataaaatacctaggactccaacttacaagggacatgaaggacctctttaaggagaaatacaaaccactgctcaatgaaataaaagaggatacaaacaaatggaagaacattccatgctcattggtaggaagaatcaataccgtgaaaatggccatactgcccaaggtaatttatagattcaatgccatccccatcaagctaccaatgactttctgcacagaaatagaaaaaaatactttaaagttcatatggaatcaaaaaagagcctgcattgccaagtcaatcctaagccaaaagaacaaagctggaggcatcatgctacctgacttcgaactatactacaaggctacagtaaccaaaacagcatggtactggtaccaaaacagagatatagaacaatggaacagaatagagccctcagaaataatgccacatgtctacaaccatctgatctttgacaaacctgacaaaaacaagcaatggggaaaggattccttatttaacaaatggtgctgggaaaactggccagacatatgtagaaagctgaaactggatcccttccttacaccttatacaaaaattaattcaagatggattaaagacttaaatgttagacctaaaaccataaaaaccctagaagaaaacctaggcaataccattcaggacataggcataggcaaggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatcccgaatctacaatgaactcaaatttacaagaaaaaaaacaaacaatcccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtccgtgtggtggttcctcagggatctagaactagaaataccatttgacccagccatcccattactgggtatatacccaaaggattataaaacatgctgctataaagacacatgcacacatatgtttattgtggcactattcacaatagcaaagacttggaaccaacccaaatgtctaacaatgattgactggattgagaaaatgtggcacatatacaccatggaatactatgcagccacgaaaaatgatgagttcatgtcctttgtagggacatggatgaagctggaaaccatcattctcagccaactattgcaaggacaaaaaaccaaacacagcatgttctcactcattggtgggaattgaacaatgagaacacttggacacaggaaggggaacatcacacaccagggcctgctgtggggtcaggggaggggggagagatagcgatatgagatataactaatgttaaatgaagagttaatgtgtgcagcacaccaacatggcacatgtatacgtatgtaacaaacctgcccgttgtgcacatgtaccctaaaacttaaagtacaataaagaaaaaaaaaattccatagtggcgatatagaacagtttgtttaaccattcagtcattggaggatatctgggttgtttctagttctaggctattacaaataaaggtgctctgaacatttctgttaaaaaaaaaaaaaagttaagacgctacgtgttgcttaggtctgctttgttgaagcctgtctctttcagagttcctaaacacaatattcccatggcatctaatcctagtgagtgctccaaatccaggctgtgtatcagatgccacgggaaattctgcctcaggactgagtttggttcaagcatctggatgttgtcaaaagtccacgttgtgtgctggcctaatctgaaagaccctaactagttctagcctttaaatgccttctgtcatcaaatctagagttacatggcatttgtacaagctaggtagctgaggcacggaatcagccctataaaggagcttttggtgcttttgttgtaggtctagctccaacttggcactccagttcccatagctagactttctctcatcgtgtgttctgatccttggattaggaacaaagtaactactctgatacaaagcagtggtttcggttcccaactagtgactattttgcctcccaggggacatttttggttttcacaactgggatacggtgttagagggtagaggctagggatgctgcgaagcatgtggcagaatcctcttccgccccgaatgctaatagtgccaacgttgtggaggcttcccacccaagggcttggtctattccttgcttttgccagctccctaaaccttaaacacatttcaaatttatatgcataagcatctcctagggacctgcccgtttccaatatcgactactgagacccatccgtagagatgcaggcttaggaggtctaggattgggctgaaaatttgcattttaacaagtactccaggtcattctgaagcaagtgatacaaaccacacactgaggaacacgccttcaagagactgaatcttgcttcccaacactagcttgctatctgagaccatctgcctgctgctggctttcctggcacaaacattctgcatgtaggcacagtgtgctcctggactccatgtcacctcgttcaccctcatgttccctcggttcctgtccccagtccagcaagcagaactgattacagatcttaacagaagatacagattgaaaataacttgcctgttcccgtggactttatccactagtcaaggaggacaagtggacaaggggagagggtaggtgggggctccttccctgttcctcccattccactttatacaaaccccagctagaccactgggagagcaacagaggttaagaatgactgcatctaaatatttaatttggcccactcttcttctgtcttgaacacaagggtatcatgagttttgtttaaagcactactgaaaccaagataaattctggcttagcatgcccctgacagatcaatctagtaatcttatcaaaaagattgagaaatcggatggttgctgtgtctgggtagaaagaagtagacatgggagacttttcattttgttctgcactaagaaaaattcttctgccttgggatcctgttgatctgtgaccttacccccaaccccttgctctctgaaacatgtgctgtgtccactcagggttgaatggattaagggcggtgcaagatgtgctttgttaaacagatgcttgaaggcagcatgctcgttaagagtcatcaccactccctactctcaagtacccagggacgcaaacactgcggaaggccgcagggtcctctgcctaggaaaaccagagacctttgttcacttgtttatctgctgaccttccctccactattgtcctgtgacccggccaaatccccctctgcgagaaacacccaagaatgatcaataaaaaaaaaaaaaaaaccaagattacctaaaagcactaaccaaaggaaaactccctcacctcaacccgtgactgctcacatttttcagattgaataatttcaattgtattttaaggttgactctttaccacctccaagctgctcctgaacacaactattattttttaattttgaaaaatttttcacttctagaatttccacttgaggctttgttattactgtagtttcttcttctctgctgtgattttctatccatttattataagagtttttggggttttgattttagtaagaattataataactactttaaaaaatccatactaattccaacatctcggtcgtctcgaggtcagtctcgattgattgcctttttctttgaatatgtttcttggtatgtttgatataatgggattgaatcctgaagattgtaaaaactggatattttttgttcctctgaaaattgataattttttgtatttttttttctattgtatactttacattttcctccaagggttttaacatttctagttctcaaaacatttacatttatgttaaaaattatacaaagtagcttggtacagtggctcccatctgtaatcccagcactttgagaggccaaggcaggagggtcactcgagtccaggacttggaaaccagcctagacaacaggacaagaccttgtctccacaaaaaattattagggtgatacaaaaagtaattgcaggttttgccattactttcaatggcaaaacccacaattcctcttgcaccaacctgataaaaaataagctgggtatggtggtggtatgtgccggtggtctcagctatttgggaagtgaaggcagaggtgggaggattgcttgagcccaggagttccagaccaccctgagaccctgtctctacggggaaaaaaaaaaaaaaaaaaaaaaattagctgggcccacgtacctgtggtactagctacttgggaggcaaaggcagaggtgccagaatcacttgagcccagaagctcaaggctgcagggcactgtgattgtgccactgcactccagcctaagtgatggagcatgaccctgactccagataataataataattacaaaaaggaaagacctagaacaccaggttaaagtattctaaaatttagctgacttactctgctctctataaaacagggttgccacagaaaatatagcatgcccagttaattttaaatttcagataaacaaatacttttttcagtgtaagtataccccatgcaatatttgggatatgcttatactaaaacttattctttgtttatctgaaattgaaatttaactgggtattacataattatagcagcctgaccataaaagatatgtaggctgagcaaaattctactttaaacttcaagctttataataaatgcattattaatcaacaactattatttactgagacctgtgtagatccccatatttatttttaaatgtggaactaggaaatctatataaagaacatttatagaaatgaatgactgttctatagagctgaaaggaaaactctagcttttatttttctccccaaacttaagctttattttacatttgtataaacaataaaattaccactcaactttggaagcacagatcataatatgaaaataaagcaaagatcccagaaacatttaacaggcaacaaatctttgacatcatcttactatagcaactaaacgtataataatttagaacgatccattaattataagaataaattcttttacaaagcataactattaatattatttgaccatcataagaacaaacattttaactaaaacaccatgaatactttacagaaaggggcgagttgcagacacagtccttcttggatttcttttaacaccaggctttcttcccttttgacctgagctgggagttgaatatttcctctctttgccctctgaccctctagtctctgaagcatcttttgtactagaggtgtgtgcagagacttcctggaaatttggatctgtaaattgtgctgttgtatcttctaagcactgcagtgatctggatatagagctgttgctcttgcttgtataagtgtaatattctgattcaaaaaaggaagtgaaaggaagggagttgattacatttggctacagaaaaaaaaagatgacactaataataaaaataaataataattgtacttgtaatataaacatctgaaagttttagttctaagaatggcagtccacataagaaaattaggtaaaaataattaatatctattataattatttttctttaaccaaagaaaaagtataatttaaagatggctgtttaagcatcaaattgcagccattggtaaaagtagatattagtcatatttattaagtgacacacagtgatactgaaggcacttgtttctcagcaacatcattttttccccaataagaacgtactgcatcctagacgtgaaatgaaaataagctttaattttcaccacaggagggcgacaaccagagaactgagggggtacagatccattagaggaccatatccatgagcttaaaatgctctactgtaagagcaagaatttttaaagaatctcggtgaaggctccttttcaaaaaagcacaaagattaaagcctttgaaatgtaaattattttttgcagttattacattgaggacaaagttatagtcgcaaagttaagatttttataactatccctaaaattgatcctcagtgactccttgatctacatatgttaaggaaaaaggcaagacacagatatgtttaaatagtttccaattttcagtaatcagcttcaatataaggtatacccaaataatggtgaattaaatgaccatgaaagcacgttatagcagatgcccgctcatcaatatgccttgaaattaaaggtttataaggtgcataagggcaaaggttttgatgttgccattacattcgcaaaagtatgtgaggcacgtacagcatgaagttcactaagtgcttgcaacataaccagcactaaattttgttgaataaataaatgaatacttttgtatagcatctgttcaaaatctgatgtaaaaatgaaaataatctgaaaatatgcaaaactgaaatttcccacagacggctgccaattcatacaaaccataagatgaatttcaaaatgagaacgtgacaataaaatcaagtttcaaaatggctggccttttttttttttagcaaaacccatgttcaaaaaaaggaataagacatcaaatgttttgagaaccaaaattttactgctgcttttctaacaccctgttgctaacctgagcccccatcctcttactgtcaataacagattttcatcatcaaacacaagaaacacgctgggcacagtggctcacacctgtaatcccagcactttgggagactgaggcgggtggatcacttgaggtcaggagtttgagaccagcctggccgacagggtgaaacctcatctctactgaaaatacaaaaattagctgggtgtggtggtgggcgcctgtaatcccagctactcgggaggctgaggcaggagaatcgcttgaacctgggaggtggaggttgcagtgaactgagatcgagccactgtactccagcctgggtgacagagcaagactctgccttaaaaaaaaaagataaaaatacaataaacatctcataaaaacaaaataatcactattctaacaaaccacagtccacaaataagaagtttcaaaaagtaagtttaaaagaaaaaaatttttaccaaccactcacttttaagctgataaaactgcatggcttccttaagaaacaagaatcccttcgatgctgagcaggtcagtttggaaaccaccccacctcatttttcagtacttttttccaaatacttgagttgatcctgaggttctctatttctctcacatttgatccttgcatgacttactgaagttgaaaagttatttaagaagacacagtggtgttcttcactcatgtaatttgttcatgtatcaaataaaggatggagagaaaactggatgaaataccagaagttaagagatacatcaaaaacagtaccatgagggaaaaatttatagctataaatgattataaaacataagatactgaatcaacaactttactcctaaggaactaaaaacagagggaaaaagagggacaactaaaagctagcaaaattttaaaaatgataaagatagcagtggaaataagtgaaatagagaacagaaaagcaatatcaaaaatcaacaaaaccaagtttattctctggaaaagatcaaaactgacaaaaattttatctagattgactaagaaaaaaagggaatactcaaattacgaaactcagaagaaaaatgggtacattactaacaaatttttggagtaaaaaaaggatgtaggagagtaccataaggaactatacactaaaaaattgaataacctaaataaaatgaacaaattcctagaaacaaaaaacctactaagactgaatcagaaaagttgaataaacctattcagcaaggagattcagcaggaagatggcataagtaatcaaaaacccagcaacaaagaaaagcctggaccagatggcttcactgttgaattctacccaacgtttaaagcagaattaacaccagtttttctcaaactttttcaaaacgttgaagaggaggtaatgttttctaacttattctatgaggccagtattaccttgacaccaagccagacaaaggcaccataagaaaactacaaacaaacatcccttacaaatgctgatgcaaaaatcctcaacaaaataccagcaactcaaacttagcagtacactaaaaggattatacactatgaatgagtataattgactcctgaaataaaagtatattccaacacatgaaaatcagcgtaatatcacattaacataaagaaggaaaaaagcctcatgtgatcacattttaatcaaagaagaaaaagcatttgtcaaaatttaacccacattcatgataaaatgtacttaataaactataaaaagaaagaaaacactttaacataatgtcatacaaaaaacaaaaacacagctaatgtggtgaaagactgaaagcttttaccctaagagcaaaaacaaggatgcctgcttttactacttctgtttaatatagtactgaggattctagttagttaaaacatgagtaaaagaataaaagatattccaatttttttaaaagtaaaattatctgtttgcagatgacataaccttatatattaaaaatcttttggtttctgtgaaataaactgtcagatacaataaacaaaattcagcaaagctgcaggatacaaaatcaatacacaaaaatcagttgtatttctacaataacaataaactatctgaagaagaaatcaagacaacagtatcatgtatgatagcatcaaaagaataaaatacttagaaacccacttaaccaagaaaatgaaaaacctgtacagcaaaaactataaacatggcatgaacgtattaaagatgacaaataaatgaaaagacatcatgtgtttatggactggaagacaaaaccttgtcaagatgccattgttatctatagtcatctacagattcaataaaatcactataaaaattccaatatttgcaaaaatagaaaaacctattctaaaattcagatgaaatctcaaaaaatcccaagtagccaaatcaatcttaaaaactaacaaagttagaggactaacacctcctggtttcaaacttactgcaatgcttcagtacccaaaacttgtaccagcatagagacagagacaaagaccaatgcgatagaaataaagaaccaaaaaatatggtcatgatttttaacacaggagtcaacactattcaatgggaaacgatggtattttttgaatggtgtttaaaatggatatttacatatacccatatgtatgtatatatcccaaattagctttttgtctgtcatgtatgtggcagatctatttccccagtctgttgacttttgacttagaggcatttttctctcacacaaagtttcaatttttatggagtcaaatacatcagtcttctattcagtgacttcttcatgggaatggtgtttgattttaggatgataaagaagttgtagatatggataaattagataaactagatggttggacaacactgaatatactggatgccacagaactgtacatttaaacatggttaaaatggtaagttttatgttgtgtatattttaccaccaaaaaagggccaggcttagatgtttacatgttaggggtttggagtacctctaacatttattcccctccaggggaataatttataaacacccacacaagaaaagtagatactgacttcacaaatctccttacaagtcccacagcaagggctgtctgggaaagcagagatggaaaaagtcacataaacttgaggtcagtgtgagacctcccatcccctactctggaatcagatggaggaaggcaggtatgcaggctgagctggagagatgagctggggtgggcagaactgtcctcccatgagcccagaccttaactgctcccacatgctcccaggcatgtatcaaaccaagaaagcggctaggagggtaacacagctacctgtatacagggagccatgaaatatctgagctgcgcaagtgatgcacaaggagatggaagcagtctgacctttacacagtgacctggctcaaataatttcaggctctcaatcaggcgagctccactttctctctgaggtaggtaaacttgaggggtttaagtgggagttgaggataatggaaaagaaagcctggtagtatttcttctaattctgttataaataaaaagtaaaacaaatgccttttctcagggcccaaatgttaggtgaaaaaatgtcatctcagtcatgtgatgtggacttcagcagagcagtaccctcatggtcatttatcctttccctctgcatgttgtgtgctttttcagtttacaatgtacctgatccacttgtctcatcacactagctgcaaacaaggccactgcatgtcacaccaggtggccagcatgtctgtgaagggcagaaacgggggcagccaaacagctggcagaggccagctagtaagtacctgatgcccactccatagaggactccacacttaaaagacaagataagcaagtgtcaggctgcctcactagttatccccccaaataaaaaaataaaagtaacccctccagggaacatgtttgtgtgtacacaaagtacatgcacacagctacatgcaaacgggaaaggctgggaaggaaccaaatccacctctgaacaccagttacttgtggggaaggggcacgtgaagccaactgtcagcattactcaccttttcaactgatgagcttgcatcaattttggcaatttctcataaaaagacaattttcactccttgggtgatcacccaggtcctgcaaaactgagccaccaacaaccacctgcaccacttcccatgaggccaaataatggcttccctcaaagctcagccctcccacccacctcccagtcctgtaccgtgcaggggggctgccggcctcctggggtgcaggggggctgccggcctcctggggtgcaggggtccaggccaaacccaacctacagatggttggtgaaaccagcacgtatccaagggccttttccccacctgtgccatgtgccgactgcatagataggcctgtgcttgctccccctaggacagagattcccttttcttccattggaatgaggggtggggagatttgatggtattctgtacaggttggatgttaatctgatgtggtgctcttggaaaagcttgcctgagttcggcgctttctcagcacatggtgtgtgctgccccttcaagctgcagaaaccccagaaggtaagtgctaactgcaacccccatttactggtgagcagaggtcaggtgatctgcagccagccaagcagctgctaagtggccaacaggctggatctgcatctcacttgcagaggccctgcctggctgctgggactgccctgagactccctcctcctcctcctcttccctccacagctctcccagcttctatccacagctgtgctccaggtggggaacacctatggctgcaccagggtgcaactactcagactccagcgtgcagaaaggccccggctccatgctgtttccatatcccagcccaagctcgtctagagcttcagcaaatccaagcttccctgaattccctgcaagactaaaccaagccctacaacccccactacactggttagctgccagtccgagcccctgctgcctcctgggcccctgtctgtacagttctggagtcctacaagaatgctgagatcgtaagccgactctcacccaaagaggtaaacaaccagggacctccaggggtggagaacatacccagacaggttctgctgcctgtaggcttcatgtccttcccctacaacacgccatgcttgccaggctggaagaggggctccagaaacttgggaaacctgggcctgtagctggcatgtggaaaagaggcctggaaaagcaccactcctgtccatgaagcccccacatggaaccaggtaattgggaaatacatgggcaccaagcctgacgccctcctcagacccaggtgggaactgcagcagtgacttgccccctctgcctctggctgtaccactatgagagggaggaacatccaggtccacacgtgagtggagacaccaggtgtgggcaggttccagtgattgctgcagctgaaccttcccaagcaggtccatgcaagaccatctcagatgggtgtgcacctggattgggcaaggacacccctcagagagtgagggccactgaggggggctgtcacagagtccccttttcctgctcctagaacaggctgggggagtgtgggggagtgtgggggagtgtgggggagtgtgggggaggttgggggaggttggggaagtgtgggggagtgtgggggaggttgggggaggttgggggaggttggggaagtgtgggggagtgtgggggaggttgggggagtgtgggggagtgtgggggagtgtggggaagtgtgggggaggagtgtgggggagtgtgggggagtgtgggggagtgtgggggagtgtgggggaggttgggggaggttgggggaggttggggaagtgtgggggaggttgggggagtgtgggggaggttgggggagtgtggggaacctctcccacctcccagctgcttccaggagccacttctttcgagatgagacactctgctgcctgtctgttcccatttggctgcaatagaccattgacaacattcagagaacaagaaggggcctcacctgttttccctgacacgtcggaggcagatggacattcccaggggacctggggtagaacctgttcatctgcccacccccaggctgtgctggcttcatcttatctgtgtgatggtggcggtgggaattaccaaggggtcatcacacagaccatggacaagttctacaagagccagggagaagagccctgtccgtgcttgctgcccagcacccagctcacacacacacctcttatttgacagcttccccaaagcgggctttgcagtccaggctccccgagaagcttggggaggagactctgccagtctgaagggcctatccctaaaaaggtgccaccctcaccaggctcatcctggcaatcttggattatctttgctctgaggttttggagtgggggacagggagacagcagacactgcacatcacccatctttccagagagcatcagccctccagactggggcaggtcagacctccacttgggcgtttttctcactggttgccagttgggggaagcagcatttgtgagcacctgcctgtcttcccaggtcctgttcagaaaccccatctgtgcctttggagagactgccctgagcacacaggcccagcaaccaccatatacgacccccaggacctaatccccctctacatagggttcagtgcatgttagcagacactgggctcgattcctgcctagtccctgccagataccccatgcccacctcgtgaagagaatgaggccacacaaacacacccagaccgtcttggtgatggagtgcctggggtcccacttgcccacccttcattgctggttcagagccagctgtctgaccacattcctaccccgagatgggactttggggacattgtccaccagggtcgctgagcccttttaaagttccagacacatggccaactggtcccctaaaagtttggtacatgggataagccaaggcttttcttcaggaacaggctttccaccacgtcgctgcccaaggcccagggcatccccaagttcatgtggcgcctgcctgccatgtccacagcccatgccgagccctcctagagccactggaatgcttgttcctgggcatgtgatgaacccagacagcttccgccttgcaggacaactgtgcacatctggcagcagtagccagagggcccatagaagttggaggtgaaaccagatgctgtgagaatactttattaggcaaaaccgcatactataaaaatgctttaaaatgcagcaggagatgtgaagacacaaatgaacgagcgcatagtgacacatggctgtcagaacacagtgaaggatccacactgcttcccccctttacctagaaaaggagagttctaggccacctcctcctcctcatactcctcctccctcggccgtggcatcctgatattgctgatattcagacaccaagtcgttcatgttgctctcggcctcagtgaattccatctcatccatgccctcgcccgtgtaccagtggaggaaggccttgcgcctgaacgttgctgtaaactgctctgagacccgcttgagttcctggacggctgtgttgttcccagtgaaggtgactgacatttttagcccccagggtgggatgtcacagacggctgtttttacgttgttggggaaccagtcagcaaagtagctgctgttcttatcttgaatgttgaacatctgttcatccacctccctcatgggcatgcgaccctggaaaatggcagccgccgttaggtagcggccgtgacgggggtcacgggcagccatcatgttcttagcatcaaacatctgctgggtgagctcagccacagtcaaggcccggtactgctggctgccccggctggtcagtggggcaaagccgggcatgaagaaatgcagccggggaaacgggaccatgttcatggccagcttccgcaggtcagcattcagctggtcggggaagcacaggcacgtggtgaccccactcatggtagcagacaccaggtggttcaggtcaccataggtgggtgtgggcagttttagggtcctggaacatatgtcatatagcgcttcgttatctatgcagaaggtctcatctgcgttttctatgagctggtggactgagagggtggcgttgtagggctccaccacggtgtctgacaccttgggcaagagcaggatgctcaatgtgtttataatcctgtctgggtactcctcccagatcttactaatgagaagggtacccatcccagacccagtccccccacccagggagtgggtcagctggaaaccctgcaggcagtcacagctctcagcctcctttctgacaacgtccatcactgactccgtcagctccgcgccttcggtgtagcgtcccttggcccagttgtttccggccccacactgacctgtaagacagcacagccggtcactcgacggccaggtatacggtcatcagtggtcaccaccataatgcagaaagggccaagtgtcacgtgtgaggtgagagcaccattcgccctgcaggtggagcagatgaaaccccctcccccggagttacaggacagcagcttcccctctcttaggaattaagtcaggagtcaaacctgagaggggctaacctcactgcaggtggaacaaatgaaaacccctcccccggagttacaggacagcagcttcccccgttaggaattaagacaggagtcaaacctgagacgggctcacagaactcgctgcaggtggaacaaatgaaaccccctccccaggagttacaggacagcagcttcccctgttaggaattaagtcaggagtcgaacctgagacgggttcacagacctcgctgcaggtggcccattctcagggaaggcagtagccacggccccagctcaggtccttgcagggagtttacatcagtagctcctcaccttgaggagacacgcgggccttcctcccgaagcccgtttaggaggcagatggagcgactcgactcggaggacaggagggtgttcaggggccctggcgccacagttcccacaggatgaccttggagcgttcctggatttcgagctgccctggctaaggagccgcaccccagtcctcgcccgcagctcacgggaaatgaagttgtctggcctgaagacctgcccgaagggccccgagcgcacagagtccatggtgcccggctccagatccacgagcacagcgcgggacacgtacctgccacctgcgtggggcgggagggcatgagcgaggggagggccgcgttcccaggagggcggtgggggaaggacgggggtcgcaccgctggcctcgtggtggtgcacgttgatgcgctccagctgcaggtggctgtccccgtggtaggtgccagcggagtcgatggcatgttcatcagagatcacctcccagaactgcggagacgggaggggccagacaggccggggctgagtcacggaggcgccccagccgctctcccacccccatccgcacccccatccccaggccgccctgtccctggggtccacccccgccgcctcgccagccacccggttccaccgtccccggcagggagcccaggggccgcaatgcaggggcaccgcccccgccgctgccaacatcttccccggccacccggcaggcccgggctgggccctcagagccccggctgccaaccttggcgccgatctggttcccgcactgcccggtctgcgtgagcacaagctccctcgtggccaaggcaggattagggcggcaggagaagcgcgagaaggaggagcagacgcacagcgacccagcccggcctccgccaacgcttaaacagccccgcgcccacctccctcagcctaggattgggctcccagaataagcaacagctttacttccacacaggtgcacccacctgtgactcccctggcgttgaacgtctgttggagaactcaggtgtccttgcgtggtcccttccacgttggggaaagctgctcagctggagaacttcctcccacgtctttagtaagactaaatccctagctgagctgaaactgaattttcctcccatgtgggaggggaagacgcttgtttccatatgcacggagtgcctttgcacctgtcctagattgatgacatatttttgtaattgatgaatcttttcatctattaggagatctgtcgttaggaaaggccttccacatgttaacaggacttaattatacgttttactttggagcagttcaaatctgcagtaagctatgggtgttagagatagtcaggcctctgatttagctagagtcttctttaggattagccctttcacctttccagaggactgcggtctccacacagagtgaaggtaatattggattcttaaagctgaggataggtgttgggttacgcctgctgtgaaagatgggccattgtcactttgcaggcttttagattacccaaactgaggagttatttcttctggtaaacatttttcagatggggtggggaatgcctcgatctaaccagtgaaggtatcagtaagcattagcaaatatttgaatctcttgcagaaagtcattggggtacattagagttgccagttctcacctggataggttccttaattttggacaggtttaactggaggagaaaattgctggccgtttgggtcatgtcaggcacagagctcacagtgctgagtcacctgttttagtgtcttgaaaagatttacccctataaacaagtgagacattaacagaaacaaagaatcccttctagggtgaaaagaatcatgaaagtgctgagttatactcttgtgattggtacttggcattagtaatttattaccatcattcagccagcccgaggggccctggactgaaatgcaatccctggcccatttctgttcttcttcagagtgttccggcccagttctatgtatgctgaccagcacgcccataagcttcattggccctttcagtgcaggggccttggctgcagctacaaggtcatttccttttacatggtcagtctctcttttgatgtcctctgcaattaattatagtcactttctggcagcaaagcagtattctaacaagctcaaaatctgaatgatgttgtatggaaaagcccttggggtcaggagtccccacccattccaaattgcagcataagcatgaagcactaaaaaatcatacttggaatcagtgtaaatgttaacttttaaatcctttccaactgcaggggcctagtaagttcaattaactcagctttttgagctgaggtcgaggccagcaaggcttgtgccttgattctcttgtgctgactactaatagcatatctagacctcctgttttcctgatgcataaaacaacttgcatctgttaaccactctgccttgggatggtcaaggagctcatctctcctacgtctggcctgctagatcaatttgtttcataacctgtgacatgctttggctgtgcccccagtcaagtcttatcttgaattgtagctcccataattcccatatatcgtgggagggacccagtgggaggtaattgaatcaggggatgggtctttcccatgctgttctcgtgacagtgaataagcctcatgagatctgatagtttatttatttatttatttttgatacatagtcttgctctgttgctcaggctggagtgcattatcgtgatcttggctcactgcaaactctgactcctgggttcaagcgattctcctgtctcagcttcccgagtagctgggattacaggtgcccacaaccatgcctgtttaatttttgcacttttagtatagacagggtttcaccatgttggccaggctggcctccatctcctcacctcaggtcatccactgccttggcctcccaaagtgctggattacagctgatggttttataaaggggagtttccctacacaagctcttttgcctgctgccacgtaagagatgtgactttgttcctcacctgccttctgccatgagtgtgaggcctctccgaccatgtggaactgtgagtcaattaaacctcttttctttataaatttcccagcctcagatatgtctttattagcagcgtgagaacagactaatacagcctgtatgccagaaaggctgggagcacctgtggactctgacagctaagtagctgggtttgtggtttggcaggctttaagggttgtgtctggagggtctagcaataaggcctgacactttcataaatgttctcctattatccactgctgccctttagcttccaggaccaccttcccttggtgtggggtcaaaaacctgtaggtgctgttctaatgttagtttattagctttgcctgctagaaaagtggtagcagcaatagctctaagacatcaaggccaccctgaggccgcctggtctatctgcttagaaaattaggctactggccttggaatgtcccccagttttgagacaagattacccaaggcctatgccttgctttttggtcacataaagaaaaaatggttcatccaacttggggactcccatggctgcagcagagctcaatttctccttgagagtattgaaggtttgcttgcagttctcattacgttctaggagctctaaatctttccctttagtgtatcatataaaggcttggctacatgtccaaatctgggcaaccataagcagcagtacccagccatctcctaaaagagcccacagtcatttgttggactgggacccttcggtgactaaaataacttttttatcttctagggttgttgatcagttccagtggttaagacagattccaaatatttaagtctttgagtcaaaatctgagccctgtatggggataccgtatatctgcaacttcccaggaaacttaccaacttaacagtattattatttgagtcttctttagttgggctagcaatgagcaagtcacctacatactgaataattgtgtccctttccagttgtagatttcttaagtccttagctagagcattttcaaataagtgggggctatcccagaacccttcagagacgactgtccaggttagttttgaggctgaatgtgtatctggattagtccattcaaaggcaaacatattgtgaatctggatgcattgagatgcagaaaaatgcgtctttcagatttaagaatgtaaaccagcttgcatcccctgggacttggtaagtattggggacaatgaggtgtatggagacaactgcatttcttagcgctctaagggttctgacaaatctgtacttgccattaggctttttatctggtaacatgcgagtattgtaaggagactctcatgggcttcataactcatatggcaagaatttggcaataaggggttgaatttcccctcatgcttcttgccttaaaatgtattgtctcttctgagggcgaggagcactaggctgaagttggatttgaatcggggaggtgtttagtgcatttcccagagcctgtgtggcccaaacttcaagatttacttgagacaatacctcaggtggtaaatgtgacagctcattcttaacttcttttttttcccctgaggggtcaggaacaaaagtaacactttctatgatttatgatctgtgaaggtgaccatgacttggtctcctgagtcaataaacttctccccagtaagagatcaggcattcagaccgtactaaaaaggtaggtgagaagcccagaggccctggaggacaacttagaagatacaaaaagcagttattttgggcttgtccatcatgaagagacaggagcccactgtattgaatcaggacagagtcatctgctcccacacctaataagaagttaatactcctacctgccactacaagagtcacctgaggcttctccatctctggatacctaatagtccaatgggagtggaggcaggaagtaacaggccctcccactttcaagtctgctgggctctgaggttggctcccttgaaagcacagtgcatttccttcagcagtggctgaccttcttacagaaggcacattgatttatatccacgacacagtggcccagaggcacagactgggactttcaccttctcacttcctctgtgagggccagggttaacgggctgcctctgaagtggtggagagcacaaggctgcagctagaagctgggccttttgggacatttggtttattttatgttttctctgccctattcctgtgatggaaaactgcaaaatccaaatctaaaatctgatccatgggagtctggaagcctaaggctgcttttggcggcttcctgcagatatcagaagcaggctgggctataaagtaaactcctagcaatgcctatcccttcttggagtaagggtcagtgttagtgtattttctcaaggtctaaattatccacccttgtaataaggctaggttttcatcttttccgagtaattttccagactttataaaaattaaaaagctttatcacaattttttttattccttcaaggagtcaaatgatcataattttttctctctatatcccactttcttcctaattcattcatcttttctagattctagttctcttttgagtcctaatcaggcacttctgtgcctcccacttgataggtgtcatgtccctggttgcaggctgccaccctattagcatgtgctctaccactcccataacacactgcttttcttttttcttttttttttaattatactttaagttttagggtacatgtgcaccacgtgcaggttagttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccgtgtgttctcactgttcaattcccacctatgagtgagaacatgctgtgtttggttttttgtccttgtaattgtttgctgagaatgatggtttccagcttcatccatgtccctacaaagaacatcaactcatccttttttatggctgcatagtattccatggtatatatgtaccatattttcttaaaccagtctatcattgatggacacttgggttggtttgaagtctttgctattgtgaatagtgccacaataaacatacgtgtgcatgtgtctttatagcagcatgttttataatcctttgggcatatacccagtaataggatgcctgggtcaaatggtatttctagttctagatccctgaggaatcaccacactgtcttccacaatggttgaactaaattacactcccaccaacagtgtaaaagcgttcctatttctccacatcctctccagcacctgttgtttcctgactttttaatgattgccattctaactggtgtaagatggtatctcattgtggttttgatttgcatttctctgatggccagtgatggtgagcattttttcatgtgtctgttggctgcataaatgtcttcttttgagaagtgtctgttcatatcctttgcccactttttgatggggttatttgttgttttctggtaaatttgtttgagttcattatagattctggatattagccctttgtcagatgagtaggttgcaaaaattttctcccacactgtaggttgcctgttcactctgacagtagtttcttttgctgtgcagaagctctttagtttaattagatcccatttgtcaattttggctttgcttgccattgcttttggtgttttagacatgaagtccttgcccatgcctatgtcctgaatggtattgcctaggttttcttctagggtttttatggttttaggtctaacatttaagtctttaatccatcttgaattaatttttgtgtaaggtgtagggaagggatccagtttcagctttctacatatgtctggccagttttcccagcaccatttattaaatagggaatcttttccccatttcttgttttttgtcaggtttgtcaaagatcagatagttgtagatatgtggcgttatttctgagggctctgttctgttccattggtctacatctctgttttggtatcagcaccatgccgttttggttactgtagccttatagtatagtttgaagtcaggtagcatgatgcctccagctttgttcttttggcttaggattgacttggcgatgcaggttcttttttggttccatatgaactttaaagtagctttttccaattttgtgaagaaagtcatcggtagcttgatagagatagcattgaatctataaattaccttgggcagtatggccattttcacaatattggttcttcctacccatgagcatggaatgttcttccatttgtttgtatcctcttttatttcattgagcagtggtttgtagttctccttgaagaggtccttcacatcccttttaagttggattcctaggtattttatcaaccaaagaaagtccaggaccagatggattcacagcctaattctaccagaggtacaaggaggagctggtaccattccttctgaaactattccaatcaatagaaaaagagggaaccctccctaactcattttatgaggccagcatcatcgtgataccaaagcctggcagagacacaacaaaaaaagagaattttagaccaatatctctgatgaacatcaatgcagaaatcctcaataaagtactggcaaaccgaatccagcaccacatcaaaaagcttatccaccatgatcaagtgggcttcatccctgggatgcaaggctggctcaacatatgcaaatcaataaatgtaatccagcatataaacagaaccaacgacaaaaaccacatgattatctcaatagatgcagaaaaggcctttgacaaaattcaacaaaccttcatgctaaaaactctcaaaaaattaggtattgatgggacgtatctcaaaataataagagctatctatgacaaacccacagtcaatatcatactgaatgggcaaaaactggaagcattccctttgaaaaccggcacaagacagggatgccctctctcaccactcctattcaacatagtgttggaagttctgaccaaggcattcaggaaggagaaggaaataaaggatattcaatcaggaaaagaggaagtctaattttccctgtttgcagatgacatgattgtatatctagaaaccccatcatctcagcccaaaatctccttaagctgataagcaacttcagcaaagtctcaggatacaaaatcaatgtgcaaatatcacaagcattcttatacaccaataacagacaaacagagagccaaatcatgagtgaactcccattcacaactgcttcaaagagaataacacactgcctttctgccatgcagcaggaaaacataaacatatgcaagtcctgcctggccagatcgtaaacaaggttagcctcttaaatttgtctacaaattttcaggcacctctgaaaactgttttagcttttccttgtatatggctagttcagacatagaaaagggtacatatacctatatagtgtcctttttatcatctgtcacttcccagagagggcaaacattcaagtttgccagctgataagaggccccactgcatgttgttctggtgaagctcacgtgttccgacagtggggtgtgtacttaagacaggactcgaagggcagggagaagacgatgaccagacactagataaccctggaaaactagaagaaattaataacatgttgcacacctcaccagaactggaaggagtctgactgtgttctcatggggttgtcggactggcagggggagttcagccccagctaagaaaagcctaatattaagaggcacttgcattaaaagggtaatcaattacgtgccatccctattttgtcttttcctccatcaaacatatagaagcccattttaattttttatcctgaccaagcatcagagaagcctatatgtaaagtatttcctcccatttagtttctcttctataaaacaaattaagctgcaaaaaaaggagtcagactgaacaggggaaatgggaaggctgtaacttgtatattgtaatgtactagtccattttcacactgctatgacaaaactgataaaactctgtcaggaaaaaagtgggatactgggtttagaaagtagggtccagctgccctataccagctcatcaaagatggcgttatggttaagaaatgagagaaaactgttaagaaaaagtcccatgttctccatcttgaggctaattgtttgcagagggttgtcataaaagaggctgtcactaaacaggtatatctgatcttatcatgtagggctgttaaataccacatttcaacttctagtcataatgatggagaggttattgctgattttttttctgataattaaggtacaaaaatactaggttccaagacatctctcttttttcagtgtcacttggaccagtggcaaattaaacaagcaatcagctaaaagtcagaggatcgctgaggaaagcaaaagctaaactgtttggggcctctttcctggggcagcctccaggctactacaaaacagaggaggtgagcagaaaggtgacaagatacagagcactcaggtgagggacagagagcacaaggtggacagtccaaaaagagaaagtggcaaacatcttgtttagccaaatccattcttctcaatattcccaagggcctctaaccctgtgagcttggcctctaatctgagtatgatgcccccgggcctctaatttttggggctgagtgtctcaccctaacattatgccctagggcctcttgcttaagtagtagtggatcatcattcttgcccaccagaatggcttcacgactctaaaagacggcccacttgccaggtgtcagctgactgattctgtgtggattgttttccttggagtgggggtcttgtcttggtgtcccttcatggtgttgctgaaagatgttgctggaaaagagggtcctgatacagaccacaaagtaggattcttagatcttgtgcaggaaaaaaattgaggtgagtcagagagcacagtgaaagaagcaagtttactagaaatgactccattagagttggacaccctcagcaaacaagagcaggaatgcattgtcttttgttagtgtctcttcttataagtaactataaagacaaagagttataattaaacttggaaggtgcaaatgtactcactaaagtcggggctattggttttaacaatgaccattaacccattgacctaagcaagctcattaatattatccttacaaaaaaaatgctgcactcctaggacatgtatacgtttttcaggcttggtggaatatgtcttgtatgaccacaaatattctccagttataatttgtggccagctaaaaaatgtggctattttcagaccatgagcattaatcttctagatgccttgtgagtacctagctactcatattaagatagagtattctagtcatgtttactaaactagaagcttgttattcatgagttcctctaacacaataagtctactgctcaaggagaaaatgtatttctcaggaattctgtgcattttgtttgatggaatttggtatgtttaccaaaatggcagaaaagagtgaaattagtcctcaaagatttctcaagattggatataaagtaagcaaaatgattataggtaatatgcaagttgatacagttgatattcaagagaaatttgaaacacaatgacatttttatttttacttatttattattattattattttgagacagagtcttctctgttgcccagggtggattgtagtgtaccatcctggctcactgaaacctccacctcccgggttcaagcaattctcctgcctcagcttcccaagtagctgcgattacaggcatgcatcaacacacccagctaatttttgtatctttagtagagatgggatttcactctgttggctgggcttgtctcaaacccctgacaacaggcgatctgcccacctgggcctcccaaattgctgggattacaggcatgagccaccactcccagccacaatgagatttttaaataattctaactgatttcctgctgttgagcagggagctgagcaaattcaacagatcatgggcctaaagtaggagaagactaaggacaaactctagaatgcatgtgattaaattaattacaattgaaaccaaatcaaatttaataaggctgtacctcttagtttcaagatgtttcccctcactttgaaatgtggtgttattcagtggaaaataacagggttccctgcagggattgattgactgagagctatggctcaggattaaaaatccttt

SEQ ID NO: 347 - DNA, 121728 bp, Homo sapiens
agaaatactgatcctgactgaatgaatagttcctacaagtgattcgatctttgacacaagaagaaacatgaaacacagattacgctgttttacagatgaagaggccagttattagagaaactaagtggcctgttcaaggctgaaaattgataatctaagcgaagttaaatgggttactgggttatagaaattgtgttatcatctctggaaatttaagacattaaccttaacttttgtcaaagcaaaatacatctctgtaatcaaagtcctaagttaagttaaaggccttaactgaaatctgaattttccagttaatttggtttgagggcatctagatacttgaaaatgacattatcctgagatttgcaaaatggacatttattggataccattttaaagcttttcctatatacgagtacacttagggcatattaaacacacacggcacaaagcaagctgtgaggtatacgcaaattgtaaagcaaagggtattataactggcattaagaaaaagctttctggccaggcacggtggctcatgcctgtaatcccaacactttgggaggccgaggcaggtggatcacgaggtcaggagtttgagaccagcctggccaaggtggtgaaaccccatctctactaaaaatacaaaaattagatgggcgtggtggtgggcacctgtaatcccagctactggggaggctgaggcaggagaatcgcttgaacccgggaggtggaggttgcagtgagccgagatggcaccactgcactccagcctgggtgacggagtgaaactccatctcaaaaaaataataaaaaagaaaaagaaaaagctctaaaacctattacaaaaaattctttttaaattcaagctttaaaaaccagtgtccatatgcaatagaccatattcttagaagcataatctttttttttttcttgagacagagtttcggtcttgttgcctaggctggagtgcaatggcaggatctcggctcactgcaacctccccctcccgggttcaagccattttcccacctcagactccgagtagctgggattacaggtgcccaccaccatgcccagctaatttttgtatttttagtagagacgggattttaccacgttggccaggctggtctggaacttctgacctagggtgatccacccacctggcctcccaaagtgctaagattagttacttgataagaacatcccaaggaaatcgaaggcgtgagccactgcgcccagccagaagcacaatcttttgccccttctgttacaaaaagcttatcactaccactccaccagaacagtaaggacccaatcattagagccagaactggaaggccccaccctgaaccaattttaatcatccttttctaggaaaaaacatcttgcaagttttaacactcatctgaaccatcattcctcaagttttcttgttttaaattaattttaagaacacaaagcgatggccgggcatggtggctcacgcctgtaatcccagcaacactttgggaggccgaggcgagcagatcacctgaggttgagagtttgagactagcctgaccaaacatggagaaatcccatctctaccaaaaaaatacaaaattagccgggcatggtggcgcatgcctgtaatcccagctactggggaggctgaggcaggagaatcacttgaacctgggggaggtggaggttgcagggagccgagatcacaccattgcactacagcctgggcaacaagcgtgaaactctgtcaaaaataaataaataaataataatctaagctacttgtgttatctttggtgttctcaatggtgactgaaaacaacaattcaatttctcacattaataatgaagctcaggtaggcaaaacgtagccccacgttttgaaccatgaaatggaacacattcactgcctaacaacttcactaccctctattttctccaaaatcagacagaatccagcccctgtttttacccaccaacattcttctctgttccttgaggtcctcctcatttcttccaggctcagctcaaggcttcatctctatgaagccttctctgactgacttccctatcctgtaataactggtattgaactacctgataatgagtaaaaatattgtctttaacagtactggggcatgcctgatgcatgagattccaaatgatatgaaaaatataatgaaaacattggaccaggaatcttttcccgtccccatcactcttctggtttagtagggagtttttttgttgttgtttttgagatggcatctcgctgtcgcgcaggctggagtgcagtagcacgatctcagctcactacaacctctgcctcccaggttaaagcgactctcgagcctcagcctcctgagtggctgggattacaggtgtgcaccaccatgcccagctaatttttgtatttttcgtagagacggggtttcaccatgttggccaggctagtctcgaactcctcaccacaagtgatccacctgcctcggcctcccaaagtgctggaattacagacgtgagccaccatgcccggctaatttttgtgtttttagtagagacaggatttcaccatgttagtcagactggactcgaactcctgaccttaggtgatccgcctgccttggcctcccaaagtgctgggattacaggcgggagccaatgcgcccagccgagggtcatttttaactagcattgtgatcgattcaggtttagctgggaatcttgctccatgacatttaaatacattatcagaggcaagtaactgcctcgccttagggcggagttagccaaactgctgtctatctaacaatcttcaacacaggctaggtttacagccaccattacttgataagaacatccaaaggaaattgaaggatgctatgctatatataaccttgcaaaatcgatgacaaaaattatcttaactctgagttttcttgagaagcatattgtaacccaaaattcagggccggggggcggggggaaccagcagggtccacaagtactctagacagcctaaccttaattttcacagtaagcttagcatataagcatggggtagccaaatacaatttcctactttaatcctcttatcaacggggaagaaaatggaaaaagctgcagaatccagtcccccgggtaagtgaggtctctacaagcagtaagcagagggaaagcgttatccgaaaagagccgaatcagaatgtattttcttacccaccctcccaaccttaaaagaactgtccagcagaatgtgacacaatcggcctctccggcgcccatcaatccagcacagccctctgaccacaccgctaatctccaagtatctttcacaaataagtcactcctatggctcccgtcttgtagtgagaactgctagcaatattcttaatgtgaacacctgcggcgttcagtcggattctgccttgagaaaacagaatccacacacaaggcgaacaggcagagcatggcaagatcaggttgtaccagagccgaagggtaagtttacagaaacccgtatctaattaatgcctgtaacacgctagtaaccgaatcggggacagctttgtccctttccgcagtgagaacggggcccgcccggagcccggggaaccgaaggtttaggagcccaaggtcacccacgaatcccagccgttccctggggcgacttcctggagcagccacgtgttcccccggcgccgcacgccgcgcagctgcaccttggctgcgcccgcgctcccggacccgcagcccggagccggcgcactagggcctgcggccttcaagggcgaggacccgaagtccccggggctgagagcgacagtgggggtacacctggtctcgtcattcgtcgctctgtgaccgaggaggcgggcaagaaggcagagagaagggaagggacgagaggcgaagggacgagaggcgcagggacgcctctgcgcacagccgccgaccccgtgtacctgcagccgctcgaggcgccgccacagccccttccccacaggctcgcggccccgctccatcccggccgccccgcctggggccgcgaccgctttcccgctccccgtgcggctccctatggctgctggacagcaccggagcggccgctccagccagccccgcaggatgaagggaggacacgagggtcggtgtagttctagaagcccgcactcacactagcgcgtcctccgtcccgagccgccacccgatatcccgacgctctgaggggatggcggcccctaaccggcggtttatagcctggccccgcccccggcccccaggggggctgtgcgtcacttcctgaggcacgtacgctcgcgaggtgctctgacagatcgcccggggggcggggatgcgcgcgcagcgggcggggccctatgcggagggcgctgcgggcgaggcgaaggccaagggaaaaggcgccaaggcagcaggtgccccgaggagccgcgcgatgggcgcactggcctctgcctcggcgccttcctccaccctggtagcctggcagcctccgcctgaccttgaccaacctccagtccctgcagtgctaggtccaatctgttggcgttgacgcttaaatgttggatattgcactgcggcagtgccttgaaatgtacgtgcaggatggaatgttaggtaactattaaagccactcttgtgaagatgtattttgcagcctcagaaatacaaaaaggaaaagaaaagcaaaatgcaaatttttattcagaatgtatacaagctgcactttaaccaagactagcggagtgctttgcgtaatgtttaatgcatgagggaataaaagggaaaatagaaacaagtgacttaatagggtgataggattgtagattaactttcgttttcattgccatcgctgttattggattgtgcaatgaataacaaataaataaaattcaattcttgtcactgtttaaactctttccaaacaatcacaccctctccctccctctggtcagtaaccagcaggccagggaggtagtagctacaatgcaagaaagcaacccataccttaaaaagcattgcacataaactgaccttcaggcccgtagggacacagaacagccctttaagaagcaaatccgtttctgggccttgggcttttactcttccctttatttcttctgctctaagatagagaaagtacttgggattctcaccgcctttctctttactcccattctctaaaatctctctccccaaagagaagtgtttaaaagtcatatgagttgccaggcgcggtggctcacgcctgcaatcctaacactttgggaggccgaggtgagcggatcacgaggtctggagttcgagaccagcctgaccaatatggtgaaaccccatctctactaaaaaaatttcaaaaaaaattagccaggcatagtggcacgcgcctgtaatcccagctactcaggaggctgaggcagaagaatcgcttgaacccaagaggcggaggttgcagtgagccaagatcgcgccattgcactccaacctgggcgacagagcaagattccatctcaaaaaaaaaaaaaagtcatatgagcaggagcattgctgcacctttaatgatctaatcaggaaaaggttaaggatgcacatccacagagggcctaccttaacattcagacaccaggcctgctcccctgtggtgttccttctttatttctttaattattaattttatttatttttattatttttacttttaagacagtgtcttgctctgtcaccctggctggagtacagtggcatgatctcgggctcactgcaacctctgcctccggattcaagcgattctcctgcctcagcctcccaagtagctgggactacaggtgtgtgccaccatgccaggctaatttttgtattttgaggagtgacgggattttatcatgttggccaggcttgtctcgaattcctgacctcaggtgatctgcccaccttggcctcctaaaatgttgggataacaggcatgagccaccatgcccagcctatttattttttatttttaatttgacgcagggtttgctatgtagcccagactagtcttgaactcctgggctcaaacaatcctcctgcctccggtctcccaaagtgctgggattataggcatgagctaacatgcctggctttctgcctttccttgactgaagtatcttttaaaaagaaacaaacaatgctggtatttgcaggtgaaaatcttatagcctcatggaggacataggtttaggtggccagatgcgatggctaatccctgtaatcccaacactttgggagactgaggcaggtggatcttctgaggtcaggagttcaagaccagcctggccagcatgataaaaccccatcacaactaaaaatacaaaatttagtctggcgtggtggcgcacacctgtagtcccagctactccagaggctgaggcaggagaatcgtttgaacccgggaggggggtggctgcagtgagctgagatcacaccactgcccttcagcctgggcagcagagcaagactctgtctcaaaaaaaaaaaaaaaaaagaaagaaagaaagaaaagaaaagaaagaaaaatatgtttaggagacatttagaggccaggaccatttggacatgaaaattcaaatctcaaaaatttatattcactaaaataaaaccataaacgtgacactaaagaggctatcaattatatttttatttttatgctgttattagtattaatagacactgcaattaaagtccacttattaacacttttactatttatttatttatttttaaacagtcttactctgtcacccaggctggagtgcagtggcgccatctcggctcaatgcaacctccacctgggttcaagcgattctcctgcctcagcctcccgagtagctgggattacaggcacgtgccaccacgcatggctaattttttgtatttttaatagagacggggtttctccatgttggccaggctggtcgtgaactcctgccctcatgatctgcctgccttggcctcccaaagtgctgggattacaggcgtgagccaccgagcctggccaaattattcgaaattattattggaaattatttaatttccaaccctccacaaactattccatgaggcttacctcatcctggaactaaaactcttgcagttcttctgcatcgtacacagaaatacgagaagtttcataaagggaaggaggttggcaaggaaaaagataccatgagctgtggggaaaagaaaagagcacaaagcctggagggccaagaagctggagttctcaactttcctgagcctgggttgtaccagctctaaaatgggaataaaggctgggcacggtggctcacacgtctaatctcagcactttgggaggctgaggcgggcgtatcatttgaggtcaagagttcgagaccagcctaaccaatgtggtgaaaccccatctctactgaaaatacgaaaattagccgggtgtggtggcaggcacctgtaatcccagctactcagtaggctgaggcaggagaatcgcttgaacccgggaggcagagggtgcagtgagctgagattgtgccactgcactccaggctgagagacacagcaagactccttctcaaaaaataaaatgggaataaaaatacctcattccaaaaatacctcttttagggtctagaagaccctaaaagcaatgactggcacatcatacactgttggtcagcatggttgaatcagagtcctcgtggggcggagtggggtcaggtaggaacgtgacgtggaagatgtctgcagactgggatggatgtgggctcatgaagaggaaggatgaaggcatttcagcagaggagaaccggccacctgaaggctctgtagtgagaaggagcctgtggtgtgtgttaaaattcctaaggagatgtctgacagctaattcaggggaattactgctggaaacaacagtgcaggatgattaacggcaaaattctgcctccctctcttttttcttcaccaagagatgaaagcagaagtcttgctttttggtgagagagaactggcaggaaaagcaaaccagataagccacttacctagtgaaagagccccagctggcagggcatggaggctcacgcctgtaatcccagcactttgggaggcagaggcaggaggatcacttgaggtcaggagttcgagaccagcctggccaacatgacaagacactgtctctactaaaaatacaaaaattagccaggcgtggttttgtgtgcccataatctcagctacttaggaggctgaggcaggagaatcgtttgaacctgggaggcggaggttgcagtaagctgaggctgggccactgcactccagtctgggtgacaaagtgagtccgcctcaaaaataaaataaaaagcccccgcctagaaattagcaacttgtcccagtgggactgtcacccactgtgctgcggaaacatgggcgtcagtcatggctctgtacttcattttccctgtctgccatgtggaaataatatccctttattgccttcattcatttaccagtgaaataaaaagtaagaaaacttattaaactacatgtttatacaaatttaaggtgttactagtgcagagcccagtctaagtgaataaatgtggtggtgacgggtcgaagctttaaaaaaaaaaaaagaaaaggaaaatttttttttctcgctctgtcacccaggctggagtgcaatggcgcagtctcggctcactgcaacctccgcctcccaggttcaagcgattctcctgcctcagcgtcccgagtagctgggattacaggtgcctgccaccacacccagctaatttttgtatttttagtggagatgcggtttcactatgttggccagggtggtctcgatctcctgacctcgtggtctgcctgcctcggcctcccacagtgctgggatttcaggcgtgagccaccgcgcccggcccttcaacggcttttgaatgcacctactccagaaaaagtgacttggtcattgataatagtggatacagaaaggtaatgccatcattatttatcgagtactgttatgtgctggaaaaggacgtgtaaagaggtaagaagcaagtctgtacccctgaaaaggcaaacaatgtagctggggaagcataatgtatatttataagaacttatatttaaaggccaggcctagtgcggtggctcatgcctctaatcccagcactcaagaggccaaggcaggaggatcgattgcttgaggccgggagttcaagaccagcctgtgcaacacagtgagaccccctatctctacaaaaaaaacttaaaaattgccaggtgtggtggtgctgcctgtagtcccagctactctgggggctgaagtgggaggatggctggagcccaggagttcagggttacaatgaactgtgattgcaccactgcacccagcctgggcaacagagcaagaccctgtctcaactaataataataataataataataataataaatatataatgccagtcactgtggctgtagtgagccgagattacatcactgcacccagcctgggcaacagagcaagaccctgtctcaaataataataataataaatatataatgccagtcactgaggctgtagtgagccgagattgcaccactgcactccagcctgggcaacagagcaagaccctgtgtcaaataataagaataataagaataaatatataatgccagtcactgtggctcatgtctgtaatcccagtactttgggaggccgaggcaggtggatggcctgagtgcgggcatttgagaccagcctggacaacatggcaaaaccccatctctaccaaaaatacaaaaaattagctgggcatctggaggctgaggtgagagaacagcttgagcttgggacgctgaggctgtagtgagccaagattgcattgctgcacccagcctgggcaacagagcaagaccctttctcaaataataataataacaataataataataataaatatataatgccagtcaccgtggctcatgtctgtaatccgcagtactttgggaggccgaggcagatggatggcctgagtgcaggagttcgagaccagcctggacaacatggcgaaaccccatctctaccaatagtacaaaaaattagctgggcatctggaggctgaggtgagagaatggcttgagcttgggaggctgaggctgtagtgagctgggattgcattactgcacccagcgtgggcaacagagtgagactgtctcaaaaaaaaaaatcccacaaaaataccattaatttgccaactttgtaatagagttacaaagttgccacttgctctttctggggtcctacctgtggcccaaacagcagatgaagtctcttagttcagcatttctcaaacgttttttactgcatttcatggacaaatgtccatcttacttcacaactcagtacacccatgtgtatgcgtgtgtgtatgcgtgtgtatacacgtgtatatttccttcagtatacccacgtggatgtgtgtgtatatatgtgtatatttccttgaaacccaaagtaaaagtttcatgaaataatacccttgaggtgtggaaagccctccagaattttctattctatttaatagtaaaaatgctaatttttaacccattcaattgatttcccaatgggccgtaacctatttttgaaaagcatagtcctaggccatttcctctctcagagcacaagactttttagtgaacaggataaatgactttttagtgaacaggataaatgatgctcaaagttaaatttcaattcccaaggtttctccctgttctttctgcttgtcgctgtttcaactttctaccgccctacatttcagcaaatattggttacggtttttttgtttgtttgcttgtttgtttgtttttaatgagttgggaggctgagttagaaggcagagagaaagtcttttcaatcttttttttttttttgagatggagtctcactctgtcacccaggctggagtgcagtgatgcaatctcggctcaccacaacctctgccacctgggttcaagtgattctcctgcctcagcctcctgagtagctgggactacaggcgcaccaccacgcctggataatttttgtatttttattagagatggggtttcaccatgttggccgggctggtctcgaactcctgaccccattgatccacccgcctcagcctcccaaagtgctgggattacaggcgtgagacaccacacccagtgttttcactatttttacttttttaaatttcttaaaataaaatatgtagaacgagggtctccctatgttgcccaggctggtctcaaactcctgggctcaagggatccttctgcctcggcctcccaaggtgctaggattacaggcttgagccaccatgcccggcctgaagtcttttcaaatgctgtcaaatagctgcacacactccggtcagtgagggcagcaccctgcctgtcacacggctggtcttcacagcagcttctacagaaatcactctaacctacctttagctctgaccctagctcctatttaacatgccggatccattttattttccttggaatcctaagcctcgggcaatcactttaggaccagagtcataaaataaaaatgtggagctctgccactttggaagaggatgcaacctagaaaaaaggcaggtggactgtcaactcatagatttgaggttgatactattttccattttattttgcatttctttttctccaccctcagtttcctgtccttatcctgctgactcaattattttttctttctccattgccaaacggaaggtcacccacgagaacatggaataggggcaagattcagattaatatggaggagtttgctcccattttatagcaaatggaaaggttacttaggacagtgaaagataactaattttgttttttttttgtttgtttgtttgttttcttttgagatggggttgtgctctgtcacccaggctggagtgcagtggcacgatctcagctcactgcaatctccaccttccgggttcaagtgattttcctgcctcagcttcctgagtagctgagattacaggtgcccaccaccatacccagctaatttttgtatttttagtagagatggggtttcaccatgttggccaggctggactcgaactcctgacctcaagtgatgcacccaccttggccttccaaagtgttgggattacaggcgtgagccaccatgcctagccaaagacaatttttaaattgattacaaggacatttatgccaaccagtacagtggtctaagttgaagttttgagtaggatatgaagttctatttagtcccattcggaggcaaaatagaactcactgcataatagagtttcaagttcagaaggaactatataactaatgtactgtctctgacctatagtaggtgctcaaaaaatgtatgttgaattaattcaacaaaattcctctacttcacctcatcaggtggttatctagtgtctcctttacctctccaatgggagcaaatctataatttcccaaagcagaaagacctgggcagtttgaactgtcagaaagtttttatctgggccaggtgcggtggctcacgtctataatatcagcactgtgggaggccaaggtgggcagataacctgaggtcattcaagaccaacctggccaacagggtgaaaccccatctttactaaaactacaaacattagccaggcatggtggcgcacacctgtaatcccagctactcaggaggctgaggcaggagaattgcttgaacccaggaggcggatgttgcagtgagctgagatcgcaccactgcactccagcctgggcgacagcgtgagactctgtctcaaaagaaaaacaaaagtttgatctactaaactaaattctctctccctcttctatatattaattattttatatatatatatattttttttaaatagatatggggtcttgctatgttgctcaggctggtctcaaactcctgggatcaagcagtcctcctacctcagcctcccaaagtgttgggattacaggtgtgagccaacacgcccatcctataaattaattattgtttgaagactgctctcctgttcacagctgtcttctccagctaaatatccaaatctcttctaatggttaccacagggcgtgattccatgtctccccacccactggtcactttgtggttttttttgtgtgtttttttttttatttttttgttttgagatggagtttcgcttttgtcgcccaggctggagtgcagtggcatgatctccgctcactgcaacctccgcctcccaggttcaagcgattctcctaactcagcctcccgagtagctgggattacaggcgccttctaccacgccgggctaatttttgtgttagtacagacggaagtttgctggtctcgaactcttgacctcaggtgacctgcccgccttggcctcccaaagtgctaggattacaggcatgagccaccgcgccaggccccactggtcatttttggaagtatagtttggccaatccagagggggcaggaacatcattcccctgttgtagatgctgcagcttttggtggccatctgtctgccaccatattcactaccttaatagccactgtctattgttaacttctgttgagttttcagcagggttcaagggaatagatcaatctttggagcagaaagacctgggccccaaatctagttttgccgtgtactagtaccctctatgctccttttatcatggagaatgtgatatccaggtactgttacagtctactatagcgtatgaagaggatctgtccccgcttatcaccagtctaattcagctggaggtggaaaagagcctgatctatttggctaggaacatccttgccttggagctgaataaaaatagccaaggtttattgtacatctaccaggtgctccattctagcgcctttaaacatatgagctcatgcaatcctcagaacaattcttaaaaataaattcttaaaaaaaattaaaaactcttaaaaataaagaggtaatcccattttcaggtgtggaaactagcttaatacagaagtaaagtaacttgccccatgtcacatggctaataaatagtgacagcaagaattcaagcctaggtcatctagcttctaacctggccctaaaaaattccactacactgcctccttacaaacccaggcatgacacagactgactgcaccacccgcacagctctgcagacacctccccagggaagaatttctattcaagaggtacagggaccatctaggtggaaccatttgagaagatctagtatctgagggatctattttttttcacttcagatttaagttaatttcaaaatttggattcatattcctatgtggggaatcccagatatttctttcttttctttcctttttttttttttttttgagacggagtttcactcttcttgccctggatggtgcaatagcgccatctcagctcactgcaacctccacctcctgagttcaagcaattctcctgcctcagcctcccaagtagctgggattacagccatgcgccaccacgcccagctaatttttttttttttgagacggagtctctctgtgtcactgaggctggagtgcagtggtgtgatgtcggctcagtgcaacctctgacaccagggttcaagcgattctcctgcctcagcctcctgagtagctgagattacaggcaagtgcgaccacacccggctaatttttgtatttttagtaaagacgaggtttcaccatgttggtcaggctggtctcgaactcctgacctgatccacccgcctcggcctcccaaagtgctgggattataggcgtgagccaccgcgcctggctagaatcccagatacttctaaaaataagagtttgtagtacaactgatgctccagaaatctgggtaccatttgacagaaatgcagtgcattcatattgtccctgcaagctagctcatttgcttaaatttccagaatgcgtacctacctttgataaggagagttattgaattgataaaattatcgtatgaatgtatatatattaaacattgtttctgggccgcatggcaaaaccctgtctctacaaaaaaataccaaaaaaaaaaaaaaaatgccaggcatggtggtacactcctgaagtcccagctacttgggaggccgaggcgggaggatcccttgagcccaagagtttgaggctgcagtgaaccgtaaccatgccactacactacactgggaacagagtaagagcctgtctcaaaaataaataaataaatacttcaaaaaaaaaaaaactttgtttccaaaatataaattagtcagtttggtttttcttatttgcatctttatctttctttctttttttgtagagacaggaccttgctatgtcgaccaggctggtcttgaactcctggcctcaggctatcctcccaccctggcctcccaaagtgctgggactgcaagcatcagccactgtaccccgcctcttatttgtatcttcttttgacatctgagcttgcaactctcacttatgtctgagtttcccttcctctatggctgggaccttaagcaataatacttctgataaactgtgcgccagatggccaaacattgcctaaaaaaaatgactaagaaagaggcctttgaaaagaacattgtgaagtggggatgactgatgatgtaaataggaaaaatgaacaaatgtgtgaagaaaacatttgcaaacagacgtctacatctaaatcccaagtcagcaaatctagtattcaggaaaaataccaaataggcagaaactttttggtttcttcagctttaatatacacagtagacaaattttcctttggtttggaaaatgttcctgccaaaacttgtatttcttatacatggaaatgtggtcaaggaggcagctgtacagtggttacatttgtgagagctggagtggcttcccttggttcatctcacacaatcccctaagtggtaggaagacccgtatcccagggctggggtgcccaggtgtcagagtgcggtaacgttcgctgagcacctatggtgtccaggtactgagctgggaacttatatttgtatcatcttactttggcccccaacaattctgtgaaacaggtatcatacctattttatagatgaataagtagaagtgtgaagaatataaaaggattggctgaaagtggcacagcttttaaatagcaagaccctaacttcagatctctgtgatttctgttttttttttttttttttaaataaatgttaagagatatagcaatggggatctcaccatgttgtccaggctggtctcaaactcctgggctcaagcaatcctccctccttagcctcccaaagtactgggattacaggtgtgagccaccatgcctggccaggtttctgtattaaaaccactttttactatatctcaggtatggaaatatgaaaacactgttgtagcaggcgggtagttgaagctctgcactcagggtaggctgacgtactgccaggctctgaccaggaccttacaacaatacccatccttggaaggtttgagtcaactttatagctgaatttgatgccaggagcacaaagcaaaagatccccatatataaagacaaggttataaggtacagtgtgcctggtacaactatcttccagaatgcttcccagaagtaacatagctgggcaccctggcacatgtttatactctcagctacttggaggtgctgaggcaggaggatcatttgagcccaggagtcagaggccagcctgagcaacatgctacgaaggggggcaggcttctctgataaggtcgagcccaagtaggcaatgagagcagagaattccaaagggagagacagttctgggcccgtgagccaatcctgctagccaggtcccctccaaccccctattccaggcagaccacttctgtgtcaaggtctgaaatccagccttgactttattttatttatgtattttttgagacagctctgctgtacaggccagaatgcagtgacatgaccatagctcactgtaacctcaagcgatcctcctgcctcagcctcccaagtagctggaactacaggcatgtgccatcacacctgtcaaattttaatttttttttgtagagatggagtctcactgtgttgccccggctatttttgaacccctgagatcaagggatcctccagccttggcctcccaaagtgctgggattacaagcgtgagccaccacgctgggctaatttttaatttttttttgtagagacaaagtctcactatattgcccaggctattcttgaactcctaagctcaaaggatcttccagcctcctcggcctcccaaagtgctgggattacaggtgagagccagcatgcctggctctagccttggctttattaaggtacaggcaggttttcctgcaggtagtaagatgaataaaggttagattggttttgagatccagatagaggctagactctagcctagcgcttctttttttttttttttttttgagacggagtcttgccctgtctcccaggctggagtgcagtggcgtgatctctgctcagtgcaacctccgcctcctgggttcacgcaattctcctgccccagcctcccgagtagctgggattacaggcacatgcctccacacccggctaatttttgcatttttagtagagacggggtttcaccatgttggacaggctggtctcgaacttctgacctcatgatcacctcagcctcccaaagtgctaggattacaggcatgagccaccacacccagcctagcctagtgcttcttaaacattcatgtgagctccatgcagtgtcacatctataatcccagcactttggaggccaaggcaggaggattgcttgagcccaggagtccaaggctactctgagctatgattgtgccactgcagctaagccttgactacagagtgagaccttgtttcttaaaaatatatatattcatatacatatattatttattttcatttattatttatttatttatttttgagagagaaagagacgaagtttcactcttgttgcccaggctggagtgcagtggcgcaatctcagctcactgcaacctccacctcccgggttccagtgattctcctgcctcagcctcctgagtagctgggactacaggcacccaccaccacgcccggctaatttttgtattttttgtagagaaggggtttcaccatgttggccaggctgatctctaactccttacctcaagtgatccacctacctcaacctcccaaagtgctgggattacaggtgtgagccaccatacccagcccttgaaaatatttttttaaagaaactttaatgtgcagataagtcccatggaggggacgtgttaaaatgcagattctgattcagaaggtctggtgggggtccaagacggtgtttctaacaagctcctaactgatacccaggctgctgctggtcttagaccaacccttgagtagactttagaggaagaagtttttattagctgtttctacaacactccccacagaaagggcaccctgtgtggccagctggcatgaaagcggtttctgcttggcagctatttttaggtagctgtaatgcattctattttttgcattctaagcttttcagtggaccagggcgatccctggggctgtcccagcttcagcaacggtccctaagaccattcagctactttgcagccactgcacaactgccaaacaatccactaatcctgatcttgaaacaattttccctcctgagaagacaccagacctcagcaggaagacttggcctgcacagcagttctcttaccccacacgaattaataaataggcctcatgaatcgggattttgtgcccttgggtagcgaattacctgatgactctggtgaactgacgaaactgagtttgtgaaactgtgagccggaagaacagtctacagctgtcgtggactcccctgaacccctgggaagacgcagctcaacagccagtccacacgaaccctgctctgaaacctctcctgcagactgggcctgggctagagaagaacaggagttttcttttctccttttttttgagacggagttttgctcttgttgcccaggctggagtgcagtggcatgatcgtggctcactgcaacctctgcctcctgggttcaagtgattctcctgcctcagcctctggagtagctgggattacaggcgtgcaccaccacgcccaactaatttttgtaattttagtagagatggggtttcaccgttttggtcaggctggtctcaaactcctgacttcgagtgatccacccgcctcggcctcccaaagtgctgggattacagagatgagccaccgcgccaagctgtgaattgattttttagtgaaacttcagggagccaaggactttggcccccacagtaccatctggattattgggaacaggtgcaaaatatatagggccagcgaaaactctcaaaggaatgattgacattataaatttagagaggaaggactgccttcctttctgtgacaacagcactttaatgttccaaaacaggatgtccttggatttggttttaatgcttatgtatataaggttagctattgccaggagactgatacaattaatcagagtccatctctcccttccaggcacaccttcacttcgctgcagtttctcatggccataaatccattagagcaagaaacagcaagattagtagagggccataaatttagattctgggccattttacctgataagtctttttgttcttttctctttttttgagatagggtctcactctgtcacccaggctggagtgcagtggagtggccatggctcaccgcagcctctacatcccaggctccagccatcctacctcagcttgcagctggaactacaagagcacgtccccacccctggctagttgttttgtaatttttgtagagacaggatctttctatgttgctagggctggtctcaaactcctgggctccagtgatccacccaccttggcctcccaaagtgctggggtttcaggcgtgaatcatcatgcccagccagaaaccagtcttaaaagactgtatactataatgattctatttatatgacattctggaaaaggtgaaattatagagacctaaaatacatcagtggttgccagaggcttggagaatgaagtataggctgaataggtaaaccatatatgatattttagggcagcgaaactcttctgtatggtacatgagactgcatttttcaaaacccatagaactggctgggtgtggtggctcacgcctgtaatcccagcactttgcgaggccaaggcagcggatcacttgaggtcaggagtttgagaccagcctggccaacatggtgaaaccccgtctctactgaaaatacaaaaaatagctgggcatggtggtgggtacctgtaatcccagctactcagtaggctgaggcaggagaatcacttgaacccaggaggcagaagttgcagtgagccaagatggcacttctgcactccagcctgggcgacacagtgagacatcatctcaaaaaaaaaaaaaaaaaaaaaaaaaaaaactttagctggctgagcggcacgcgcctgtagtcccagctactcaggaaggtgaagcaggaggatcccttgaatccaggagttcatgagctatgatcatcccacagcactccagcctccgtgacagagcaaaaccctgtcactaaaacaaaacaaaacaaacaaacaaaaacccatagagcacaaatttctctacagcacaaatttcaaccttaatatatgcaaatgttaaagcgggagtgggagggttcccaggatggaatgcaaactgttataaagaacctcaccatgctacaaacatgacctaacatccaaggggaaggaagggaagtgctgggtgttgaaggggatggaagggaagtgctgggcattgaaggggatggaagggaagtgctgggcgttgaaggggatggaagggaagtgctgggcgttgaaggggagggaagggaagtgctgggcgttgaaggggagggaagggaagtgctgggtgttgaaggggagggaagggaagtgctgggtgttgaaggggagggaagggaagtgctgggtgttgaaggggagggaagggaagtgctgggtattgaaggtgagggaagggaagtgctgggcgttgaaggggagggaagggaagtgctgggcgttgaaggggagggaagggaagtgctgggcgttgaaggggatggaagggaagtgctgggtgttgaaggggagggaagggaagtgctgggcattgaaggggagggaagggaagtgctgggtattgaaggggagggaagggaagtgctgggtattgaaggggagggaagggaagtgctgggtattgaaggggagggaaaggaagggaaatgctgggtattgaaggggagggaaaggaagtgctgggcattgaaggggatggaagggaagtgctgggtattgaagaggatggaagggaagtgctgggtattgaaggggagggaagggaagtgctgggtattgaaggggagggaagggaagtgctgggtattgaaggggagggaagggaagtgctgggcattgaaggggatggaagggaattgctgggcgttgaaggggatggaagggaagtactgggcgttgaaggggagggaaaggaagtgctgggcattgaaggggagggaagggaagtactgggtattgaaggggagggaagggaagtgctgggcattgaaggggatggaagggaagtgctgggcattgaaggggatggaaaggaagtgctgggcattgaaggggatggaagggaattgctgagcgttgaaggggatggaagggaagtgctgggcgttgaaggggagggaagggaagtgctgggcgttgaaggggagggaagggaagtgctgggcgttgaaggggagggaagggaagtgttgggcgttgaaggggatggaagggaagtgctgggcgttgaagggggtggaagggaagtgctgggcgttgggggtggaagggacgtgctgggcgttgaaggggatggaagggaagtgctgggcgttgaaggggatggaagggaagtgctgggcgttgaaggggatggaagggaagtgctgggcgttgaaggggatggaagggaagtgctgggtgttgaaggggatggaagggaagttctggatattgaaagagaaggaagggaagtgctgggtattgaaggggatggaagggaagcgctggtctaagtgactttggaaataagtgaagactataagactaaaaataaaaggaactgtacataagcactgaactctaacagcaaaattgtttcccatggggatatgggttaacaactgtgaaaccactctacattgtgctgggattgaatggatggcaagccagggagccaggtagctcaccgttgtctacacacacacacacacacacacacacacacacacaattctctcttgcttatattaatgtgtatataaatatacatacattaacaactgtgtgtgtgtatatatatacacacatataaatatatatgctaataatcatgtatgtgtttatgtgtgtgtatgtattatacaagaatcatgtatgtgtgttacatacatgatagttaatgtatatatatttatatgtgtgcaccagttagtacacacatataaaaactacaaagcaagtcggccagacatggtggtttatgcctgtattcccagcactttgggagaccaaggcaggaggattgcttgagcctattagttcgagaccagcttgggtaacttgacaaaaccctgtgtctacaaaaaatacaaaaattagccaggtgtggtggcaggtgcctgtaatcccagctcccgaggaggctgaggtaggaggatcacctgagcccggaaggtcaaggctgcagtgagctatgatcgcaccactgcactccatcctcggtgacagagtgagaccctctctaaaaaaaaaaaaaaaagtctgaaaaagaaaacacaacaagtatagagaaagtcaagaaaactgaagttgtctttttgaaaagaccaacaaaactgacaaaacagtctggcgctcacgcctgtaatcccagcactttgggaggctggggtgggaggatcacttgaggccaggaattagacaccagcctgggcaacagagcaagactcctgacccccaagtctctacatgaatttttttgtttgtttgtttgtttgagatggagtctcactctgtcgcccaggctggagtgcccaggctggagtgcagtggcgcgatctcggctcactgcaacctctgcctcccgggttcccgccattctcctgcctcagcctcctgagtagctgggactacaggcacccgccaccgcgcccggctaattttttgtgtgttttttagtagagatggagtttcaccatgttagccaggatggtcttgatctcctgacctcgtgatccgcccacctcggcctcccaaagtgctgggattacaggcgtgagccaccgcgcccggccgaaaatttttaaaaattaggcatagtggaaacctgtagtcctagctacttgggaggctgaagaaggattgcttgagccgaggagtgaccaatgatcaagccactgcactccagcctgagtggcagagtgacaccctgtctcgattttttaaaaaactgacaaatcttttgctaaactgaccattttaaaaagagaaaaagtggccaggagggtggctcacgcctgtaatcccagcactttgggaggccaaggcaggcggatcacgaggttaggacatcgagaccatcctggccaacatggtgaaaacccatctctactaaaaatagaaaaaaaattagctggacgtggtggttggcacctgtagtcccagctactcgggaggctgagccaggacaatcacttgaacccaggaggtggaggttgcagtgagctgagatcgtgccactccactccagcctagcgacagagcaagactctctctcaaaaaaagaaaaaaagttcaatatatgaaaatcagcaattaaagaggacatcactatataccttacagaaaaaaaaataaataaaaggtggccaggtacagtagctcatgcctgtagtcccagcactttgggaggctgaggcaggcagattgcttgagcccaggagatctgttgtccaggagatctgagatcagcctggacaacatgacaaaaccccatctctacaaaaaatacaaaaattaggcaggtgtggtggcacaggcctgtagtcccagctactcagggaggcagaggcaagaggatggcttgagccctggaggttgaggctgcagtgaaccctgacggtgccctgcactgcagcctgggtgacaaagtgagatcctgtctcaaaaaataaataaataaaaatagattataaaagaataccatgaataaccatatgccaacaaattagataacttatataaaataaaatgggcacattccttgaaagacacaaatttctgaaacagacagaagaagaaggagaatatctaaatagacctatagacctacagcaagtaaagagattgaattcatactgacagtggctcacacctataatcccagcacttttcaaggccgaggcaggaggagcacttgagcctatgagttcaagtccagcctagacaatgtagcaagacactgcctctaatacaaaaattaacactaaaacaacaaaaacactcaacaaactaaaaggagctacctcaatccaataaagggcacatacaaaaaaacctacagctaacaaagtgaaagactttctccctaccaaaacaaagatgtccactctcacctgttcaacactgtgaaggaggttctagccaaagcaattagacaagaaaaagaaacaaacaggctgggtgcggtggctcatgcctgtaatcccagcactttgggaggccgaggcgggtggatcaacaagtcaggagttcgagaccagcctggccaacaaagtgataccctgtctctactaaaaatgcaaaaaattagggggtcgtggtggtgggtgcctctaattccagctaccaaggaggctgaggcaggagaatcccttgaacccaggaggcagaggctgcagtgagctgagatcgtgccattgcactgcagcctgggcaacacgaatgaaactccatctcagaaaaaaataaaagaaaaagaaacaaaaggtattcagattggaaaggaagaattgaaactatctctgcttataaatgatatgattttatatagagagaatcctaatgaatccaacaaaaagctactagtatttacatgtatatttcccagctctgtccacttagaggccccagaaacaatatccaggtagcaatgagaacacacccagtgtccagatctcggtttctaataccattccccagagcagaggaccctggtttctcataccattccccagaacagaggaccctggtttctcataccattccccagtagagaggacactgctttctaataccattccccagaacagaggaccctgctttctaataccattccccagtacagaggaccctgctttctaataccattccccagtagagaggaccctggtttctcataccattcgccagtgcagaggaccctgctttctaatacgattccccagaacagaggaccctggtttctcataccattcgccagtgcggaggaccctgctttctaataccattccccagtagagaggaccctcgtttctaataccattccccattgcaaaggaaccagcctccctggagaaatgcctgatttctttttttattttttgagatggggtctcgctcgtcatcaggctgcagtgcagtggcgtgatctcggcttacctcaacctccgcctcctgggttccagcgattctcctgcctcagcctcccgagtagctgggattacaggcgcccaccaccacacccagctaatttttgtatttttggtagagacagggtttcaccatgttggccaggctggttcaatctcttgacctcatgatcttcccgcctcggcctcccaaagtgctaggattacaggtgtgagccacactgcccggccctgatggttttgttgttttttttttttttttttttttttttttagtaaataaacttgtaccagaagaaatggctgattctaagcctgggtcaggaaatatccaatatgaacctggagcatcttctagtgccagaaagtacgaaagagctcaaagaacaaaatggtggggatatgtctatggacacagaagccaactacagaagctcccaatggccaaagctggagcaatttatactacagaatgaagagcctaatacagattataacccaaagtataaaaaataaatatccatgagaccccactgccataaataagtgattgcctaaacaaataaatgaggacgaataggcaactctcttgtacagtggaactctagatgatatactgacatttatcatggaggaggtggggcataactccctaccgctgaggcaggagttgcatagagtgacttcctactaaagagtatagtacggaaagcggaggaaaggccgggcacggtggctcacgcctataatcccagcactttgggaggccaaggcgggtggatcacgaggttaggagttcaagacaagcctggccaacatggtgaaaccccatctctactaaaaatacagaaaattagccaggcatggtggcaggtgcctgcaatcccagctactcaggaggctgaggcaggagaatcgcttgaacccaggaggcagaggttgccgtgagccgagattgcgccattgcactccagcccgggcaataacgcgagactccatctcaaacaaacaaacaaactaaaaagaaaatggcactttatctctgtggttttcctccccaaaaccccaaaccccaaaccccagtctaatcatgagaaaaacatcagacaaatcccagttgaaggacattctacaacatgtatgaccagtactccttaaaaccgtcaagttcatttaaaaaaaagaagggctggacgcggtggctcacacctgtaatcccagcactttaggaggccgaggtgggcggatcacctgaggtcaggagttcgagaccagcctggccaacatggtgaaaccccgtctctactagaaatacaaaaattatccgggtgtggtggctcgaacctgtagtctcagctacttggggggttgaggcggtaggattgtttgagcccaggaggcaggggttgcagtgagctgacattgtgccactgtgttccaacctgggtggacagagtgagaccctgtgtgagaaacttacattttattttatttaggtatttggttttgggattacaggcatgagcctccgcgcctggccgaaacttacatttcagaagagcgtaaggagacctaatgactgaatgtgatatggcatcctagctgaaatgctagaaatagaacactgggtaagaacgaaggtaacccaaattatgtatggtcttcagaagactgtatgaatattgactcataggttttgataaatgtaccatagtaatgggataacaataggagaaactgagtgtatgggtatatggaaactctatatttgatcgattgattgattgagatagggtctcactttgttgcccaggttggagtgcagtggtgtgaacatgactcactgcaacctcaacattccgggctcaaaacatcttcacgaagctgcccaagtagctgggaatacagaagcatgccttgccagtttttacaatttgtgaagagatggggtttctttgttttctttctcttttttttttttttcgagacagagtctcactctgtcacccaggctggagtgcagtggtgcgatctcagctcactgcaacctccgcctcccaggttcaagcaattcttctgcctcagcctcccgcgtaactgggattacaggcgcccgccaccacactcagctaatttttatatttttaatagagatggagttttgccatgttggccaggctggttccaaactcctgacctcaggtgatccacccacctcggcctcccaaggtgctgggattacaggcgtgagccaccgggcctggccgagatggggtttcaacatcttgtccaggttggtcttgaactcctgggctcaggtgattttcccaacttgccctcccagtgtgctgggattatagtcctgagcctccaggcccagccatctctacactatccttgcaaattttttgtaaatcaaaaatattctaaagcaaaaatttattgagaaaaatatacacatacatatcacatgtacacacatacacatagttgcagaaaagggaacagaagaaaaaatagtttaaaaaacctttttgtttttccattaaatattctttaataaatatgtactactttgaacataaaaaatgcttttctttaaactatgagaatagaaaatgcttatttgtttgaaatgtaaccctggctttctctttctactgtattctacccattactattctatattttgtattttattatattattactatttttgagacaggatctcactctgtcacccaggctgagtgcagtggcatgatcacagctcactgcagccttgacccccccaggctcaagtgatcctcccacctcagcctcctgagcagctggggctataggtgagtgacaccacacctggataattttttgttttttgtagacagggtcttaccatattgcccaggctggtcttgaactcctgggctcaactgatccttccacctcagcctcctgattagctgggactataggtgcgtgccaccacatttggttcatttcttatgttttgtacacagggtctcgccatactgcccaggctggtcttcaactcctgggctcaagtgatcctctcacctcagtctcccaaagtgttgggattacaggtgcgagccgctacgctcagccttttttatttttatttatttatttatttgagtcagaatctagctctgtcacccaggctggagtgcaatggtgagatcttggctcactgcaacctccgcatcccgggttcaagcaattctcctgcctcagcctccagagtagctgggattagaggtgcccgccaccactcccagctagtgtgtgtgtgtgtttagtaaagacaaggtttcaccatattggtcaggctggtcttgaactcctgacctcgtgatccacccacctctgcctcccaaagtgctgggattacaggggtgagccaccacacccagccagcctattttattttattttattttgagacagggtctcgctctggtgctggagtgcagtggcatgaggttgcttactgcagccccaaccttttgcgctcgagtgatcctcccacctcagccttctgagtagctgggatcataggcacgtcctaccatgcccagccaatttttagttgttgtttacagacacagtgtctcttcctaatgcagtctcccttagtatctcactggtctttaagtaaaaaagaaaaaatttaaaaattggaataacaaaagatatgtggtctccctgtgttccccaagctggtcttgaactcctgggctcaagcaatcctcctgcttcggcctcccaaagtgctaggattacaggtgtgagacactgcacctggcctactcttctataataagagtctcatctttctcttatgttgaacgtgatacagatactgggttctttttaacttttttttttatttgagatggagtctcgctctgtcgcccaggctggagtgcagcggcgcgatctcggctcactgcaagctccacctcctaggttcacgccattctcctgcctcagcctcccaagtagctgggattacaggcgcccgctgccacgcccggctaattttttgtatttttagtagagacggggtttcgctgtgttagccaggatggtctcgatctcctgacctcttgatccgcccgcctcggcctcccaaagtgctgggattacaggagtgagccaccgcgcctgtcatctttttaacattttttaaggaattcttatttgccatgagccaaggaatgcacagagactagattcccatggacagctcactcctaccgaacacatacaatgggacacacctgtgctgggtgaaaggcgcagcctagagggctggcaggtgttgggtgaggctcaggtttcaggctgaggggaggagggtcagctggcagatcctcagcaactctggcagcctcacagggccacagcccccctggagctcttggttcccccagggtcaaaccaggtctcagtcatggagctaggatcaagctttcctaccctcctcagtaggaggcccccttcttcccaggagggagagctaggggaagggagatagtggagggtgagggaacggcattcgcatttgtaagcagtgccctggagctgcatgctggagataagagaaggcccctcccgaggctgggagcagagggagctgcagcctgaggcttgggcaggacaggtgaacccaggtttcccaaccactgaatcaccctttgccccaccacgcacatgcgctcttgcgtgtggacgcacgtgcacacacacgcacaccccacagcttccacgtggcaatgtgtctaagcccaagatcctggacagcccagacacagaactgccatgagaacccacagcagtcccactcgggagccctcatcagcactgctgagtgccaaccgaacaacagtgagaacgagaacacagacccttatcctgggaccacacagttggcttctcaaggcttcatgaaattcttctttttattttttctttgagacacagtcttgctctgtcacctaggctggagtgcagtggcgtgatcctggcttactgcaacctctgcttcccaggctcaaacaattctcatgcctcagcctcccaagtagcagggactacaggcatgtgtcaccacacccagctaattttgggggtattttttcttcttttttttttgagacagagtctcacaccatcacccaggctggagcgcagttgtgcgatctcggctcactgcaacctctgtctcccagcttcaagcaattctcctgcctcagcctcccaagtagctgggattacaggcacctgccaccacctgctaattttttgtatttttagtagagacggggtttcactatgttggccaagctggtctcaaactcctgacctcgtgatccacatgcctcagcctcccaaagtgctgggattacaggcatgagccaccgcgcccagcctaatttttgtatttttagtagagatggggtttctccatgttggccaggctggtctcaaactcctggcctcaagtgatccgcccaccttggcctcccaaagtgctgggattacaagtgtaagccactgtgcctggcctaaattcttctttagcatcatgcaatctgccttaattgagaaatgttatcacgaaaacccacatgaaactcaatattgcacttactgtaggagctattattggaagctagtgatcctgagaacttgcctagagtttcagtgcaagaaaaggctggcttcggctgggtgcagtggctctcgcctgtaatcctagcactctgggaggccgaggcgggtggatcatgaggtcaggagatcgagaccatcctggctaacatgatgaaaccccgtctctactaaaaatacaaaaaaaaaaaaaaaaaaaaaaaaaagctgggcatggtggcgagtgcctgtagtcccagctactcgggaggctgaggcaggagaatggcgtgaacccgggaggcggagtttgcagtgagccaagatcgtgccacggcactccagcctgggcgacagggcaagactccgtctcaaaaaaagaaaaaaaaaagaaaaggctggcttctcctgattaatggtcatcttatttttgacacaatttgtaataacttttttttttgagacagaatcttgctctgttgcccaggctggagtgcagtggcgtgatctgggctcactgcaagctctgcctcctgggttcacaccattctcctgcctcagcctcctgggtagctgggactacaggcacccgccaccatgcctggctacttttttgtattttttagtagagacggggtttcaccatgttagccaggatggcctcggtctcctgaccttgtgatccacccgcctcggcctccccgagtgctgggatcacaggcgtgagccaccgcacctgccacgtagagcctattttcttatccataaaacaatacctacttcacggggttgttctgaggattaagacaatctatgtaaaataattagccaatacacaacctatagcatgctcagtaaatggtagctggtataacaattatgggtttcttgtttgtttttttgtttgagatgcagtctggctgttgcccaggctggtcttaaattcctgggctcaagcagtcctcccgcctcggcctcccaaagtgttgggattatgagcacgagccaccacatccggataaaggaagtccctgtccgggatcacctgaggctaaagagagctgcgtcacccaacgtcatgctccccctagggacagctgcattcctgacaagggccatcccagctccagagagtcactcctattgagagatttgctgaggcctttgtttcctgagctccaggccgacgtcccctaatcctgcagccctgcctcctcacaggtattaatcctgagggcattttttttctttctttttgggcggggggcggggggggcacgaggttttgctcttactgcccaggctagagtgcaatggcacaatcttcactcactgcaacttccaactcccgggttcaagcgattgtcctgcctccgcctcctgagtagctggggttacaagcatgcgccaccgcgcccagctaattttgtatttttagtagagatggggtttcaccatgttggtcaggctggtcttgaactgctgacctcaggtgactcacccaccttggcctcccaaagtgctgggattacaggcatgagccacagtgcccggcctcctgagggcatctttaataaacttcctgatcacaaatctccctcttggtctgcttcccagacacccaacctctgtctgttgtaaggagaggttattaaatggccctgtctctgacagtctaatgtatttctctccacaatggcatgtaccctcctagttcccctgagagtacactgtcttcttggggatgcatctagacctggtaatttctagaaactgatcgaagttagagactgggagaaaatacagaaatcctaatcctggccgggcgcggtggctcacgcttgtaatcccagcactttggaggccgaggcgggcggatcacgaggtcaggagatggagaccatcctggctaacgcggtgaaaccccacctctattaaaaatacaaaaagttagccgggcgtggtggcgggcgcctgtagtcccagctattcgggaggctgaggcaggagaatggcgtgaacccgggaggcggagcctgcagtgagccgagatcacgccagtgcactccagcctgggccacagagtgagactccgtctcaaaaaaaaaaaaaaaaaagaaatcctaatcgttcctgcaccaattcccatccttacttcctacttcgccctgcccaaatgaaaaaatacaaaaattagctggtcgtggtggcgggcacctgtaatcccagctactcgggaggctgaggcaggagaatcgcttgaacccaggaggcggagcttgcagtgagccgagatcgcgccactgcactccagcctgggcaacaaagagcaaaactccgtctcaaaaaaaaacacaaaagattacaactccaagaccagcctgggcaacatggtgaaaccctgtctcgacaaaaacacagacattagcctggtgtggtggtgtgtgcctgtggtcccagctattcaggaggctgaggtgggaggcagaggttgcagtgagccaagatcatgccactgcactgtagcctgggcgatggagcgagaccctatagtaacaaaacaaaacaacaacaaaaaaattccacaaacgactaaagaggaacaaaccaatcagacttctcagaagtacttggcactgaacttttcaaaggatccttaccaaaatcgagcttttttgttttccctctgaagtctcatgttaagcaagaggggaaaacccagtgtctgcctggggtaagaaaagtcgcaaaagtcttcaaaggtcatcaaggttttaaatgttcacagtaatgagtttcttttttttttcttttttttttttgagatggagtcttgctctgtcgcccaggctagagtgtagtggcatgattttggctcactgcaacctccacctcctgagttcaagcgattctcctgcctcagcctcccgagtagctgggactacaggcacccactaccatgcccaactaattttttgtatttctagtagagacggggtttcaccgtgttagccaggatggtctcgatctcctgatctcatgatccacctgcctcggcttctcaaagtgctgggattacaggcgtgagccaccacgcctggctccaagtttcttcatggagctctatctgcaaggatctgagtcgagagggcacacacacaggaggcaaattcacgacctgaaccaaggcccattctcctgagagactttcaggtcactgacgtagctacagatattggaaaaaaatgcatctgtagtagttcagttgaggagaggggatgggtggcagtaaatcttaaggggctcaggggcatctattccaaatttccagagagggtcctcacagtctgtcattgcatatacatcaaatgtaaatgtatccttaggggggtttttggttttgttttcagagacagagtctcactctgttgcccaggctggagtgcagtggtacaatcacagctcactacagccttcaactcctgggctcgagggatcctcgcacctaagcctcctcaggagctgggactataagggcatgggccaccacacccagctaatttttaatttttttatttgtgatatggtcttgatctgtcatccaggctggagtgcagtggcatgatcacagctcactacggccttgacctcctgggtccacctcaacctcccaagtagctgggactacaggtgcatgccatcatgcctgtgtttcattatatatatatatgttgagagagagagagagagagagagagagagagtagagagagagagtagatatggggtttcaccattttgcccaggctggtcttgaactcctgggctcaagcaatcctcttgcctcagcctcccaaagtggtgggattacaggagtgagccaccacacccagagaatttttaaattttttgtggcgatggagtctcgctctgttgcccaggcttgtttcaaactccgagcctcaagcaatcctcccaccttggcctcccaaagcactgggatgacaggtgtgagacagcatgcccaggcatgaatgtgtctttaaacataccttttactttctttttttttttttttaactgtagtcataatagctatttacttgggtaaaattttctcaggatatttttggtatgtggggcagagggagagctagcaagtgagagaagctgtcttttcagtacaaagagctcacagtactccggtctccactggaagttccgtctttatttttaaaggaatctggtcatgagtctgttgaccaagcacatcctggtaatctattgtcagatgagaagtgttctggatttccaacttataccatgcatgatagatgctgagtttcaagcataaaactactctagttaccaagatcatactgcttttatgttgatataacttaattttattatttgcttcacctcccaccagaatcacttatttgctcacttttcttgtctatgctctagaatgcacttactgcttaagcggcatattatatgaaccatccttttacattatagtttattaaaaagtggcttttgccgagtgtggtggctcacgcctgtcatcccagcactttgggaggccgagacaggtggatcacgaggtcaggagatcgagaccatcctggctaacacagtgaaaccccgtctctactaaaaatacaaaaaattagccgggtgtggtggcgggcgcctgtagtcccagctactcgggaggctgaggcaggagaatggtgtgaacccgggaggcagagcttgcagtaagccgagattgcgctactgcactccagcctgggcaacagagcgagactgtctcaaaaaaaaaaaaagaagtgtcttttcttttttcttttttctttttgagacagggtctcactcacccaggctggagtgcagtggcgtgaacttgggagcctcgacatctgggctcaagccatcctcccacctcagcctcccgaatagctgggactacaggcacacaccatcacacccaccctgctaatttatattttgtagagacaggattttaccatgtttcccaggctggtcttgaagtcccaggctcaactgatcagcccaccttggcctcccaaattgctgagattacagacgtgagcctctgcgcctgcccaaagcagctgttcttttgcaaggatttattggtctgtggtgcctctccctcagtacccttgcgtggttcttttctttttttcttttttgtttactggagctacccaccatgaactattggttggttatttataaaaatatgtttaggtttatgcacatcattatatttatttgcccacgtgggccccttgagcatcagagcttcctaaagcaggatctttgcaggccatctcatccctcctcatcatgtatggatacacaaaccgaggtccattgagtccttttgaagaaggatagctgcagctagctgaaggccaaggcaggtggatcacttgagcccacgaggttgaggctgcaataagctgtgttcttgccactgagagagagactctgccttaaaaaaaagtgcaagctgcaaagtggttgccttttgctgaggaggtgggtactgggagcagcaggaattgactggaaagaggcatgaggacacgttcctttttttcccttttttattttttattttattttttgagacagtctcgctctgtcacccaggttggagtgcaatggtgcgatcttggctcactgcaacctccacctcccaggttcgagtaattctcctgcttcagcctcctgagtagctgggattacaggtgcatgccaccatgccaactaatttttgttcccttttctattttttacatgtaataattatatatatatatatgtatgtattttttaagtgctatttttgttgcattaagagtatggctccccagggaccacaaaggccttttagaagcctccgtatgtatttataggttatcaacaacaacaacaacaaaaaaacctctgctgaaacatacgcaatagtgatttaagaagaaaaggaatttttcacattggatgagaaagaacttcccaagttagttgcctttacaaattcaaacatgacgggctatcggcttggagtgttttttaagagtgacgatgggaggcttatggtaagcccattgtttgacgtgacccaagcatggcctggttaattttgaccatgctcacagcagtggtagaagcaactagccacacagtaccgtacttgttctgaaacacccatctctacttgtgaaaaagtagaggatcattgaaggatcttaagaaaaatttctggaccatagcatatctctgcagcaaaagaaaagtaacatatttgaatgtaaacaaaaacctgagactcacccccacaccccaatgctcaccacactcataagaaaggaagtgagaatgggaacccccaaaggcccacagaacctatatacaactgtctttctctgtgaaaacagatcagccccagaacctctatacgcctctctatgtgaaaacaataaatcagccccagaacctatatacacttgtctttctctgtgaaaacaatgaatcagccccagaacctatatacgcctctctttctatgtgaaaacaataaatcagccccagaacctatacacgcctctctttctatgtgaaaacaataaatcagccagagaacctatatacgcctctctttctatgtgaaaacaataaatcagccccagaacctatacacacctctctttctatgtgaaaacaataaatcagccagagaacctatatacgcctctctttcgatatgagaacaataaatcagccacagaacctatatatgcctctctttctatgtgagaacaataaatcagtcacagaacctatatacacctctctatgtgaaaacgataaatcagccaaagaacctatatacgcctctctttctctgtgaaaacaataaatcagccccagaacctatatatgcctctctttctctgtgaaaacaataaatcagccagagaacctatatatgcctctctttctctgtgaaaacaataaatcagccagagaacgtatatacgcatctctttctatgtgaaaacaataaatcagccccagaacctatatgcgcctctctttctatgtgaaaacaataaatcagccccagaacctatatacgcctctctttctatgtaaatacgatagatcaggatgccagaaaatatgtgattgtccccttcacattaccttcctaattaatgattcaaaactttagcaatccataattttattttttttccttatacagggcctaccctgcttctagataatcccacaacagatactaaataaaaccttacacaattgaattgaaggaagtaagctttgtttgtgtagtacctgagtgagtttagagagtacaaacattgcccataactgagtataatagatatcacaagcatcttccctatatcacctcaaacataaaaataaaatgccaggagatttaacgatgtgaatgggaaagtccaaattataagccttttagaaaaaaactaaatagaaaagtatcttattacgttgggatagtaaatgattttttcctttcccaccccccacttttttttttttttgttggcagcctcctgagccagagtaggctcagagactccagttttttgtgtttttgtttgtttgtgttttgagacagagtcttgctctgtcacccaggctggagtgcagtggcgtgatcttggctcactgcaacctctgccttgtgggtttaagcgattctcctgcctcagcctcccgagtagctgggattacaggcacccaccactacacccagctaattttttgtatttttagtagagacggggtttcaccatgttggccaggctggtctcgatggtctcctgaccttgtgatctccctgcctcatgatccctcaccctcccaaagtgctgggattacaggtgtgagccaccgcgcccggccctgtttttgtttttaagtagagatggacctcggcctcgcaaaatgctgggattacagttgtgagccaccatgcctggctggaagtgattttcaaaatcagacataaaatgtgcaagccatacaagaaaattattgataaattttattctattaaaactcagaattgatatttattaaaagattccataaagaaagcaaaaatcaagctacaaacattttaacatacataatcaaaaaattatttgcatacaaaatatgttctaattctttaaaccatttatgtgtgttatatacactattctgaaaacaaaaaccagcacccaagacagacaaagcgtgtggagctagtgtggctaagttgaggcgggaaattaatgctgcaacaaagttactgactgtctccaacctgttttgtggtgttacacatgggcataataatagctccttcctcataaggctctcggagctataaaccacagtgtgtctaaaataccttgcccagggtctggcgcatggcaagagctcaaccaatggtgaatggttggaactataaataaataatcgtgtcagagccgagtgggaatcaaactcagctccttaagtcctccatgacctagacaggattgttccagaccatgtggcagaagttaaggggccttggtgatgaaggcaagaatgcccacactgtttctcctgttcctccctctttctgtccctgaggcagtagctgactccaaactgagtctcccacacatatccagcagggctcagcctcagggaatccataggattctgggggtggacctttgggaggagaaaccatctcaactaagacactttcctctctcgtcagcaaagatattcagagatggatagccgacttacatttttattttcttcattaattaatttttttgagacaggttctctttctgtcacctaggctggagtacagtggcaagatcactgctcactgcagcctcaacctccggggctccagtgatcctcttgcctcagcctctcaagtagctgggactacaggtgtgatgcccagctaatttgtttgtttctttgggttttagtagagatgaggtcttaccatgttgctcaggctgactgttccatgtcagcctcgcagagtgctgagattacaggcatgagccaccatgctgggccaatttacattttttaataggagaaaccaacttggccctaactcaggtgcactgaaaccaggaactcttactctgaataggtttagctcatgagataaattcccccaaattattggctcattcgtaaattgtctttttttttttttttttttttgagacggagtttcgctcctgttgcccaggctggagcgcaatggcgtgatctcggctcactgcaacctctgccccacaagttcaagcaattctcttgcctcagcctcccaggtagctgggattacaggcacctgccaccacgaccggctaatttttttgtattttcagtagagatggggtttcaccatgttggcaagactggtcttgaactccagacctcaggtgatccacccgtctcgtcctcccaaagtgctgggattacagctgtgagccactgtgccggccctttttttttttttttttttgagatggagtctttctctgttgcccaggctggagtgcagtggcacaatctcagctcactgcaacctccgcctcccgggttcaagcaattcttctgcctcagcctcccgagtagctgggattacaggcatgcaccaccatacccagctaatttttgtatttttagtagagatgcagtttcaccatattggccaggctggtcttgaactcctgacctcgtgatccgtccgccttagcctcccagactgctgggattacaggtgtgagccactgtgccaaattgtctattttatcacaattacatttatggatgttaagtaagatacaaaatacaaaaataaaaaggaagggactgaacaacaacaaaaagaatgattagaaggaggctggattccatcaagcgggtccaggtcagatgctgggggctccacgggcccttctccatggaaggactgaacccaatgcccctccctgctgggacggtggagctaggaagcttttcataacaggcccagtgcttggtgcccatggaggctagagcaaaaaaccttcatgggccaggcgtggtggctcacggctgtaatcccagcactttaggaggccgaggcaggcagatcacctgaggtcaggagttcgagaccagcctggctaacatggtgaaaacctgtctctactaaaaatccaaaaattggctgggcatggtggggtgcatctgtaatcccagctactcgggaggttgaggcaggagaatcacgaacccaggaggcggccaagatcacaccactgcactccagcctgggtggcagagtgagattccatctcaaaaataaaataaaatatttaaaccttcatgggatgagcagagacagccctgttcacccgttcttattgaattttgtgtcttagttttttattccaaaagcataatgtccacgtccatttcattctaagacactttgaggatttgtttgtgtcaggagcgcttagggccaggaggtttggttcctcttcaaaacactgagggaatgtggacttactgtagataagatttgggcgaagcagctccgacccgaaggacacaggccacgcagtcctagtaccccacagagccagcggccaggcatgagtcccagggatgggggcagacgccgcatccaccttgtgtcctaggagggatggggcacacgccgtatccaccttgtcgccctctcacagtcaagggctagagagcagaacccagaagtgggggccacgctgggtcccccagcctgtaggttggcatggggcttcctcagggactaagggagacccagaggtgaaagccaagaaatagcccccctctctcgtcctcttccaccctaactgaccccttggctcccagcccaggcaggcgcccgggaagaataagggctggacacgtgcaagagaaaaggaacatccaggctgcatctcccatgcggacagctgacaggaagccagaccgaagatcaagaagggggcaccctagtttccccaaacccacatggcaaataactgcaggccttctgcaggaagtgtcatgaaaggaagctgacccgcagaatcatcggctggtataataactgccttcctgtgagccactgctaaaattctgccactcttccagtctttaagccacacaagcattgccttctaagccaagggaagaatttactgtatcaggaaaatgtattgcaacatcattctcaggattaacatgtctctttaccttagatctttatttatctttctgccaggtgaccaaagtaggacctgaagaattatcctcacactctatcacaaaaaaaaaaaaaaaaaaaaaaaggctactgagctgagtggggtggtgcagccctgtaatcccagctactcaggatgccatggcaggagcaatgcttgcgtccaggagtttgagatcagcctgggcaatatagcgagaccacgtctctaaaaataaaaataagttactgtggagaatgaatgagtggctaatcccgtgttttgctgagggtttttagatgaccccaacttctcagaacctggctccgaagatcagtcatccccacagccagcccatgaccgtctctgcagtagggtgagctggcctttgggtggcttttggggaaactgcctttagctctacatgccacaaggatttgtaaaagcagctcccaagcaaaaccggagagcaaaacttgaggctccacggaagatacacgaccaacgccctgttccaggtaaacgtaaggccaggccagggtctcccatgtccccctacccaccagacctacacggaagatagcgccatggaagtggcatccagacatcgaaggggcaggagtcagggtggccccatctctccagcaggcaggagggccatgggggtcctggctgcaaagaggccaaggcccctccacttggagaggccttcagtgcccatttcagcagcctcgtccagtgctcctccagcttcagtatgtgcctgagtccccttggaatcgtgttaaaatacggactctgcctcagtggttttggggtggggcctcaggtgcagcctccgtgtcccagtcaacagttagggccaccatacttagcggcaagtcatctactcataggtaagtggtcagtaactaaggaggaccagtcaggccggatgcagctggaatatttctccccatcaagattcatggaacaaataatgatagcgaacaccaagaaagcacaaccaccgctctacaccctttacatgaactcatttaatcttcaaatccgccccaagaacaggtgactaatattatcctatttacagatgagaaaaccaagcacagagaggtcaggagactcacctaggctggtgagtagcaagctgggatttgaacccaggccacctggctctggagttgtgggtcttgacagatcccggtacttctgtacactggggctgtagaatgtgagcagttgcgcaagactcaggatggagtgtgttgtctcggccgggctgagacaaacatgtctgtgatctattatcagaatcttttcaaactatgatgagctctccaaagtttgtttcaaaatactgtaagccttccccctcaccaggcttggcccagaaaatatcttttatcgtcaaacgacttcaaaacttgtttgtattttaatagaagcttagtttcttaggaattctgaaacagtgtttaaaataatcagtatgggcttcaggaattttatcttgaacttcctcactctggggcacaggttgtattcatgtgcttcaaacgttgttgatctgtcttgtctgagtttgtggggaaacggggccgtgttaacctctcgtttgttgtttgatccatggccgtgtgtggtcacgggaggaactcgtggtggtggggctgatcgctggttcaaggatcagaataagaaggttccagtgctgctctgtctccagtttgctgtgtggcctgatcggcttatagcccttctcggggcctcagtttccccatctgtaccatgaaaggtctggctagatgctccgaagtgctggacgtggtgcgttcttgttgagggggtcttgatctttgtcagggtttccccaacagctgccaattttctgcatgattttcatgccgaagggtgactggttctagcaaagcaaggagcgcccagtgaaggcccaaatgcaggtgagaacttcgtggatgaacgagtgttgacagagatctgggcttcctctcggtggttctgggtcccttcaacttgttcccagcactcatctttcctcatgtggcccaagcaccttgatattttataacctgcttgacttcttccagttcctacttctagccccttgctagactccctcaccatctccctgctgcccaccacccctccgagtccacacttcttaccaggctcccaagccccacgtgttctgcggacatccccagaggcctcctcgccccccagcctgagcggcctctctaaccgcattttccttcttccccctgggcttccctgcgagccggcccactgcctggggtgcccgtcctcccttgcttgaccagtaaacgctgactcatccctcaagaccctccttgtgaaactgcctttgcaaaaaccgtaacagaaaattacgacagtgaacgagaccagacctatctgacctcatctttcttctaacctcgaaactgtccttcgtcattcctgggtgtaagctgaactctctttgggaagggatttagtgtatggtttatggaagagcccttcctagaaggctaaactgttcttttaaaacaaatgaaaggccaccagccagcaagtccagatgagagcggctggaattctaaatattcccagccattattccagaggccataggatttgcagcttccacagtgagtcttgaaggtaacttcactccaggagctgactcagcagaagagaacagtttccattccctgtgatttttttttttttttttttttgacatggagtctccctctgtcgcccaggctggagtgcagtggcacaatctcggctcactgcaacctctgcctcccgggttcaagcgattctcctgcctcatcctcctgagtagctgggactacaggcacacaccaccatgcccagctaatttttgtatttttagtagagatggggtttcaccatgttggccaggctggtcttgaactcctgacctcaggtgatctgcccgcctcggcctcccaaagtgctaggattacaggtgtgagccaccacgcctggacggtgactccctgtgatttcaccccctagccaaccagtcagcattccgattcacgggccccctacccaccaaattatccttaaaaactctgatcccaagttttccaggagacttatttgagtaataataaaactccggtctcctgcacagccggctctgagtgaatttctctttctctattgtaactgctctgtcttgataaatcagctctgtctagacagtgggcaaggtgaaccccttgggcggttacacttggagaagggttttccaaggagccttttatggtctgtcctggtaaagcaagttatccatcatttgtgcttccactggatctcatgctgatcaccgtgatttcagatccaccattttattcgtttggatgtgttcagctgcaagtaacagaccacctcactaacagtggcttaagcaatagagacatttaattatctctcagggctgggtgcagtggctcacgcctgtaatcccagcactttgggaggccgaggcaggcagatcacgtgaggtcaggagttcgagactagcccggccaacatggtgaaaccccgtctctactaaaaatacaaaaattagccaggtgtggtggtgcatgcctgtagtcccagctactcgggaggctgaggcaggagaatcgcttgaacccgggaggtggagcttgcggtgagctgagatcgtgccactgcactccagcctggcaacagagtgagactccatcttaaaaaagaataataatcctctctcggccatctggcagtggccccattagggttagttcttcaaggacctaggacctttcccttctattatccttagtgtgctgggtgtgtcttgcctcatggcaaccagatggtggctgcagcctcaagcatcacatcctcacacctcagcgtccaagaaggaagaaaggcagtgggggaaagcaccttttattcatgagtgtatctttttgtagacggaaaatccttactgtggagcacccagtagagatttccttatgtataattaattggccagtgccaagtcatgggcccaccaaccaagactaatcattgacaaggggaataggattgcatgattaatttcgaccagtcatgggtcatcccctgtgactaggtacattcaggcttctgtggtcaagaaataagagaaatgaactttgggtagatcattcggctccgttgaggtccatggaccaacaacattggcatcagctgagaatttgctagaaatgcagactctcaggccccaccttgcacccaatgaatccgaatctgcatttgaacaagatcctccaggtgattcgtacgcacccatagtctgagaagtgctatggttacccgagtcaaatcgtaagcgctagtgctttttttgttttgttttgttttgtttttttgagacggactcctgctctgtcacccaggctggagtgcagtggcgtgatcttggctcactgcaacctctgcctcctgggttcaagcgattccactgcctcagcctcccgagtagctgggactacaggcatgcaccaccacgcccggctaattttttgtgttttagtagagacggggtttcaccatgttggccaggatggtctcgaactcctgacctcatgatccacccgccttggcctcccaaagtgctgggattacaggcgtgagccaccgcacccagccaagcgctttttttcgtggagtcttactcttgtcacccaggctggagtgcagtggtccctatagggagtagggattatgtcttattgatctctatagggagctctatagggagcttagcatatatagggagtagggattatgccttattgatctctatagggagctctatagggagcttagcataataggttctccacaaagctgcttaagtaggtgagaaatgactttctgagtgtggactcctatacctgctcttggcctcttttcctacccttggtatctatccctgtacttcattgttttaatcaatatatttatttatttgtttgtttttgagatggaatttcactcttgttgcccaggctggaatgcaatggcgcaatcttggctcaacacaacctccgcctcccggttcaagtgattctcctacatcagcctcccgagtagctgggattacagacacctgccaccacacccggctaatttttgtatttttagtagagatggggtttcttcatgttggtcaggctggtctcaaactcccgacctcaggtgatccacctgcctcggcctcccaaagtgctgggattaccggtgtgagccactgcacctggcctatttattttattgtatttattttattttattttattttattttaattttgagatggggtcgcactctttcacccaggctggagtgcaagggagtgatcacagctcactgcagcctcaacctcctgggctcaagcgttcctcctacctcagcctctggagtagctgggaccacaggtgtgagcaaaccacatccagctaattatttatttttaaattctttttatttttttgtagagatggggtctcactttcttgcccaggctcatctcaaactcttgtgctcaagtgattctcccacccgggcctctcaaagtgctgggattatggcgtgagccaccgcacccagcctgcccctgcactttattagaggccccaattttctttctttctttcttccttttttttcagatggagtctcactctgtcgcccaggctggagtgcagtggcacgatcttggctcaccacaacctccgcctcctgggttcacgcgattctcctgcctcagcctcctgagtagctggaactacaggcgcacgccaccatgctgggctaatttttgtatttttactagagtcggggtttcactatgttggccaggctggtcttgaactcccgaccttgtgatccgcccacctcagcctcccaaagtgctgggattacaggcatgagtcaccgcgcctagactagatgctccaattttcacttcttgacctgaccaggcacctttaaatgtccacactcaagacctgactctctcaagtgcctgaagtcaaagacatcttttgtccttaaaaaacaaaattcctcccatagtctgcagttgtgaaaggtcctggcggtctggacatgtactcgctgttgatagtcctgttgtatgtgtagcttttgctggaaggtcctggcggtctggacacgtactcgctgttgacagtcctgttgtatgtgtagcttttgttgtgagctgcctcaaatgcttttttggaagtaggtgtggtataaataataaataaatgagtgaatatctggaagtgtggctgtttttatttaatcatgggagaatgtggttacctctgcgataagtccctctggctaagagtaaacaggatggcccggcccctgtctagaatctaaaagctgcaggctgatacagaggacgggcgtggtaggagctggtttgagactcgaccttcctttttggtgcagcttgctggttgtgtagtaggtgagtttcagagaggaaaaggtctgaagcctcatcactgccatcagagcaactgtctgtgtgatgaaaggatccctctgcctgggccttattttccgcaagcgaataacaaggaatttgggttagattgcctcaaaaggccctttgaacttggctgatgtgtgtgttttgagggagaggatctgtgaggtgcttcccagagtgagggtggggctgaccgtgcagggcaggggggacaggaaatagcaccctgaccgctttccttctcaaccacctgaggccgtggccgtctcacaggagctgggaaggagctgataagagggcttactggccccctgccataaaaggatgcagttcccactcttgaagctgttctgtcccgggcaggaggctcagcaacagagagcccctgacacccctgctctgtgcttttggcttgggggactgtcccctctgtgctccaagtggattcagtggccagcctcttccccacccagcctcaaccagcacagagcagccaggacagggcaggcagagggaggaaaagtttgcaaaagtggggtgcttggggcacagacaaccctcaggtgcctgggggatctgagggggctcctaagtgatgagaaagcagcaggggaggccccccccagtgccctggtcgaggagaagaggggctcacatttgctgtgctgcccaggctgtagtgcagtggtatgaccacggctcactgcagcctccatctcccagactcaagtgatcctccagccacaacctcctgagtagctgggactacaggcatgtgccaagatgcctggttaattttttattttaagtggagatggggtcttgctctcttgcccaggctggtctcaaactcctgggctcaagcgattccccaacctcagcttcccaaagtgctgggattgccggcatgagcaccacatccaccgcatcgctggctttgaagatgaagaagggagcgacaagccaaggaatacaggtgattgactgcctgtcattagcgcggtggctcacgcctgccattgcctgttgtccccgtcctctgtggccctcttggcttctgtatcactgtcacgcgtagcagggccaggcttgctgaactgaaccgaagcaagaagacaagggaagggctgtgggaagcgtccatcatgaggctccgtgtcctcctcccaggcctcgcctggcctcgcctcaattcacctcgggcagcagctcaacatgtgggatttcaagactaagcctgaagatcagccagaagcaagctcctcacccctgacctggccgttcccttccccgaggctttgtggccacagtcctagaagacggagacatgctttggactagcctccaggagtcagggcccttcaacaccatttttttttttttttgagagaggatctcactatattgcccaggctggccttgaactcctgcgctcaagagatcctcccacacagcctctcgaatagttggggcaacaggtgcccacgaccacaccagctccgtcgctcttcttgaatgtacctggaatcctggtctgaactgagcggttggctgaactttcctctctttttgcctctctccaggctgagagatgagccctgctaaggagcagattgctcagttatagaatatttacagtcttgtattgtagagaacagttcacaaagccccttctgcttatttcatttagttgctgccagtcagcaagatggatgccataatcatcatctccatgtcacagctgagaaaaccaaggctccgagagatctgagaaaaccaaggctcctggctgggcgtggtggctcacacctgtaatcccagcactttgggaggccgaggcgggtggatcaggaggtcagatcgagaccatcctggctaacatggtggaaccctgtctctactaaaaatacaaaaaattagctgggcatggtggttggcgcctgtagtcccagctacttgggaggttgaggcaggagaatggcgtgaacctgggaggtggagctggcggtgagctgagatcgcgccactgcattccagcctgggcgacagagcaagactccatctcaaaaaaaagaaaaaaagaaaaaaaagaaaaccaaggctctgagagatctcagaaaaccaaggctcagaaagatctgagaaaaccaaggctctgagagatctattttctgttgttgctgtaacaactgaacacaaatcgagcatcttaaaaccacacaaatggggtgggcacagtggctcatgcctgtaatcccagcactttgggaggccgaggctggtggatcacttgaggtcaggagttcaagaccaacctggccaacctggaaaaaccccatctctactaaaaatacaaaaattagccaggcgtggtggtgcacgcctgtagtgcagttactctggaggctgaggcaggagaatcgcttgaacccgggaggcagaggttgcagtgagctgagatcacgccattgcactccagcctgggtgacaagagcaaaactccatctcaaacaaaacaaaacaaaaaaccccacaaatgtattaggtcacagttctgtgggtgagaggtccaggcacagcacggctcactgctttacaagaccaaaatcaaggtataggccaggctgcctgcctttctggaggttctgggcatgaatccgcttccagtcctgtgagggctactggcagaattcagttgcgtgtggtgtgggacgaagggcttgtttcctgctggctgccacctgggggcctttctcagcttctagaggccacctgcagcccttggcttgtggctctgttccttcctctccaaagccagcgatggtggctgctgctcatgcttccaagctgtctggcatcctttgtgtcttacgtctcttctgcctttatccagagcgagttttccacttttgagggctcccgtgattagaccgggtccactgggataaccaaggataaaacctcactcacatttgcaaagtccactttgctgtgtggtataacacagtcacaagttctgggaattagggcacggacatccctggggaccatgattccgcctaccacagagtggcttccaaacctgtcgctaagctcgtaagtggcagaggtggaagctgaagatcctctggctgctgaactctttccaccacatccctgctgctttgggccatcatttacgtcaacccagctgagcccaggaagaagaccgtctcgagagagtatttctgcaggccctcggtcacccggactggctcctcaccccctgcgactgtcccagaagttctctggaagtcaaaactaattgatacaagatggggctgaggcaagtcgagggcctctgcctgtttctgttgtagaagcctccaggaaggcctcacatcgccggtagatgtcctgggtaccgcggagtgcacttcctttcccgtccagatcgggcagggtgaaagaatgagctggagattccgaaataaaccagcatccctgactgcggcagacacggcccctccaacgtctgcctctggtccgcagtaaaagtatatttattccttcccatcaggaacttccccctataagcagattggatgctacatacctttcactcattcacgattcattcactcatgatcgtacccctgctttgtgtggggcacattctagacactccagatctatcagtgaacagaagagacaggcctcatggagcctgcattctggttgtggcaaggagagggttgacagttataaataaacacagtatatgagttaatgatgtcatatgttagaataagagctattaaaaaaaagagagggtgacaggatacggggatcaggagtgctggtgggaatgcagacggcactgttaaacatgggggacagccgggcgtggtggctcaagcctgtagtcccagcactttgggaggccgaggcaggcggatcgcctgaggtcaggagttcgagaccagcctggccaacatggtgaaaccccatctctactaaaaatacaaaaaattagctgggtgtggtggtgggcacctgtaatcccagctactcaggaggctgaggcaggagaattgcttgaacccgggaggtggaggttacagtgagccaatatcacaccattgcactccagcctgggtgacaaaagcgagactctgtctcaaaaaatatatatacatatatgggggataaggtgtgtttcactgagaagatgaggtttgaacaaaaacttgaaggagagatgtagcgaaatggatacttgaggtgggagcattccacgtagagggggcagccatgcaaagtccctgaggcagaagcatgcttgacatattggaggaacagccaggagcccagtggattggagagcacagccactataaggacttggtttgagtggaacaggaaacccgggtggggctttggataaagcaacgacttgtcaaaagttcttgagtttccacggaatgctcacgcagggggcaggtggagcatcctggtcctgcggattctgctgataaaccggaggcaagacggatggctggctgggccaggtggaggctttctggaatgtagccttgggagaattgtggatgctgaggcaggtgggccctggcctcgggtcagctcatagatgagggagcggttgctgggccgtgcagattggcttgatatcgtaaaccaactggatgaggacagagattgatgctctccagggtctcacaagctgagccacagaaacaccccggcatccaagccaggagatgggaacgaccggctcccacatcagagaatcagcaacaagtcaagctttgtgagggggaatccaggtgaaaccgtgtaggtttcaccataagttaccagctacgaagccaagcaaaatcatgattgtcccggtggagctttaagtgagggagaccctgaggggtttgtgtcgattactttggacattaacaggccctgctggatggaagtggcacagggccagctatgtccagtgtaagatgtggtggaggcgttgccattccctttgtcccaggtgctgtcttgattatgttgatccacaaaaaccatgattacaggggctttcagagtttctttttttttcttttgtagagacgggctcttgccatgttgcctaggctggtctccaactcttgggctcaagagatcctcccaccttggcctctcaaagtgctgggattccaggcgcgagccaccatgcccagctccgagttccaaccccagctttctgtcttgcccctccaagcgcccttccccatgggaaactctttttgtgctccgcggataagaagctcttcttccttgagggtttcaggacagaggacactggggagaagatacctgtgtctctactgggcagctgctccagtcagtggtgtctggtggggccaaagccctgcctggagagcagagagctggacccaacagatgaacctcctgggaagctgcattcttgatggtaaatgaagagatcagaacctcacagggaggaaacaggcaatgccaatgacacctacatctatggcttgaagtgcagagagaaaagcacagaagaaaatatactaaaacatgagcaagttatatttccagggtgggggtttattggtaatattttttccttccttataattcatatgtattccaagtatatatttttcctatatctcaagtgctctgtaatgagaggaaaacaatgaaattattatatttataattatagtggcagaaaacgtaacttggtgtaaagaagaactccctgaatgaatggggactgacaaaaaaggggtcaccggccgggcacagtggctcacacctgtgatcccagccctttgggaggctgagatgagaggatcgcttgaggtcaggagttggagaccagctgggataacacagtagactctctctctctctcttttttttttttatggagtctctctttattacccaggcttgagggcagcggcacaatctcggcccactgcaacctccatctaccaggatcaagtgattctcctgcttcagcctcccgagtagctgggattacaggtgcacatcaccacatctggctgatttttgtatttttagtagagatggggtttcaccatgtcggccaggatggtcttgaacttttgacctcaagtgatctgcctgcctcggcctcccaaagtgctgggattacaggcgtgagcccccgtgcccggcccagaccatgtctctctaatttttttttaaatgagtcttcagtgaggaggctctgccacctctccgtccttgagagggacacacactgcagtgcctgggaggactggcacatgcttagaggcctgggggagagtggttcatctctctttaaaattattttactgtattttatttttttagagacaaggtctcactgtgttgccaaggttggtctcgaactcctgggctcaagggatccacccacctcagcctctcagagtgctgggattacgggcatgagccacagtgcctggcccatttttatctatttatttatttatttttattatttatttatttatttattgagacagacttttgctcttgtcgcccaggctggagtgcaatggcgccgacctcagctcactgcaacctccacctcctgggttcatggattctcctgcctcagcctccggagtagttgggattacaggcgtgcgcccccacgcccagctaatttttatatttttagtagaggcagggttttaccatattggtcaggctggtctcaaactcctgacctcaggagatccacctgcctcggcctcccaaagtgctgggattacaggcatgagccactgtgcccggccattttttaatgtttttatagagtcagggtctcactatgttgcccaagctggtctcaaacttctgggctcaagcgatcctcctgccttggcctcccgaagtgttgggattagaggcgtgagccaccgcccccagccaagtatgtctataactggggaagcctaaaccatgagccactgactgtctgttcccggcaaagtccagacgctgaagctgtgaaaagtcggctggaatgagctcggaggcccctccagcatggatcctctcgttccgggttccctgtggggtcagggctacggccaagatctctcactccagatcctctgactgtgtcccagtgccctggtcactgctcttctgggtttgaagggtcttgagtgttttcatggcctcttgtcaatagaagtatattttctgccctttcccagactgtcccaggagagacttctctgccctcttctccttctgaaacagtcctgtgcgtccctactctgctcagcttcatcccaataactcaggaagcaggaaacactcaggaagggcttactcagcactaagccctgggaaatagaggcgagcaagacaaggtccccatccttatggaacttactcgtaacgaagagaatttcaaacggtgaaaaatgtatgcgaagcaccggggagataggacagtgagtggctgtgcagagatactctaaatacatggcccagctcatcctctctgagcaggtgacattggaatcaagaatttcatttgctgagcacggtggcccacacctgtaatcccagcactttgggaggctgaggtgggaggatcacttgagcccaggagttccagacgagcctgggcaacatggagaaaccttgtctgtacaaaagatacaaaaattaggccgggcacagtggctcatgcctgtaatcccagcactttgtgaggccaaggtgggtgaatcacctgaactcaggagtttgagaccagcctggccaacatggtgaaaccccgtctctactaaaaatacaaacattagtcgggtgtggtggtgggtgcctgtaatcccagctactcgggaggctgaggcgggaaaatcgcttgaatccaggagtcggaggttgcagtgagccgagatcgtgccactgcactccagcctgggcaaagagtgagaccccatctaaaaaaaaaaaaaaattagccgggcgtggtagtgtgcacctgtactcccagctactcctgaggctgaggtgggaggaccccctgagcccaggaggttgaggctgcagtgagctgtgatcacaccactgcactccaacctgggtaacagtgagactgtctcaaataaaaagaaaggatatttcatgatacttctctgttgatgtgtgtccctccctttgtctgatggggtctgtgtcttagtacacatatctcagaggtcgcatagtgcctggtacatagacagagcttgcagatgtgaattgaatgcatggatggacagtgagaccgtggaggggatggtccaaccatcctctgcactgttcagacccatgaggagctctgagtccaggtccagggaggcagattcctccccagaacccctcgacttatcaccgaagagtgcataggagactggagaggttgaagagcttgccccactgcacagccagctgggcggcatagctccctggtgagctcagcacagcagtgggaaacagaggtgaagggcagagccttgaacttggctgtgttctctacccactgtgtgacctcaggcaactcacccagctctccagctttgagagttgggtaacttgcccgactctcattgggcacctacctcattgagttctgtaaggattaaatcgagataaaatatgtaaagaactcagcaggcaggtgggctgagaaaaagggagcagccagcatgtctgtttctgcagtgcctcaggcaccagggcctgccagtggccacagaaatggagttgacctcaccggctcccttccagtctcccaggctgtggggcagtgacaaccccaagcaggaggctggaggcacagacttccaagaaggaggagacgaggcatgctggtacattttccaccttactccaacccttcacccacatcctgacttcttcaaaagaattattgtataaacaatataaaggcattaaaaaaaactgcaaaggaaaaacgaaccacctatgatctcagcattcgagcccaacaaggttgttttcttcctgtctagttcttccagcttgtccaggcatgtacatattttatttcgctgtagtcagagtcattatttattttttgcttgtgtaatatttttatcataaatgttcattcacaatcctgtagtcttcataagtagaattttttttttcccccttcaggacagagtgttgctctcgtcgcccaggctggagggcaatggcgcaatctcggctcactgccacctccgcctcccgggttcaagggattctcctgcctcagcctcccagtagctggaactacaggcgtgcaccaccccatgcccatctaatttttgtatttttagtacagacagggtttcgccatattggccaggctggtctcagactcctggcctcaggtgatccacctgcctcggctttccaaagtgctggatgacaggcgtgagccactgcgcctggcccataagtagaatttttaatggcaacctgatatgccaccaagctgatgcgccatcagttatttcttcattattctcttgctggatattttcttctttttgctgttgaaggacaacatatttatacataattttaatttatttacttacttatttttgagacggagtctcagtgtattgcccaggctgatgtgcagtggagtgatctcggctcactgcaacctccacctcctgggttcaagcgattctcatgcttcagcctcctgagtagctgggaccacaggcatgtgccttcacacccagctaatttttgtatttttaccagataaacggtttcaccatgttggtcaggctggtctcgaactcctggcctcaagcgatccacctgtgttggcctcccaaagtgctgggattataggcgtgagccaccgcacccggccccaaattctttatggctacattgctccccagagtggaataatttacacttttctagcagcatgtgagtaccttccaaccaactcggcacgggcttttgtgctgttgatatggttgcatcttgtcagtttcatctggtacagtgtggtgttattcactgttgaacttcctctcgaataaaatttagttcatattttttgctcattatcagtttttgtttttgtttgagacagggtctggttctgttgccaggatggagtgctacggtgcgatctcagctcaccgcagccttgatctctcaggctcaagtaatcctcctaccttagccttctgggtaactaggactacaggcatgtgtcaccaggcctaggtaatttaaaaaaaaaatgtggccaggcatggtggctcacgcctgtaatcccagcactttgggaggctgaggcgggcagatcataaggtcaggagatcgagaccatcctggccaacatggtgaaaacctgtttctactaaaaatacaaaaattagctgagcatggtggcacatgcctgtagtcccagctacttgggaggctgaggcaggagaattgcttgaacccgggaggcagaggttgtagtgagccaagatcacaccactgcactccagcctgggcaacaagagcaaaactccgtccccaaaaaaaaaaaaaaatgtttagtagagacgaggtctcattatgttgcccagtctggcctcaaactcctgagctcaagttgatcctcccacttcagcctcccaaagtgctgggattacaggtctgagctaccatacctggcctagcttatcagtcttattagctatttatgaaccttgtcttttgtcattatttgctgcaagctcttcctccaaatctttttctttttcaaaattatatttttaaaaagttataaaagcaatacatgtttatggtagaaaatctgaaaaatagagaaaaagtcataaaatatatgccaccacttaaaattaacctttattatcctgtttgtctgtctgtttttgagacagggtctggcaccgtcccccaagctggagtgttgtgagtgtggttcccagcagccttgagctcctgggctcaacgatcctctggcatgagccgctgtgcctggtgttattatcctgtttcaaaaccagctgtgaaaagataatttgaccctattgggaaatgaagatatggactggttgttggatgatactgaggaatttttgttagttttgttgagggcgtaatagcagggtagatgtatgttttcaaaatcccttatcagtttacatgctcactggaatatttacaggaaaattcatgtgacgtcttggctttgcttttaaaaactccagcacacacacaaaaataaataaatgattggggaaaattagataaaaccaaattggcagtatttgttgatactagatgatggatatatgagtattcatttcattgttctctctacttttacgtacatttgaagttttctgtgacttacgtttaaaagttatcttctcaggaggactcccaggcttagcttgcctaaaattccaatcccatctccttggctgactttcatactcctcactcctgctttgtttttcctccttagcatttcatcacgacctgccacgctaaacgcgttcttaggtatctggtcatcttggcttcttacctctccccaactggaatgtgaactccctcaggaaggaattttactgttttcttcccgcccttgctatcaacagtgcctgagtattcaaatcattatcacatgaaaaacaaactcactgttaacatttttcttcggttttttgtttttttctgagacaggctctcactctgtcacccaggctggagtacaatggcatgatctcggctcactgcagcctcaacctcacaggctcaagagatcctcccacctcagcctcctgaatagctgggattgtaagcacgcatcgcaatattcggctaattgttattttctgtaaagacagggtgtcactctgttgcccaggcaggagtgcagtggtgccatcacgactcactgcagcctcaacctccgaggctcaagcgatcctcccaccccagcctcccacctcagactgtagtcatgagccaccatgcccagccaataaaaactttaaaagacctttctaaaccatcaaggttggaggcattaaggatttttgttgttgttactgctcatttcttttttcttttttctttttttttgagacagagtctcaccctgccccccaggctggaatacagtagagcgatctcagctcactgcaacctctgcctcctgggttcaagtgattctcccgcctcagcctcccaagtagctgggattacaggtgcccaccaccatccccggctaatttttgtatttttagtagagacggggtttcaccatgtttgccaggctggtctcgaactcctgacgtcaagtgatccacctacctcggcctcccaaagtgctgggtttacagtcctgagccacggcgcccgaccatcatttcttaacgagcatacattaaaatttccaggcagtcaaacttagtgactgctttacaaacatgaaatatcacaccaatatttaaagaaatgagcaaaacctgtttttaaaaatttacacacaccaaaaacgacatggaaaacctaggcccacttttaggatcgccctctagacaaaacaaataaggaaaggctaatctttgaggaaaatatcctataaaatatacctgaggggagaaagcccctatcatgaagaaatggttagagctattctgtttcccttgtggtacttttatcactctttaagagaatccatcacaggccttcaatctctagccagcctagacacagatgtgcgtgggccgacccagcaaggggcaggaggaaaacccctctgcttcctgtccccggcttctcccacttactcccccgccccccacctctgcccgtctaatggttccctgggccgactcggtcgccctgccagcctgtcctccttcactcaggcacacactgtttccacgcccgggagcctggctcacttgcagagctataaaaacagacatccaccaggcacggtggctcacgcctataatcccagcactttgggaggccaagatgggtggatcacctgaggttaggggttcgagaccagcctggccaacatggtgaaaccccatttctactaaaaatacaaaaaactagcctggcatcatgtcatgcgtctgtaatcccagctacttgggagactgaggcaggggaatcgcttgaacccgggaggcagaggttgcagtgaaccgagatcacaccactgcactccagcctgggcaacaagagcaaaactccatctcaaaaaaaaaaaaacaaaacaaaaacactcagacatcaggctggccgccgtggctcatgcctacaatcccagcactttgggaggccgaggcagggaggatcccttaagcccaggagttcaagatcagcctgggcaacacggcgaggccccgtctctactaaaaatacaacaaaattagctaggtgcagtggtgcttgtggtggtctcagctacttgggaggctgaggtgggaggatcacttgagcccagaaggcagacagaggttgcagcactgcactccagcctcggtgacagagtgtgactccaagtcacaggaaaacccaacaaaacacagacgccgcccccacctgctttgcccgactctgcagagtcccacccggatgatctgggggagggaaggagtttgtctttttcgaagccctctgtggttttcggatgagcggatttagggacagtctgcacatgtctttcactcctgctatggaccccagaacccaccacagtgcctggctaaattgcacgtgcttaaataaatatggaacaaatgaaccaactgacctcttttgatgttcccagccattctgtgaggcagaggatcaaatgggtattattgtccccatttgacagaggcccagagaggtgacaggaattccccaaggtcacagatggaggggcccgaggctgcctcccactaccaggctgatttccagaggcttaaggtgggggctgagtttaaggaggggaaaaagaaaaacacatccccttacctagtgggtagagaggagtaggggcaagggagagaaaagaggaaacgaaagaagaggggaaagaggaaagaagaaggggaaggttagagatgcctaaaagcatggaactggaggaaagacatcaaaataacaaagagcaagactagccgcgtggtggctcacgcccgtaatcccagcactttgggaggccaaggtgggcagatcatttaaggtcatgagttcaagaccagcctagccaacatggtgaaaccctgtttctactaacaatacaaaaaaattagctgggcgtggtggtacatgcctgttatcccagctactcgggagagtgaggcaggagattcacttgaccctgggaggcagagtttgcagtgagccgagatcatgccactgtactccagcctgggtgacagagtgagagtccttcgaaagagagagagagagaaagagagagagagaggaaagaaggaaggaaggaaagaaaagagagagagagagggagggagggaagggagggaaatgagggaagctaagagggggttgggctgcaaatcctatctctgggcagcgggtctgggcccctcgtccctgcagcaggtctgggcccctcgtccctgcagcgggtctgggcccctcgtccctgcagcgggtctgggcccctcgtccctgcagcaggtctgggccactcttccctgagtttgatgcttggtttggagtcagggctctgagcccagagtccctgtggaaaacacatccctccactgactatggcctctgtcccacaacctcccccctccccaggcctgtgtgtgtttagacagcttgccctgcatttttagaacaatttttaacttgtaggctgtacctgcggaaccagaatgtctggccaagacctgttacctaacagcctcagaccatttgggtgccaacagcaactgcagctctggcccaagccaggtgtgggctgacctagccagggagcggggaagtgaaaggaatgggtcccttcccactcagagggcggagcccccacttctggtgagagaaagctgagcagaatggatctaatctgattcctccacccagaagcccttaaaatgcagctttgttttaagccttcttgaagatttgggctagatctagaaaagaacctcaccacggaggatgtgcaaagtacaacacgtgaccccggagacggaagctcttctctacctccgtaaagatgatctctgatgaacagacatgatcatgcctggagaacagggatggacagtcccgcttctgaaagaccctgtctggctgatgattcatggtgcgccgggcagaccccaggccaagagaccccacccacagtacctgagtgctcagctgggaaccagaccagacctcaaaacaggtttgcagaattaagatgaggagctgagctcaacacagcctccgcagctccccagggcgggcctgagccgagggagagcccatggccatcagggtgctggaatgcatgtcacactgcattacgtgcattacgatccacgctgcaatgacagcccagagcgtggagaacccagagagggtggggagatggaatcccggcgagccagcgctggcagggaccacggggagcagctggtccagccgccggttttccaagagagaagactaagaagtgagtcacttgcccacagccacagagagaaggagggcaacgaggccggcaggtcagcagcgagcagttagttcaaggccttgagggcttccactaactttgaagggcgaggatgggcggagctctggaggccgccggggtaggttcgaggggagtgttcaagaagcctcttttttttttttttttttttttttttttttttttttgagacggagtcttgctctgtcacccaggctggagtgctgtggcgtgatatcggctcactgcaacccccacctcccaggttcaagaaattctcttgcatcagcctccggagtagctgggattacagacacccgccaccacacccggctaattgttgtatttttagtagagacggggtttcaccatgttggataggctggtctcaaactcttgacctcaggtgatccacccgccttggcctcccaaagtgttgggattacaggcctgagccaccacaacaagccaagaagccctttttgtagagttctaatcctgggtctgcggctgagccatggttgtgttcacaaagcagagcaatcaaccgggcatagggatggacctcctggggccaaaatggcggctgacatctccaccctgacctttcttctcaggttcccaaggttaccacccaaccctgccaactttcgcaccccgcaaggagcaagaccccgcccgctcaccacctgcctgtgcagccaacgggcctcgctgagctgccctgggccgctccctccattcacacagttggccctccctctccctgcctcccttcgcctaccccacgaactacttcatccctctgggccggcactgtagaagccccattgttcacatcgacctcccaattatctcctctttccctctccctctgctcctgcccagaccagccccccagcattgacctggatgcctgccacagcctcctccctggtctccggcctcccacctctgctcctcggtctcctctacccagccagtaactgcagagagcactaaagcacagtcctggcatctcacccccttaaccctggccacggcttcccagtgcctccaagataaagcaccaacacctgaggacagcaggtgagtcctcccggagctagctctcccccaccttcctgtcaccctctgccccaggctctgcccgtgctgctgccccctgaacccacacttccgtcttttgctttccctttccctgggatgctcttataccccctggccccctgggatatcttctcatctgttaagtctcaacccagagctgcttcctctgggaaaccctcattggtctcctcgggcagaggctggtgtttttctctcatgcgtcctcgggcagaggctggtgtttttctctcatgcgtcctcgggcagaggctggtgtttttctctcatatgcctgcaacagcctgggatttcctctctcagcgctttttttttttttaatcaaaaaaatttcgacggggagacaggatctcactatgttacccaggctggttgtgaactcctagcctcaggtgatcctcctgcctcggcctcccaaagtgctgggacgacaggcatgagccaccgtgtctggccctctcagcactcgctaccgagggtgttctaatacttcattcgcctgctgtgggaggcagcctctaagatgacgctcagtgatccctgcctcttggtatttcctgtgtaaaaccgtccccttgaatgtgggctgggctaattgactcactttttaatttatttttcagagacagttttaaatttatttttcattctattgcccaggctggagcacagtggcataatcatagctcactgcagcctcaaactcccgggctcaagtgattgcccaccttagcctccctagtagccaggaatccaggcgcacaccaccacgcctggctctgattgacagacgcacaccaccacacctggctctgattgacaggcacacaccaccacacctggctctgattgacaggcacacaccaccacacctggctctgattgacaggcgcacaccaccacgcctggctctgattgacaggcacacaccaccacagctggctctgattgacaggcacacaccaccacgcctggctctgactgacaggcgcacaccaccacgcctggctctgactgacaggcgcacaccaccacgcctggctctgactgacaggcgcacaccaccacgcctggctctgactgacaggcgcacaccaccacgcctggctctgattgacaggcacacaccaccacagctggctctgattgacaggcacacaccaccacgcctggctctgactgacaggcgcacaccaccacgcctggctctgattgattcacttcaaaccaggagaatctgtaactgcccatgtgctcttcttgcccaatgcccagttagagctgatttattacaacaggggaattgcaatagagaaagagtttaatacacgtagagccagcgaaatgggagaccagagttttattattactcaaatcagcctgccccaaaattcagaggcgaaggtctcttaaggagagtttggtgggcagggagctatgggacgtgtgctgctgatcagctgggggggcaatcacgggggtgtggaaattggcccttgtgctctgaggcagcctctgggtagtggccacagaggagctgctggtttgggtggggccttccggtcatcagtaacctgaaaccctgaaaagagatctcaaaaggccaatcttaggtcttacagtagtgatgttatttacaggagtcattggggaagttgcaaatcttgtgacttctcatgggaatcatctcacagcacccacatattcgcggaattcatgcccctttcctcctcttaacccagtggcctttggaatagtggctgggaatcatctcacggcacccacatcttcgtggaattcatgcccctgtcatccccctaacccggtggcctttcattagttttacaaaggcaatttagttttggaaagggctattatcatttaaactataaactacatttctcccaaacttagcttggcccacacctgtggatgaccaagggcaccagcctgaacaacacggtgaagcccctcatctactaataatacaaaaattacccgggcgctgtggcgtgcccctgtagtcccagctactcagggggctgaggcaggagaatggcatgaacccgggaggcggagctggcagtgagccgagatcacaccaccgcactccagcctgggcgacagagccagactccgtctcaaaaaaaaaaaacaaaaaacaagcagtgaatgtggatctaaacaaaatcacaacgtaactcaatcaggaggaagagaagggcagagagtttctgtgtggtggggacagggagaacaaaaatgagctacatcctcattgttcacagtgaaaactcaatagatttatctcaggctgggcacagtggctcacacctgtaatcccagcacttcgggaggttgaggccggctgaccactggagtccaggagttcgagaccagcctgggcaacataggaagaccccgtctctacaaataattttaaaaattagccaggtgtggtggtgcatgcccgcggtcccagctactcagaaggctgaggtaggaggatacctgagcccctggaggtcgaggctgcagtgagctaagatcacaccactgcactccagcctgggcgacagagagagacctgtctgaaaaaaaaaaaaaagaatcatctgaaaaaattgacagtggttgaaaatcattgacatgaggccaactaattaacagaaaaaaggcataaaactaatttacatgcacatagggagagtcagggtgcctgcgccccagtggggttcagaagctcatacagcatcctggcagcacagtttatgggaggcaggaaaagagggggataaaggattactagggaaagtaaatggatctaggaacagagatcagtttacatactattttgtggaaagttctgttcaagtttggttacattcctggctttacaaataattgctccttgtgggtctggaacttgaccaattaaaaaacttcaacttctttggggaaaggtcagagagacctcaaggcttcttcggtcccatatgtcaaagcaccatattctggggtattggtttctgagttccagcacctgtaaggagtagaaaaaggagtctgagttgcaaaggatgggggttttcacaccaagtaaactcataaaactatgttcaagtataactctattacaaattaaaatacaaatctaccacggctgggcacagtggctcacgcctgtaatcccaacacttcgggaggctgaggcgggcagatcacctgaggtcaggagtttgagaccagcctgaccaacatggagaaaccccgtctctactaaagatagaaaaattagccaggcacggtggtgtgcacctgtaatcccagctactcgggaggctgaggcagaggaattgctcgaacccaggaggtggaggttgaagtgagccgagatcgcaccactgcactccagcctgggtgacagagcgagactctgtctcaaaaaaaaaaaaaaatctaccacaatgtctacatatggaaggtgctccaaaagcgtgaaccattagaattcctatggaatgacgttttcatcaaacagcttttgctatacttacaggtggatgtgattgcaaacaacaaagcctgaactcagatggggaaagaatcagtggggatcatattgtgtcatgtccaagaggttcacagatcaaattcaggcatggctggatccaggcgttcacagcgtgccaacagagatcttgctgtctccatttcttggctccattcactgtgttgactttgctctcaaacaggctcctctcagaccttagcacactggcctccagcggttgcaggattctatactgctggcttagtgctcccaacagaaaaagagtgtctctacttggtagttgcaaccaaatgcctcagatagacactgacatggtttggctctgggtccccacccaaatctccagttgagtcctaatcctcagtgttggaggtggggcctggtgggaggtggttggatcatggggtggatttctcatgaatggtttggcaccatcctctcggtgctgttctccatagtgagttctcgagagatctggccgtttgaaagtgtgtggccccaccccctcgctctctctcttgcttctgctcctgccgtgtgaagtgcctgctcccgcttcgccttctgccatgattggaagtttcctgaggcctccccaaaagccgggaagaggccagcgtcatgcttcctatgcagcctgcagaactgtgagccaattaaacttcttcttttttttttttttgaaacggagtttcaaaaaaacaacggagctcttgttgcccaggctggagtgcaatagtgcaatggttgggattacaggcatgcaccaacacgcctggctaatttttgaatttttagtagagtacagacgaggtttcaccatgttggtcaggctggtctcgaactcccaacctcaggtgatctgcctgccccagcctcccaaagtgttgggattacaggcgtgagccaccacatctggccaattaaaatgatttcttcttttctttataaattacaccgtctcagggttttttttgttttgttttttgttttttgtttttagacggagtctcactctgtctcccaggctggagtgcagtgatgtgatctcagctcactgcaacctccgcctcctggattcaagcgattctcctgcctcggcctcccaagtagctgggaccacagtcacacaccaccacgcctggctaattctgtatttttaatagagacagggtctcaccatgttggccaggatggtctcgaactcctgacctcaggtgatccgcctgcctcagcctcccaaagtgctgggattacaggcgtgagccaccgcactcagccagtctcaggtatctttttacaccagtgtgagaacagactaatacagacactcattgatctggcttgggtcacatacccacccttgaacagattgccgtgaccaagggaatagagcacttggattggctaaatcccagtcctaagccgaccgctggaaccacggacaaagtgggggcagagtggtctcacaaagaaaaatatggatgcttttattagaaagagagaagacgctgcaaaaccaacaggtctcccctgtgtctgaagactgagactaggccaggcacgatgactcacacctgtaatcccagcacttcggggggcggaggcaggcgaatcacttgaggtcaggagttcaagaccagcctggccaacatggcgaaaccccatctatactaaaaatacacaaattagacagatgtgcttgtttgaacccagggagtgaaggttgcagttagctgagagtgcgccactgcactctagcctgggcaacagagtaagactctgtctcaaaaaaaaaaaaaaaaaaaaagactgagactgctgtttgccttcatcagcacagaagccgctagttaggaaccattctcctagcacacccactccctgtgcttcacaaaagcaggtcaatgtttacagaagtcccctcttcccacgtcttctcatcttcaggggaaactgttgcgaggaacagaggactggagagaccaatacgggaaacaggaggatgtttatttaaggtgcaccagctcagaggattcgtatccaaaaagctgagcattgaacaaagtcagggtttagcttatataggccagcgcaaaggctgtcaatcacacagtgacagcttctgtcatctacagcataactagtgacttggcacaacctgtgcccttgcatagcgggtaaccttgcagctgaggcaaaagaaaacaggaacttacaaatctgactaagtacaagcattggcaaacatagtcagaattattagttcagagaaggagagacagtcaaggaatttggttttggggattttttgtttttcaaccatgctcgggggtgtctggagcctattcttgcagcttttgcttctcagactaggtcaccgcgacctttttatagccttgcctgttactatccttaaagtaaataaatgcagtacttatgtttctttaaatttctgcctcaaaacaacactaattctcctgattgtctttcatgacagtttccagacctctcacttttctggctgtctttcctggatgctgagtaatgtcaaatgtggcactaaaattcagcacccagggctgaatgaagcttcaggtgtgccccgatcagcccagaggccagtggcatgctcagctcaattctgcttggcagcaaagccacttacagatgcactggcttttcaaacgactgaatgcattgttgactcttactcagcttgcagccaatatctttttttatgtgagctgtcatcaagccagggattcctcattctccattggtgcaactggctcttgaacctacatcaagaactttgtccgtgttcatttcacattgtaggtcttagtgcatttttgctgttctttgaggtgtttttgaatatagatcctgtcttcagtactaaccatctctccgggttttgcacaatctacccatttgaatggagacattcttaattttcatccaagaggataataaaataaatcagggtcaaggttaaaactcacaaccaggcgtggtggctcatgcctgtaaccccagcacttttgggagtccaaggcgggcagatcatttgaggtcgggagtttgaaaccaggctggccaacgtggtggaacccaccccccatctctactaaaaatacaaaaattagccgggtgtgctggcatgcaccggtagtcccagctactcatgagtctgaggcaggagaatggcttgaacccaggaggtggaggttacagtgagccgagatcgcgccactgcgctccagcctgggcgacagatcaagactctgtcacaaaaaaaaaaaaaaagaaaagaaaaggataaaactctgtcccaccacccaagcccacgtgacatgtggacaataattagcatattctggatgtgaagccaaatccctatggaacaaccaaactctattcgttttccagttttgccataacacgtaatcacaaactagatggcttaaaacaacagaaattcattctctcacagttctgccatcagaagtcctaagtcagcagggccatgctccttctgaggctctagggaagagtccttcctagcctccttctagcttttcagggttgttgtgtatccttgatattctgtgggccgtagctcatccttccatccctacctctatctccacataggggtccctcctcttacaagtcattgaatatagggcccaccctaatccattatgagtttatcttatttgattacatctgcaaagacccctatttccaaacaaggtcacatgcccagggactaagggttagaacttgaacataactttttggagagcacaattcaacccacaacacaagtaggatcagtttccgtctttctgtctccttgacctccaggctctgaagagcatctccatcagaaaacttgctgcagcctcgacctcctgagttcaagtgatcctcccacctcagcctcccaagtagctgggactacaggtccaggccaccatattcagctaatttttttattttttgtagagatggggtctctgttgcccagactggtcttgaactccttgtctcaagtgatcctcctcctttggctgggattacaggtgtgagccactgtgccctgcacttgctgacatccagatggccataggattccatgtacccctggcccccaacaccagtcaacctgatccactaacccagtctagagtggtggttgtcagcgggaactctgtgtggctgccctctccctttccaactctttgagattcagacaaaatctgccctgggggaggaggctggagactcctggttgtggaggatgcaggccatggagtgacttgctgaagagaatggcgtgagacagacctcagtgactttgggcttactcagcctcccttgcaactcattttcttcagctgtaaaatgtaaataataaaacctatccagctgggcgcggtggctcacgcctgtaatcccaacactttgggaggctgaggcaggcagatcacaaggccaggagttcaagaccagcctggccaacatagtgaaactctgtctctacaaaaatacaaaaattagctgggcgtagtggtgggaacctatagtctcagctacttgggaggctaaggcaggagaattgcttaaacccaggaggtggaggttgcagtgagctgagatccgtctaaagaaaaccaaaaagcaaaaaacctatcacctttatgaggattaaatgacatcacatttgtaaagtgcttagcccaggcagccgtgagtagcagtggtcgttgccaattgttgccgctgttagctgcttgggagtcagataaagctagatttgaatcagatcttttcttttgttttttttttgagggacggggtcttgctttgttacccaggctacagtgcagtggcaccatcatagcttattgtagtctcaaactcctgggctcaagtgatcctcctgcctcagcctctcaagtagctgggactacgggcgtgtgccactggcccaccaactatgaacccagattttctttttaaaaattgttttttaatttttttttttttgagacggagtttcgcttttgttgccaggctggagtgcaatggcacatctcggctcaccgcaacctccgcctcccgggttcaaacgattctcctgcttcagcctcctgagtagctgggattacaggcaggcgccaccacacccggctaattttgtatttttagtagagacggggtttctccatgttggtcaggctggtctcaaactcccaaccgcaggtaatctgccctcctcagcctcccaaagtgctgggattataggcgtgagccactgcgctcggcccagtttttaaattttttgtatattcttctcttttttccccataggttattggggtacaggtggtatttgctcacatgagtaagttcttttgtggtgatttgtgagatttgggtgcacccatcacccgagcaatatacactgaaccctatttgtagtcttttatccctccctccccccacactcttcccccaagtccccaaagtccattgtgtcattcttttttgctgttgttattttttgtttgttttttgtttttgtttttgagagagagtctcgctctgtcacccaggctggagtgcagtggtgcaatcttggcttattgtaacctctgcctcccaggttcaagcaattctcctgcctcagccttccatgtagctgggattacaggtgcatgccaccacacccagctaatttttgtatttttagttgagacggggtttcgccatattggccgggatggtctcgaactcctgacctcaggtgatccgcctgcctcggcttcccaaagtgctgggattacaggtgtgagccaccacacccagcctagatggcttttattatattgagatgtgtcccttctatgccgattttactgagagttttaatcataaagggatgctggattttgtcaaatgctttttctgcatctattgagatgatcgtgtgatttttgtttttaattctgtttatgtggtgtatcacatttattgacttacatatgttaaaccgtccctgcatccctggtatgaaacccacttgatcatggtggattatctttttgatatgttgttggattcggttggctaacattttgtgaaggattttagcatctatgttcatcagggatattggtctgtagttttctttttaggtcagttttctttttggttttcctggctttggtattagggtgatgctggttttagagaatgatttagggagcgttccgtctttctctatcttgtggaatagtttcagtaggattggtaccaattcttctttgaatgttggatagaattctgctgtgaatccatctggtcctggacttttttttgttggtaatttttaaattaccatttcaatcttgctgcttgctgttgttctgtttggggtatctaattcttcctgatttaagctaggaggattgtatttttccaggaatttacccatctcttcttggttttctagtttatgcatgcaaaggtgttcacagtagccttgaatcatctttggcatttctgtggtatcagttgtagtatctcctgttccgtttcttagtgagattatttggattttctctcctctctgtttttctttttcttttctttttctttcttcctttctttctttctttattattattatttttttgagatagaatctcactattgttgcccaggctggagtgcaatggcacgatctcagctcactgcaacctctgcttcctgggttcaagcgattctcccacctcagcttcccaagtagctgggattacaggcgcccaccaccacgctcagctaatttttgtattttgagtagagctggggtttggccatgttggccaggctggtctcaaactcctgacctcaggcgacccacctgcctcagcctcccaaagtgctgggattacaggcgtgagccgctgcgcccggccctcttcttttcttggttaatcttgctaatggtctatcaattttatttatcttttcaaagaaacagcttttggtttcatttatcttttgtaattttttgtttgtttgtttcaatttcatttagttctgctctgatcttggttatttcctttcttctgctgggtttgggtttggtttgttcttgtttctgtagttccttgaggtgtgaccttagattgcttgtgctctttcagacatttttttttttttagacagagtctggctctgtcgcccaggctggagtgcagtggcgcgatctcagctcactgcaagctccgcctcccgggttcacgccattctcctgcctcagcctcccgagtagctgggactacagatgcccgccaccgcgcctggctaattttttgtatttttagtagagatggggtttcaccgtgttagccgggatggtctcgatctcctgacctcgtgatccgcccccctcggccttccaaagtgctgggattacaggcgggagccactgcgcccggcctcagactttttgacgtaggtgtttagagccacgaactttcctcttagcactgcctttgctgtgtcccagaagttttgacaggttgtgtcactattgttgttcagtttgaagaattttttaatttccatcttgaattaatttttgacccaatgatcatccaggagcaggttatttaatttccatgtatttgcgtggttttgaaggttccttttggagttgatttccagttttattccactgtggccatgagagagtgcttgatagaatttcaattttcttatatttattgaggctcgttttgtggcctatcatatagtctatcttggagaaagttccatgtactgttgaatagaatgtgtattctgcggttgttgggtagaatgttctgcatatatgttaagtccgtttgtttcagggtatagttttaatccattgtttctttgttgactttctgtcttgatgacctgtctagtgctgtcagtggagtattgaagttccccactattactgtgttgctgtctatctcatttcttaggtctattagtcattgctttacaaatttgggagctccagtgttaggtgcatatatgtttaggattgtggtattttcctgttggacaaggcctttcaccattatatactgtccctctttgtcttttttaagtgctgttgctttaaagtttgttttgtctgatgaaagaatagctacccctgctcacttttggtgtccatttgcctgaaatgtctttttccagccctttaccttaagcttgtgcgggtccttatgtgttagacgagcatcctgaaggcagcagatagttggctggcgaattctgacccattgtgcaactctgtgtcttttaaatgcagcatttaggccattggcattcaatgttagtattgagatgtgaggtagcattccattcatcgtgctatttgttgtctatatggctcggttttttgtttttattttttaaattgtgtttttgtttcatacgtcctgtgagatttatgctttaaagaggttctgttttgatgtgtttccacgatttgtttcaaggtttagagctccttttagcagttcttgtagtgctggctgggtagtggcaaattctctcagcatttgtctggaaaagactgtatctttccttcatatatgaagcttagtttcactggatacaaaattcttggctgataattgttttgtttgaggaggctgaagataggacctgaatcccttctagcttgcagggtttctgctgagaaatctgctgttaatctgataggttttcctttataggttacctggtgcttttgcctcacagctcttaggattatttccttcgtcttgactttagataacctgatgactatgtgcctaggcgatgatctttttgcgatgaatttcccagatgttccttgagcttcttgtatttggatgtctaggtctctagcaaggccgggcacgttttcctcgattatttcctcaaatatgttttccaaactgttagatttctcttcttcctcgggaacaccaattattcttaggtttgggtgtttagcataatcccagaatccttggagcctttgttcatattttcttgttcttttttctttgtctctgttggattgggttaattcaaagaccttgtctttaagctctgaatttctttcttctgcttgtttgagtctattgctgagactttccagagcattttgcatttctattaggtgtgtccaatgtttcctgaagttttgattgtttttcatttatgctgcctatttcctggaatatttctcccttcacttcttgtatcatttttttccttacattggggttcgcctttctctggtgcctccctagttagcttaataactcacctcctgaattctttttcaggtaaaccagggatttttttcttggtttgggtccattgctggtgagctagtgtgattttttggaggtgttaaagaaccttgttttgagttggttttctggttccttctcattttggtagtctctgtcagagggaaggtctagggctcaaggctgctgttcagattcttttgtcccacggggtgttcccttgatgtagcactctcccccttttcctatggatgtggcttcctgaggacaagctatagcgattgttatctctcttctggatttagccacccagcacgtctaccaggctccaggctggtactggggttgtctgcactgagtcctgtgatgtgaactgtctgtgtgagtctctcagccatggataccagcacagtatttggggtgtctcatgggtcctgcaggagcgatctgcttccttcatggggtctgtgggtgctctcagctttcctgctttattcctgcagtcattccagagcaaaaattcactatgtgagtctccacagctgctctgtccatctgagtcacagctgcaatctagtcctgcctcccgtccgccatgatccctgtaactctctatttattattattaattattattactgagacagagtctcgctctgttgcccaggctggagtgcagtggcacagtctcagctcactgcaactccgcctcctggattcaagggattctcctgcctcagcttcccaagtagctgggattacaggtgtgtgccaccacgcctggctaatttttctactttttgtagagacaggacattgctttgttggccaggctggtctcgaactcctgacctcaggtgatctgcccacctcaacctcccaaagtgctgggattacaggcgtgagacatggcacccggcctgaacccagattttcaactgccccctgaagcaaatttctttttttttttttcactttgctcattttattttattcaatcctcacaacaacctaagaggtgtattataatcagcactagtttaaaaatatgaaaactgaggcttagagacattaaataatatgtttaaagtccttgagctaataggcagaggagctgtgattaaaaaccaggtttgatgacataatgtctacattcttaatctgtggtgttgaatttccaaacacatttaagtaattaagtcccataatgtttcacacaccacacaactctgagaggagtttctcacaacactcactgcagcccttcagtttcggcatctgtaaaacgagacacctgactaacccttaggctgctgtgagcgctcaggtcacccagcatggagcctggagtgagaaacctgttacagatgtttgcttcttcccttcccttctcctgtgaataaaaggggctgttcacctgacatggcctacccttaggaaactcaaggtgcctcttttttttttctgagacagagtcttgctctattgcccaggctggagtgcagtggcacgatcttggctcactacaacctctgcctcccggattcaagctattctcctgcctcagcctccccagtagccgggactacaggcacacgccaccacgtctggctaatttttgtatttttagtagagacagggtttcaccatattggccaggttggtctcgaactcctgacctcatgatccgcctgccttggcctcccaaagtgctgggattacaggcatgaaccatgatgtccagccatgaccactctcttttctatgtccctggggagagacctcgaattttatttggagcctgtctttataaagactctaaattgtggccaggcacagtggctcatgcctgtaatctgagcactttaggaagccgaggcgggtggaggtcaggagttagagaccagcctggccaacacggtgaagccccatctctactaaaaatacaaaaaattagctgcgtatggtgccgcacacctgtaatccccagctacttgggaggctgaggcaggagaatcgcttgaatctgggaggtggaggttgcagtgagccaagatgacaccactgcactccagcctgggcaacagagtaagactccatctcaaaaaaaaaaaaaaaagactctaaatagtgtttatatatggtgtatatatatatatatatctttgatgtatatctttgtccatcaggtcagcttgttctttcgaaaccctctccagtcactagttttgttgtcgttgttgttgtctgagacggagtttcgcgctcgtcacccaggctggactgcaatggcatgatcttggctcactgccacctccgcctcccaggttctagcaattcttctgcctcagcctcccaagtagctgggattacaggtgcgggccaccacacccagctaattttttgtattttgagtagagacggcgtttcactggttcagtgtttgtacgtgagtgcgttcccacaaatggcagtgtgtgctgtgcgtggtttggtaaccttcattgttttactccacagcttgttttgagagtcccctccattgaaacacgcacatctaatttgtccttcagttcgctggactccacgctgaacgtgccatgctccattgccccgtgagtaactccatgctcttgccggtttcacacggcctctcagagctggagcctttgttcaggagccctgggcagctttcaggaagctcttgggctcatcagcttcctctggctgaagccgccccagtggaatcatggggatttcttactttgaaggtggggccacccgcagactgtaaccggctggttcaagatcaaggacttccccaggccacctgcctcagaggcaagaaaggctcagctgagtcccagacactcctcgctgtggcccctccttcctccctgctgggcaggcccccctcaattctgtttgccagcagggcctagtaacactgaaagacgaaaagggaaataaaataaacacaattaataggctaaaggttactgaataaagtggcagcagtaaataaattgactactgtgcaaatacaaagacatgaagacatgaaacccctgctctaaatgaccactcaccaagagcaaggcctgggctggaggcagggagcacctccctaaggagcactccctctttcccggagtgagtcctccttctagatggaattcagtccgggttcctcttgagccacagtccctgttggggcctatctcagtggactcaagatcctgaacttcttccagattgctgactacacatttgagtcacccagagattaaaagaaaaaacaaataatttcccagtgatcaggagtaaatcagctggggcagggttggtgctatgaatgaccacactgatttgtacacttcactgatttgtagtgtttgctatttccgtcgtgtaaatactgccaacatggacaatcttcagttgctaatggtttactaactggcttgtaaatgaattcattcagtattcaagaaaatggcactacatttagaaacattttgtagcatttcttactttctaagaatttccaatagacaccatgatcactaaaaaatcataaccaggctgggggcagtggctcacgcctataattccaataatttgggagaccaaggagggaagatcacttgaggccaggagtttgagaccagcctgggcaacatagcaaagactccatctctacaaaaaaaaaaaaaaaaaaaaaaaaaaaaagttaggcagctggtggcaggcacctgtggtcccagctattcaggaggctgaagcaggaggatcacttgagcccaggaggttgaagttacactgagccgtgatcacaccactgcattccaaataaaaactaaattaaaatatatatatatatatatatatatattttttttttttttttttttttttttttttttctgagacagagtctagctctgtgtccagactggagtgcagtggcatgatctcggcaacctccacctcccaggttcaagtgattctcctgcctcagcctccggagtagctgggattacaggcgtctgccaccacgcccaggtaatttttgtatttttggtagagatggggtttcaccatgttggtcaggatggtctcgatctcctgacctcgtgatccacccaccttggcctcccaaagtgctgggaatacaggcgtgagccactgcgtctggcctaaaataaacttctaaaaaagaaaaattggccaggcacagtggcttatgcctgtagtcccagcactttgggaggtcgaggcagttggatcacctgaggtcaggagttcaagaccagcctgaccaacatggtgaaaccccgtctctactaaaaatacaaaaattagccaggcatggtagtgggcacctgtaatcccagctactcaggaggctcaggcaggagaattggttgcacctgggaggtggaggctgcagtgagccaagatcataccattgcagtccagcctgggcgacagagcaagacttcgtctcaaaaaaaaaaaaaaaaagggaaagaaaaattataaccaatcgacattcaataaattatttattggctgggcgcagtggctcatgcctgtaatcccagcactttgggaagccgaggtgggcagatcacatgaggtcaggagttcgagagcatcctggctaacatgatgaaaccctgtctctactaaaaatacaaaaattaggtgggcatggtagtgcgagcctgtagtcccagctacttgggacgctgaggctggagaatcatttgaacccgggaggcagaggttgaatgagccaagaatggcatcactgctctccagccgggacaacagagcaagattctgcctcaaggaaaaaaaaattcaataagttatttatttgtcaaataatttataaagcagctttctcaaagccctttcaaaaagtttacagcagccaagagtggtgactcatgtctgtaatcccagcactttgggaggccaaagtgggcagatcacctgaggtcatgggttcgagaccagcctgaccaacatggtgaaaccacgtttctactaaaaataccagaattagccaggcatgttggcatcagcctgtagttccagttacttgggaggctgaggcaggagaatcacttggacccaggaggcggaggctgcagtgagccaagatcatgccattgcactccagcctgggcaatggagcgagactctgtctcaaaaaaaaaaaaaattacagcaaaaaatacttgatgtgggccacaggtgtgttttaatatgcttgatctgatgtgcgagaggccctgagagggagtgtttccaggacctacagagggaatgagagaggagagtccctgctgtcgggaggtgggtgagaaaagctcctaccactgcagaaatcctcctgtaaggctcctcggcggctcaccaggcgattcctcagcgaagaaaggtgaggcagcttgcccagggtcacccggccagtctcaattgaggactgacaaccaaaatgagtgactgaggcaagtcttaatcactgaggtttattaagccacgttagggcgcttctgggaaaaacaagccacagacacatctgtggctgtttttcccaagaagttccaagttttgtatttgtacatttcttcctttttttttttctttttgatacggagtttcactcttgttgcccaggctggagtgcagtggcgcgatctcagctcactgcaacctccacctcccgggttcaagcgattctcctgcctcagcctcccgagtagctgggattacaggcatgagccaccacacccgactgatttttgtattcttagtagagacggggtttctccatttggtcaggctggtctcaaactcctgacctcaagtgatccacccacctcagcctcccaaagtgctgggatgacacctaggaagaggggcaggcgggcagtcaggcttaggcgaacactacattttatataagataaggtgaacatctgaaggtggaaatgagcgccactgcactcagcctggacaacagagcaagaccctgtctcaaagaaaaagagaagtgtgagtggtcctgatttttaaaattttcctttacaggactttggacactagaactaggcctctttccaaaacatgctgatactgaaggggtcacgctgaaggctgagggctagggcctttaaaggtggggcaccctcttccttctacccgtccttgaccctcagcagactacaggttgatctcccctttgccatgagtgcccaaggagggaacttgtgatctagcagtttcttgataatccccaaaaggctttaattactccatttccctgccacgcccagggcaggaggagggtgagcgggaaagctgtccaccttctgctaaacgggtcaggaggcatcgggagccacgtgggttgtggtttaggagcctgagctgctgatccccaggcaggcctacacaatgggagctgctccctgcagcccccgggccggcctgggttgcataacccatgaggtcagcccggcctgcggcagttgctttcccacaacggaggggccgctccccacctcctgcgggacccacagccctgggtctctttccagctttcctctttcactggcaaagctgcaggccccataaactggggaagggttgaggccctgcctctcctgaactgggcaagggtcgaggacttccccatgggtccaggcctccagcattacatcaggaggtagcctggggaggacagagcactgaatccctctggcatcagctcctctggccagccctgcacctgctctgtggggctagggcctggggaggtgtcccaaaatagcccgcaggggcccgggagctctggccttcaaggtcagacactagcactgagaatcctggtgaggctgtcttcccagaccccgcctggcaggccggctgggcacggctgcggagaaagacagggcaggctccccaggcactggcccccgcggcaacctctcctgtctctaaaatcggatgtagattaagaacgctccatctggcaagaccaaatggaattcggcagaagcataaccaggacactgggttttggatctgtgactctccacacatgcagaggacaaaaatacaagagaaaggggtcaggagagaggcgtatgatggggggcgggggtgtgatgtgtgtgttgtgtgggtgttgtgtgtctttatgatatgtgtgtgtacacctgtgttgtgttgtgtgtgtattgtatgtgttctgtgtgtctgttgtggtgtgtgttgtgtgtgtgtgatgtgtctgttgtgtggtgtttgtattggtgttgtatggtgtgtggtgtgtgtgtgtctgtgtgtgatgtgtctgttgtgtagtgtgtatgtatggggtggtgtgtgatgtgtgtgtctgttgtgtggtgtgtgtatgatgtatgtccgttgtgtggtgtgtggtgtgtctgttgtgtagtgtgtgtatatggggtggtgtgtggggtgtgtgtggtgtacgtgtgtttgttgtgtggtgtgtctgttgcatgatatgtgtatggggtggttgtggtgtgtgtctgttgtttggtgtgtgtgtgtgtgtgtgtgtgtctggggggttgtgtgctatatgatgtggggaatggacattgactcagtgtgtggtgttgtctgttgtgtgttgtggtgtgtgtatctgttgcgtgttgtgtggtgtgtggtgcgtgtgtgtgtctggggggttgtgtgctatatgatgtggggaatggacattgactcagtgtgtggtgttgtctgttgtgtgttgtgtgtgtgtgtctggggggttgtgtgctatatgatgtggggacattgactcagtgtgtggtgttgtctgttgtgtgttgtgtgtgtatctgttgtgtgttgtgtggtgtgtggtgtgtgtgtgtgtctggggggttgtgtgctatatgatgtggggaatggacgttgactctgtgcgtgtggtgtgtgtgcctgttgtgtgttgtgtggtgtggtgtgtgtgtgtgtctggggggttgtgtgctatatgatgtggggaatggacagtgactcagtgtgtgtggtgtgtgtctgttgtgtgatgtgtgttgtgtggtgcgtgtgtgtgtctggggggttgtgtactatatggtgtggggaatggacattgactctgtgtggctggaaagtgatctttcaagagaggattaaccaaaggaaatgggaaattgaggtcaggatggataaggaaaacatggggcaaactgggtggtcagagaaagacgaggatggcctctaggctccaagagcaccccagataaaaggctggaataggggcaggagagaagccccccgtacagagggttattccagggcctgagggcatcccctccaccccagaggagtgaaggtgggaggaagtgttttctgcttaagcattgggaataaacgtggctgccaacaacagaaaacttgactggcaggtgtaaagaaatagtggtttctttgtctcccagaataaaaaatctggaagtgggcagggctggcatctgtggggttcacttggcctttccccatggaaataagactgcagcagtttccgtatcaggagtcttttcaaagcaggaagaaggcggtctgtcctaggcaccctccttccacacaggtcccttggccagaacaggtcacgtggtttctcccagttgcaaggtaggccggggaagcacagggcagttgccatgatccgtggctcaccctggctgaccactctgttatgccccaaacaaaagcagtttcattagtaaggaagaaggggacatgaatatcgggaagccagtcatgccacacgagaccctggggagcaaacatttttccttttgttgttgttgtagagctgaggtctcacaatgtcacccaggctggtctcaaactcctggcctcaagcgatccccctgactctcaaaatgctgagattacatgcatgagccaccacacctggctgataaacattttcaataaaggctaaattcaggtaatataatctcctgccctgcccactgcacagacaaatcaatctcgaaagctcagaggtatttcaagaatagtttggtggctggatgcggtggttcacgcctgtaatcccagcactttgggaggccgaggcgggtggatcacctgaggtcaggagtttgagaccagcctgaccaacgtgatgaaaccccgtctctactaaaaatacaaaattagctggaggtggtagcggtggtgggcgcctgtaatcccagctactcaggagggtgacacaggagaatcgcttgaacccgggaggcggaggttgcaatgagccgagatcgtgcactccagcctcggtgacagagtgagactcagtctcaaaaaaaaaaaaaaaaaaagaatagtgaatagtttggtggacaggggctataggaaacggggaatgttggttggttgggaatgaaaccatacgggtgtggaacccggtcctctgtgtgtgtgtgtgtagactgcctctgtgtgggggccacaggaccaactgagtcatgagtctcaggttgagtggagtcagccagtcagaaatgcgaaaagtctgaaaagacatctcaaaacaccagtcttaggttttacaatggtgatgttagctacaggaacaattggggaaattgaaaatctcatgacctccagaacaatggctggttaccctttatgcctacatctcagcagaatccaggctcttctcataatcctgatcttgtgtgctttcattcattttataagggtggtttagtttggggaagggctattatcatccttgttttaaggttaaacaataaacaaaattcctctcaaagttaccttggcctaaacccggcaggaatgacccaggttggagactggaggtaagacagccaactatgtcaaatttctcttactgtcataattttattttattttatttatttattcatttatttattttgagacagagttttgctcttgttgcccaggctggagtgcaatggtgcaatctcagctcaccgcaacctctgcctctcgggttcaagtgattctcctgcctcagcctcccaagcagctgggattacaggcccgcgccaccacacctggctaattttgtatttttagtagagatggggtttctccatgttggtctccaggctggtctccaactcccgacctcaggtgatttgcccaccttggcctcccaaaatgctgggattacaggcatgagccactgcgcctggcctttatttatttatttatttatttatttttaattgaaagagacagggtctcactatgttacccaggctggtctcaaacacctgggcttaatcaatcctcctgcctcagcctctcaaagtgctgggattacaggcatgagccaccattcagccattggtttcaataatattccaaagttgatctgaaagagcctccagaaagctgtgaggccccacattgggaatgcgacccaaaaccccaaggtcggggtcctgacccatttgtgcgatcatctcagtcaacattaattgtcttggtcttcttagcaacctcacgatgacagaaatgctattatttcccttgctacagatgaaaaaggaggggctcagacaagttcagaaactaggtcaatggccgggcgtggtggctcacgtctgtaatcccagcactttgggaggccaaggcgggcagatcacctgaggtcaggagatcgagaccagcctggccaacatggtgaaaccccatctctactaaaaagacaaaaactagccaggcatggtggcctacgcctgtaaccccagctactctggaggctgaggcaggaggatcacttgaacccaggaggcagtggttgcagtgagctgaggtcacaccactgcactccagcctgggcaacagagggagactccatctcaaaaaaaaaaaaaaaagaaaaagaaaaaagaaactaggccaaggtcacaccggctgtgagtggcagagcaaggggtgctgtccgcagaatcctctcttttcaccacgtcaccctttgcaggaggagcacatatgggtcaagatgttacgggctcaaccagcgtggtggctcacacctggaatcccagcactttgggaggctgaggcaggtggatcacctgaggtcaggagttcaagaccagcgtggccaacatggtgaaaccctgtctctacaaaaaatacaaaaattagccgggcaataataataataataataataatgaagtgatgggctctaatccagaccctcctcgggttttcagtcctaaactctttggctactccttacaggaagttgtccagttacacatctctgatccttccccaggatcaaaacccaggaaggaggccttgaagccagacagaaccatgttcaaattcccactctactacttggcagtgtgtggccttgggcaagttacttggctctgagcctcctaagcaggggtaacccctttgagaggttgtaggattcaatgggagaccatggattagcgccaagaaatagcaggtgctccataaatatccgtgcctttctggggatacagccaagtggaaactcagccatggacgatacctgggctcctgggagccaacatcactttatttcccacattctgctaacaaaatccaattcgttataatcaggggtcatctgttttgctttcctttgccaataaaaaattgacttggcatgaagtcttcagtagttacttcagctaacatttgttgaacaccgtccaggagccaggcaccctgctgctcagaggctggccctggccctctgggagttcagagtctcactgcagaatggcacctgcaggcaaagaactctaaaacaaggcagggtagtgagagatgtgagccatacgttcaaaatgctgggacttcagagacagcagaggccacctgggtgtggcatgggcttggcatgcagtcctctggggctactgcggaaggggtgtcaccaggaccagctacagaacttatggggcccctttttcaaaaagttattaagaatcttggtaataggccaggcgcggcggctcacgcctgtaatcccagcactttgggaggccgaggccggctgatcacctgaggtcacgagttcgagaccagcctgaccaacatggagaaaccccgtctctactaaaaatacaaaattagctgggcgtggtggtgcatgcctgtaatcccagctacttgggaggctgaggcaggagaatcgcttgaacccgggaggcgcaggttgccatgagccgagattgcgccactgcactccagcctgggcaacgagagcgaaactccttatcaaaaaaataataataataataatttcagtgatagtagggcattaagccaaatgtagggccctctgagcatggcgccctgtaccaccacacaggccactgacccatgcagctggccctgggtgccgctattccatgaccccaggaggtcaggtgctgtccctctgggagaggcaggctcagggcagaccctgtgggagttgggccctcaggcctcatccaagctgctgaccatgcgtcacggctccctatttctgtgtgaggagaattgttcctgtctggtgactgtcatcaggagggtgactgtggatttccacaagccaggatggacggcaacttccccagcatgagaaagagccacccaggattggcttggggctgttgacagtggcctgtccctcgctatgtcatctgcctcaccacaaaccaccagcagaaggttcagaggccagggaaagagaggggagccactgggccaggcctgatggtgcacacctgtcatcccagcactttaggaggctgaggcaggaggacggcttggacccaggagttggagactagcctgggcaatgcaatgagaacctgtctctccaaaaaaaaaaaaaaaaaaaattaaaaacttagccagacatagtggtgcatgcctggagtcccagttactccgaaggctgaagtgggaggatcgtttgggcctgagagtttgaggctgcagtgagctctgatcacaccaccgcactccagcctgggcaacagagcaagaccctgtcgcaaaataaataaataattttttttttttttgagacagggtctcacgctgtcaccaaggctggagtgcggtggcgcgatctcggctcactccaacctctccctcctgggttcaagcgattctcctgcctcagcctcctgagtagctgggattacaggcgcccgccaccacactcgctcatttttttgtatttttagtagagatggggttttgccttgttggtcaggctaatctcaaactcctgacctcaaatgatccacccgcctcggcctcccaaagtgctgggattaaaggtgtgagccaccactcctggccataaaaatttttaaatgacattttttggctactgttaaaacaacaacaaaaacaggaactaagaagtatcggggaggatgcggagaaactgcgcccggtgcatcgctggtgcagaatcaaatggcgcagccgctgtggaaaccagtgtggtgggaggctcctcaaaacattaaacagacaattaccaaacaatctcgcaatcccgcttccgggtatatgccccaaacaactgaaagcagagtctcagagcagtatttgcacgcccacactcacacagcattaccacaagagcaaaaagatggaagcaactcaagcttcacggacggacaaacggatgaaccaaatgggttatatgcacaaaatggaatattatgcagccttaaaaaggaaggatattctgacacatgctgcaacgtggataagccttgagaacattatgctaagcgaaataagccagctacaaaaaagacaaatattgtatgattccacttatacgagtaatcaaattcccacaaacagaaagaaaaaagtggttgtcagggctgggaggagagggaaacaaggagttattgttcaatgggtgtaacatggcagtttttttgtttttggggggtggttttgagacagagcctccctctgtcacccaggccggagagcagtggtgcgatctcagctcgctgaaacctctgcctcacaggttggagcggttctcctgcctcagcctcccgagtagctggaattacaggcacgcaccaccacgcctggctaatttttgtatttttactagagatgggggagttccaccatgttggccaggctggtctcgaactcccaacctcaggtgatccgcccgcctcagcctcacaaagtgctgggattacaggcgtgagccaccgcacctggcccacattgcagttttgcaagagcgagacttctggagatggatggggtgatggttacacaacaatgtgaatgagcttaatgctactgatctgtacacttagaaatgactaagatagtacattttatgttatgtgtattttaccgcagttaaaaatgttgtaagtttaatgacttttgttttctgtatataaaaaaatatttattaaaaatcgtgagcccaggcacagtgactcatgcctgtaaactcagcactttaggaggccaaggggggaggatcacctgaggccaggagtttgagaccagcctaggcaacatagcaagaccctgcctctacaaaaaataaaacataaaaattagctgggcatggtagtgcacgcctgtagtcccagctactagggaagctgaagtggaaggaccgcctgagcccaggaggtcaaggacgcagtgagctgtaattgcaccactgcactccagcctgggaaaataaataaatataaataaatggcccaggcgcagtagctaatgcctgtaatcccaacactgggaggccaaggcaggcagattccttgaggccaggagttcgagaccagcctggccaacatggtaaaaccctgtctctactaaaaatacaaaaattagacaagcatggtggcacatgcctgtaatcccagctactcaggaggatgaggcacgagaattgcgtgagccggggaggcagaggttgcagtgagctgagatcctgccactgcactccagcctgggcaacagtgggaacctgtctcaaaaaaaaaaaaaataaatataataattaataaataaaaatcttgaatgtataggaaaaccgaaagagggctgggtgtgatggctcacacctgtaatcccagcactttgggaggctgaggcgggcggatcacctgaggtcgggagttcgagaccagcctgattgacatgagaaaccctgtctctactaaaaatacaaaattagccagctgtaatcccagctactcgggaggctgaggcaggagaatcgcttgaacttgggaggtggaggttgcggtgagctgagatcgcgccactgcactccagcctgggcaagaagagcgaaactccatctcaaaagaaaagaaaagaaaagaaaaatccaaagaggcaaagatgtaatatctctcttatattatacataaatactcataaagaaataaaagtacctgtaactctactacccagagacaactgctgctaaagacatgatctacttcctcctgtatttggaacacacacaggtgtgtacctctctccagccatctataattcagatcagttcaacagctatagttatgtatactctatttcctcctgtatttggaacacacacaggtgtgtacctctctccagccatctataatttagatcagttcaacagctatagttatgtatactctatttcctcctgtatttggaacacacacaggtgtgtacctatctccagccatctataattcagatcagttcaatagctatagttatgtatactctatttcctcctgtatttggaacacacacaggtgtgtacctatctccagccatctataattcagatcagttcaataactacagttatgtacactactttctcacttcatgtattataagtatttctaaaatctcctgtaatatgatttttagtggcttcctggtatttgatcatatggacataatgttcaactaatcttctatttctgaacatttaggtcgtttaaagtttttccgtgttttaaacaatactgtgatgtacatccttatgtatatactgttatccatatttctcgaactcctgacctcaggtgattcgcccgccttggcctccaaaagcgctggggttacaggtgtgagccaccacaccccgccctgttatccatatttctgatcatttccttagggtgatttcccacaagacatttcaccgagtcaaagactgagtgtcttgaggccaggggcacgtacggatcgggccctcctgatgacagggccgcgtctggcccagtgctctgtgctctgtgctctgtcccctccaggcttctaaggccccagactttctctcctttgactttggctagattcgactcccgtaagtgctggcgaacgaaaagttctggaatgtaagcaaaatggggcccccgtgtccatatgggctaactctgtaggctcaaatgaaatcttttttttttttttttttttgagacagagtttcgcccttgtcactcaggatggagtacaatggcgtgatctcggctcactgcaacctccacctcctgtgttcaagcaattctcctgcctcagcctcccaagtaactgggattacaggcatgcaccaccacatccagctaatttttgtatttttagtagcgatggggtttcaccatgttggccaggctggtctcaaactcctgacctcaagtgatccacctgccttggcctcccaaagggctgggattacaggcttgagccacctcgcccggccctcaaatgacatcttaaggccgggtatagcagcttacacctataatcccagaactctggggggctgaggcaggtggatcacttgagcccaggagttcaagaccagcctaggcaacatggtgaaatcttgtctctacaaaaaatacaaaaattcactgggcatggtggcatgcgcctgtagtaccacctacttgggaggctgaggtgggaggatcacctgagcccgtgaggttgaggctgcagtgagctgtgattgcaccactgcactctagcctaggtgacagagagagactctgttgaaaggaagagagagagagagagaggcagagagagagaaagaaagaacaaaaagaaaagaaagagagagaaagaaaatttacaaaaaaactcaatttctgttgcaggaagaggcttagagattgcctcctcccactctttcattttatgaagcagaaaaatgagggccacacatggcatcagctattcccgtttcttgatggacagactgagctggaactggcttggtccatcaccccagggagtaatggctggcttaacagcccacagcaaattctgtggttcactggaccaagcagcaggttccaggacagctgtggggtcagttggggccatctttggactcagcctgagtgtcagctgtctcatgcccacatcctggcactcacaggagccagtaaaactctctccagggcagtggctgcgaccctgtctcctaaactcagaaaaccaggtcctaactttggggacttgcggggaagggtgggagggggtcgggggataaaagactacaaatagagtgcagcgtatagtgcttgggtgatggttgcacccaaatctcacaaatcaccacgaaagaacttactcatgtgaccaaatagcacccgtaccccaataacctatgggaacattcaaaagaaaaagaaaaccgtgtcctagtctcctcagccagtggggcggtgtgtggtgggtggtctgcacttggtcccagagaggtcaatgagacccagacttgcctgtgaaagaaacggagtggtggcggggcccgggaaaaacccctgcgttcactcgttcactcggcgcctgctgtgtggcaggcagcccccctgctgggctcgctcagtcctcggtaccatcctgggagcaggcattagcccccttttgcagatgagcctccgaaaaggtgaagaacttgaccaagggtcaaactgagcaaatggcagagtcaggcccctaccccggctgaccacccaatgcccagtggctgcagcgttcccgttacacagcacgatagctctgcaacacacataagcatgcattaaaccagagatgcgccatcactcccacttctggaagctgatctcatagcacagcaagagacgagcaagaaggatgttctaacaagtgtgttgaggggtcacagggtgggcctttctcactccaaggctctgggactcttggagctctggtaggagcaggggagaccaaccctacctcggatgcaggggcagcatccgatgaccctgataatgaccacaagaaagaggcagcacctctagggcaggaaagtgctgggggtcagaggcatgggtgccattccaggctgagccaggctggctgtgtgagcctgcgtgagtcacttaacctctgaacctagtgcttcacgtgcaaaagagggaagcttccctcatcctcctccagccgtcacccgctgccttccttctctctgcagcaaaatggctccgaagcgttgtctacacttcttttctctgattctttatttaaatttgcacttattaggctgagcgcagtggctcatgcctgtaatcccagcactttgggaggccgaagcgagcagatcacttgaggttaggagttcaagaccagcctggccaacatggtgaaaccctgtctctactaaaacacaaaaattcgctgggcatggtggcaggcacctgtaatcgcagctactcaggaggctgaggcaggagaatcacttgaacccgggaggcagaggttgcagtgagccgagatcgtgccactgcactccagcctgggccacagagcaagactctgtctcaaaaataataaataaataaataaataaataaatcttcacttataaattactccctaaataaaaataacacgttatatacatatatatacccatctcagcctcccaaagtgctgagattacaggtgtgagccatcgtgctttgccataacgtggtttttttaatgttttattttaaaaatgtttttataacttttatctatttatttattttttgagatgaagtcccgctctgttgcccaggctggagtgcagtggcaccatctcagctcactgcaagctctacctcctgggttcaagcgattctccggcctcagcctcccaagtagctgggattgcaggcatgtgccaccgcacctggttaatttttctatttttagtagagacaaatttttgccatgttggccaggctggtctcaaatccctgacctcaggtgatccgcccgcctcggcctcccaaagtgctgggtttacaggcgtgagccaccgcgcctggacaaaatttttttataccttttaaattccagacccaccaccaggttgaatcctccgggctgactgtgcagaccccccactatgccccctactttccattaactggtatgttttatgttatcaagaatattaaaacaaacctatgcatctgccattgagcttaagaaatagatggccggacgcggtggctcacgcctgtaatcccagcactttgggaggccgaggcgggcggatcatgaggtcaggagatcgagaccatcctggctaacacggtgaaaccacgtctctactaaaaatacaaaaattagccgggcgtggtggcaggcgcctgtagtcccagctacccgggaggctgaggcagaagaatggcgtgaacccgggaggcggtgcttgcagtgagctgagatcgcaccactgcactccagcctgggcgacagagtgagaccctgtcttggggaaaaaaaaaaaaagaactagacgaatgcccaggcatgggaagccccagtcacctttccctccctcaacccgagaggagtcacattccaaacctagcctttatcattcccttccttttcattagacggttatgtatgtacgtatccttaaactttatgctaatggtatcacattttgtgtattctactacttttaaacatttatggattaaattctgtccctccaaaaaagatatgttggagtcttaacccctaatactttaagccgtgaccccgtttgcagacaccgtctttacagaggtgctcaaggtgagaggcactcattagagtggaccctcattcgatacgactggtgtccttataacaagcagaacacaggacagaggcagagccaccagcagggagaacaccacatgaagcctggagtcaggcttccggacgaagccgggagagaggcggggaacaggtcctcctcccacgccttcccagggaacgtggccctgtcggcaccctgatctcctcgcccctagaactgggagacaacacgtttctgctgtccagccacccagtgtgcggtactttgttacagcagccccaaaaaataaagacaccattccatgtcatgttcttgaaattcatttgttaatgagtgaagccgaggctcattcattttctctgtcatgttctattatatgatatcccacaatttatccattttactttgaaaagttatatggtttgcttacaggttttattgttgttttgaaattgcaaactgtgctgccccgaacctccctgcaaactgtgccgtaggagtggagctgcacttgggtcaaagagggcaaaggtaagtcttaactgtgcagcccagatcagagcaataacaactcatcaagataagtctaattgctactcaacggggtggaacttacacgcttgccagtgggcaggcagagttccctgtgtcctacattcttgttaacacttgaaactccagtcttttttttttttttttttttttttttgagagatggagtctcaccctgttgcccaggctggagtgcagtggtgtgatcttggctcactgaaacctctgcctcccgggttcaagcgattctcctgcctcagcctcccaagcagctgggactacgggctcccgccaccacgcccagctaatttttgtgtttttagtagagacgaggtttaaccatgttggccaggatggtctcaatctcttgacctcatgatccgcccacctcggcctcccgaagtgctgggattacaggcgcaagccactgcaccccgccctgcagttttgttttgtttttttaatttattattttaaaaaaatgtttttgagacaggatctcactctgccacccaggctggatcatggtggcatgatcttggctcactgcagcctcgtcctcccaggctcaagtgatcctcccgcctcagcctcccaagtagctgggaccacaggtatgtgccaccatgcctgactaatttttgtgctttttgtagagatgagttctcactgtgttgcccagggtggtctcaaactcctgggctcaagcgatcttcctgcctcagcctcccaaattgctgggattacaggcatgagccaacacacccagcccgaaggaactgccattctttttatctttgccaatctgatggttatagaatggtatttcctagtggctttattttgcgttttctttatttctaataaagttaagcatcttttacatgttgatggacaatgtatatttcctgttttgcaaaacacctggtcgggttttcctggtcttttttcttatttatttctaggagttctttatgtactctggactctgatcctgcattggtctttctaaagctttattcgtcgcatcctctgatgaacagagcttttcttttttcttttcccttttaaaattagtagaatttattcatctttttcttaacaattagtgctttcaagaaattctttgtacccccaaggtcaagagatattatcctatactcgctttgtaagggttggtattctgcctgtcaggtcgttaatggacctggcattgattttggagcctgctgtgtagtcagatctaaactgggaaaggaacaattgcctgcttttctcacaggggcgttctgaagctcaaaggagaaaatgcgtgtgaaagtgtccagaactgtgaaacaatgtacaagtaagagagtctgcgatgctgatttgctggagggtgacaaagccgtttaagagaaggctgctttggcctttgatttgctaatcagttggtagcgtcataggctgccagtaggccaggcagaaacccaacctccattctgcctccggaggctggagaacacagccaaaaagaccagctgaagcatgtggtctttgcaggaaagtaagttccagtggcactgctggggctggccccgtccacccacactgttcactccatctgccacctgacattagcaaattaggctgcaaatacagccctgagtcatagagaaaagatgaaattacactcaggaaactctgctcactgaagtgcatgagtaacaggatgcagaaagacacccattaaaagcggctaaaaacgagtcaggtgctccaaggcagcctgctgcacaccccaacacgcgggcaggctccgccccagctccaactccacctggaggggcaacacgcacccattatacgagccacacgggggccccagcaactggcccagacaaggctgcagagcccactcagggtggaaccccctttagcgaactggaaggttccatgacggggctgcggggaaggaagccgactcgtggggagttagctgagctgccggaggaaactgacaaaatcaaacgcaccctttggcctgcacaaggcgatattgttggttctccctgaagcacatcctggccaggagacagagcttaggccagcccccgggccaggtgcctgctacccagacctgtgatcctagccaaaagtctctgagttctggatgtccacactgggaagggagagcagcgagggaagggttaccaaaggggcctgaggagacattcgggggtgacagattgtcagcatctttttgtttggtttttcttttaagcgatgggggcggggggtgggggggggtctcactatgttgctgaggctggtctcgaactcctggcctcaagcaatcctcctgcctcagcccccgagtaactggaattcaagacgtcagccacggcccccagcttagcttcagcatcttgattgcagtggtggcttcacagatgtatacatatgtcagaacttatcaaattgtatattttcaatatctattttagacaattagatctcaataaggctgtttaaaaattacagaatggtgtgatggcgacttttactaaatatgcatgttgacagcaagaggaacgactagaaggaggtccccagatgttaacagtgcttagttctgggctgtgggattacagaggattttacttttcctctttgtgtttttctgtactttaaaaaatttctgaaatatatgtgttttactttttttttttttttaagatggaatcttgctctgtcgcccggagtggagtgcagtggcgcgatcttggctcattgcaacatctgcctcctgggttcaagcaattctcctgcctcagtctctcaagtagctgggattacaggcatgtgccaccacacctagctaatttttgtatttttaatagagacaaggtctcgccacgttagccaggctggtctcgaactcctcacctcaggtgatccatccacctcggcctcccaaagtgctgggattacaggcgtgggccaatgcgaccagccgtgttttacttgtataaatcaggaaaaaaaaaagtatctatttcaaaataaaagcaaactttaggtcgcaggggtcttctgaaggtcggcagccatgacctcacagaggcacactctgggcttagcacggtggagctgtgcccaggggaagcagcttgggctttacaaccaggtctgcagcaaactgcccaggccaaacctcagctctgccgcccatctcctcagcggccttcagctagttacttgagtgcttggtgccaattttaatccccaattatatttcggagacaatcgtcaaagcctctgcaggtggctgagagattcaatgagccaatacaggtggctcttagcagtgttctcacagcacagcacagactgggtgaattacagctactattccctcctattaaaaagaatagaagtggccggacacaatggctcatgcctgcaatcccagcactttgggaggccgaggcgggtggatcacctgaggtcaggagttcgagaccagcctggccaatatggtgaaaccccatctctactaaaaatacaaaaattagccgggcgtggtggtgggtgcctgtagtcccagctactctgaaggctgacatgggagaattgcttgaacccaggaggcagtggtttcagtgagccgagatcgcgccatcgcactccagcctggatgacacggcaaggctctgtcccaaaaaaaaaaaaaaaagaatagaattgacttgagaaactctttgcttctttttcccccatgaggttagaaaagataattgaatcatctctagaacaggacgccagtttctggaactgaagggttttgaggtttctcttaacgaatatcagaaatctttatctctcaaccaactgtaaccaccatctgtggcctcctccagccctcaccaatacgggtacccctcccaggcttcctctccctccctgagcctctgctgtgaattatctgagtccacttcttctgaggctgcttttatgggacagagacaagaccctactctttccttctcttacttgttccttttctgttgtctgccagaagtaaccacccgttgcccaaaccaatctttagcttggcctcctttcaggggtctggatgccatctttaactgccttagtctggtggcctgagcagcttacctgagcctcagcttcttttttctttttctttccttttttttttttttttttgtttgtttgtttatttgtttcttgttttttctgacaggatttcacgccatcgggcaggctggagtgcagtggtgcaatcacagctcactgtagcctcaacttccagagctcaggtgagcctcccacctcagcctcctgagtagctgggactccaggcacgcactcaatgcctggctaatttttgtgtttttggtagagatggggtttctccatgttgtccagcctggcctcaaactcctgggctcaagtgatccgcccaccttgacttctcaacatgctaagattacaggtgggatcctaccaggtggggcaggagtaatcaaccctactagacagatggggaaaatgagaggccgggcgcagtggctcacatctgtaatcccagcactttgggaggccaaggcaggcagatcacttgaggccaagagttcgagaccagcctggccaacatggcaaaaccccatctctactaaaatacaaaaattagctgggcatggtcgtgggcacctgtaatcccagctactcgggaggccgaggcaggagaattgcttgagcccgggaggcagaggttgcagtgagccgagatcgcaccactacacactctagtctggatgacagagcgagacttagcctcaaaacaaacaaacaaacaagtgcacctttgttagttttatttgaaccaatgtttacatctctggcaaccacaggctcatatgaaacttcatgctattaaactttatgggtgacatggccaggcacggtggctcacgcctgtaaccccagcactttgggaggccgaggcaggtggatcacgaggtcaggagatcgagaccatcctggctaatacggtgaaaccccgtctctactaaaaatacaaaaattagctgggcgtggtagcacatgcctgtagtcccagctacttgggaggctgaggcaggagaatggcgtgaacccaggaggcggaggttgcagtgagccgagatcatgccactgcactccagcctaggcgacagggcgagactctgtctcaaaaaaaaaaaaaaaatttatgggtgacaatagaacaaaggcagagggacaggacagaacaatgagtcactccaacacaccctgtgtgttctaaaagaggccccgggacaaacacctgcctcagtaggaaggtccagcattcgtggcggtgtgtgctgggcggttgtggtgaggactgtgtctgtgtctgggcgggtgtgtgtagttgtggagtttatagctttcctttgactcaaatccttcttccctatcaccggcttacatgttagaggcctgtaacaggagaccagttccaggccaacctgtggttaaaagaacctcagcctgtgagcaaatgttactcctcctccgcactcgaggaccctgtggcagcccagcctgtcaggcctctgcagacatgagttggcctggttctccctgctgccatccctcacccgccaatccccaatcagtcttcactgtataaacaagtgcttcactgaacagcccagcgcatctgcgaaagatccaacacgcagcccttctcgttcctttgagtggatccatttgaaaagctcctgtctcctggctgggtgtggtggctcacgcctgtaatcccagcactttgggaggccgaggcgggtggatcacgaggtcaggagtttgagaccagcctggccaacatggcgaaaccccgtctctactaaaaatacaaaaattagccaggcgtggtggcgggtgcctgtaatcccagctactcaggagactgaggcaaaagaatggcttgaacccgggaggcggaggttgcagtgagccgagattgagccactgcactccagcctgggcgacagagcaagacaccatcaaaaacaaaacaaaacaaaacaaaacaaaacaaaaatctcctgtctctaggaccaggcacaatggcctaggcctgtaattccagcactttgggaggtcaaagtggaaggattgcttgaggccaggagttcaagactggcctgggcaacatgatgaaaaccccctctctacaaaaaaattaaaattaaacaaatcagttgggcagggtggtgcacctgtagtcctagttgctctggaggctgagacaggaggatggcttgagcctgggaggtggaggctgcagggagccatggtctctccttcacattccggcctgggagcaagcccttcatctctaaaataataataataataaaataaataaataaataaataaataaataaataaataaactgtctccaaatccttccattctagtccaggcctcttttgagttagctctattttttcctaatactcattaaataaatgcttaactattaaaatagaaagtcctctgggcggggaatggggtggggggcggctgccaggccatggccagaggctattatgcactggaaaccccgcatagcagaggggcagccctgcacctgcccctgtccaaggtaggtgggtggtgactgcaggccatgggaaacgtccatcctaggggagtcaccagccacctgggaagccaggatcaaggccctccacccccagagtacaggagacaaagggaggaacaccagggacaaggaaccctaggacccgaagcaaagtggcgttcgctcacccgggagtgccacgttcgtgccaccgtcacagccctcacctcccgcccgccagcacctgagaccggagtgctggggggctggctgcaggcgaaggaggtgagggcggattcgtttctcactgcaactgcagcctctagagctgggtgggcagggtctggctccatgagctcagagctgaccctctacaaagattccaggacttgggggctggagacatctctcttcgaaaacagattaatccagaggagctgtgggccctgtgtttagtaaattgtactctgtgtcttcagcatagaaagtccttcccactccctgctcagtatctcccagccctcctaggaggcaggcaaggcaactccaggacagtcaccctagttcacagatgaggaaactggggtttcaagactgagacatgagcgctcagcacagtccggggtggggggcagcaagggggtattactgagcacctctcatgcactgccacagccccagaccttaccccacttcatgcctgggacagcccgtaagctgcggactactggccaggtaaacaaggggaagaatcctacccaagatgtagctgatttgaatttgttaagaattaaggccaggtgtggtggctcacgcctgtaatcccagcactttgggaggcagaggcagacgggtcacctgaggtcaggagttcgagaccagcctggccaacatggtgaaaccccatctctactaaaaatacaagaaattagccggacgtggtggcagacgcctgtaattccagctactcgggaggctgaggcaggagaatcgcttgaacctgggaggtggaggttgcagtgagccgagatcatgccactgcactccagcctgggcaacaaagggaaactctatctcaaaaatataaaaaaattttaaaaatgtaaaaattatggcagccccaatttccaactaagttatattccaaggtatagtcaaaacacattttcccactgcaacaatgttattttatttagatattggggcttgtccatcaagggccagttaacccacaacactccagaatttctgaacaagtgtaatgaacagctgacaaatattattacaacatcaatggtcaaaatagaaaagcaatagcatttgataagaaattactttttttttttttgagacagagtcttgctctgtcacccaggctggagcacagtggcacgatctcggctcactgcaacctccacctcccaggttcaagcgattctcctgcctcagcctcccaagcagctgggactacaagcacctgtcacgacgcccggctaatttttgtacttttagcagagacagggtttcaccatgttggccaagctggtctcaagctcctggccttaaatggtccacctgccttggcctcccaaagtgctgggattacaggtgtgagccactgcatccggctgactttttatttaatatcttgaatacctgcctgaaaatctgaggccggatggaagaatggacagaattgcccccactctcctgttctggaatttaaagaagaaaaaagaggggaggaggcatcacctagttgggaccaggcttggggaaaaaaggacagaatttgcagaccaaacagggaagctgtgaaagaaaaaagcaagtccctggcaagcagctcagcagctggaaatccccctcggtccttgggagagacaatgagctccagctgctctcaactgcgatgcagagagagctggttcccaccctgcagccgtccccgtgtccttctcctcgctgagcctcacctcctccgcctgccacagaggcgagcatcccgcttcctgcccagggatgcagcggagaatgaatatcacctaggtaacaactcacaagcacagtgtctggcttcggggcgtaggggcggggacacatgtaatcaatacaagccgcctgcctgggtggcttcccccttccctgatgaagacctccaggccgcagagaatgctctgttcctggtcacaaggctgcagctgaagggcgggggaggcctctcagattcaaaacagagcagagatgagaggcctaattctaatttgagatcagagcctgacagctgggcaggtggcaggcggccgcttcctcccctccgtggagcctgccaggagaggggctgtggtcgtattaagggtgtgagtggcaaggcccgcagcgggatgggcagtccccgccatgccagtgcagctctgtgtaaatccttagtcccgagtatcctcgtgtaactcagagctggaaagagccgtagatcttctggttccatgctttcattttacacataaggaaacaggcccacagaggaaaagggctttttgtagtcacgtggcgaggcaggggaagctgggcccagaatgcaggggacctgccacccagacccacagccaggaccccccaacgggaaaacgctcgctcggccaccaagagcatttgatgaatttgcctctagtcttttaaaaatacatatatgcaattttattttaaaatgttttatttttattttattttattttttttgaaacagggtctcactctgtcagccaggctggagtgcagtggcatgatcatggctcactgcaacctccacctcctgggctcaagcgattctcctgcctcagcctcccaagtagctgggactactacaggcaggcatgtgccaccatacttagctaatatgattttttgtagaaatggggtcttgctcacaacaaagcccaggctgctttaaaattcccttgctcaaatgatcctcccacctcagcctcccaaagagttgggattgcaggtgtgagccactgcacccagcctacatgcaattctattttattttttttattttttcattttatttttgagacggggtttcgttctgttgtccaggctggagtgtagtggcgaaattaaagctcactgcagcctctacttcctgggctcaagtgatcctcccccctcagcctcctgaatagctgggactataggtgtgcatccccatgcctggctaacttttttctatttttttgtagagatagggcgagccactgtgttgcccaggcaggtctcaaactcctgggctcaagcaatcctttcatctcggcttcccaaagtgctgggatcacaggtgtgagccattgtgcctggctgtaattttaaattaatacctaattatactatgcatgaatacattctctttaaaaagttatttccttgcctcttggatatggtgtggctacttagtgtttgttaaatgtgtgaacaggtgaattcttatttctatcatcccattcaggccccaatcttattaccagctcctccctggatgccagcacctctcaacgccccctcccctaggaccctcctaccaggaccactggatcagggcacccaggggcaaggaggccagtgaggctgcttgagggcccctctaattcctgccccgctcttggttggggctagctttggggcacactttggacttttttttttttttttccagatggagtctcactctgttgcccaggctggagtatagtagtgtaattttggctcaacctctgcctcctgggtccaagcgattctcctgcctcagcctcccaagtagctgggactacaggcacgtgccaccacgcccggctaatttttgtatctttagtagagacggggtttcaccatgttggccaggctggtctcgaactcctgacctcaggggatccgcccgccttggcctcccaaagtgctgggattacaggcgtgagccaccacgcccagccctttggaattttttatcccagccccaagcttgggacgggtctggggcacccagataccctccctgtgaagccagggccccccgccctgctcaactgcctgcacacaagcaggtgttcctccttctctgtggctcctctcacctttgcttcctctctcccggtattgggacgtggaaagacattaaacacctgggagcccccagggaataattcaaattcaatcatagaaaatgaaggcacaaggcctgggctgctgggagggcccgagggcctggagatggaggcttggcaggcccagcactgctgaagccaagggaatgagtgacttctccaaaagcaggttgagtcatgctgaacctcactggttccccagtagcaggagcatgaggaccaaggacggacctagaagattcatggtaggggctgaggggaagagcagccaagagtcaggagggtcagaagtgtgtctgatcccttggcagggtgcggtggctcacgcctgtaatcccagcactttggaagtccgaggcgggcggatcacctgaggtcaggagttcaagagcagcctggccaacatggtgaaaacccgtctctacttaaaatacaaaaattagccgggtgtggtggcgggcgcctgtaatcccagcaactcagaaggctgaggcaggagaatcgcttgaacccgggaggcggaggctgcagtgagccgagatcgcgccaccgcactccagccagggtgacagagcgagactctgtctcaaaaacagcaataacaacaaaagaagtatgtctgattcctcaggccagagtaaaagaggtttcaagaaagagggtgtggtcaacagtgccaggtgcagctaatgtaaaggaaaagtggcctcctttttcccttgacgtggatgcgtacaaaccctcccctgggaccaagctcagggccgggccacgaccaggggccctcaggctagatctggtgccggaggagacctgctgccgaggctggacgggtgagcctggaagggcgtggaccctccacccaacctcagggacaagtgcctgacacccccctgagcagaaacagggtgggacggaaaccaaacaaattgctcctgaaatccatgttttaggaatgtttggttttcagcttctctttcctgcagcaggatgtttaaagaaaacaaatctttaaagtcttctactccaaagcaaagagcgctgtgtgtgcctacttctggtctccgcttcaggaacaaaccccctttactctctggcctggattgggcgcaaggcagccggagcttcctggccaagctgggccagcagcccaggcccccaccaaaggctcagagtgagctgggcaccaccaggccttgaggccttccagaggcttctactccagggcactctgaggccgggggctgtgggtggctaacagactatgccgccagctgggagcagagggggccccatctctgccccaaatccaagtctggccagctccttcccctagggatagatacttggtggggaagagagggagctgagaaggtcacccaagaaaggtgagccgggccgtctgcctgggagtcagaatgaggtggcccatcctcggacttgaccatttcccaatgccctgtttaatttaattttttattttattatatagggacagggtctcaatatattgcccaggctagtctcgaactcctggactcacatgacccacttgcctcggcctcccaaagtgctgggactacaggcatgagccaccacccccaccccccagataatctaaattcagagcctgcaaaaggctcagggcccaaggagagaaaatggagacagaagagaaagggaatttctccctccaggtccccacgcctgagtcagaccctctcactgtttcctttacaaccaccgcacacccacctggacctggcctaagaaaaggaatacaagtccatgaaggttctcccttctttttcttctttttcttcttctttttcgtcttttcttcttcttctttttcctcctcctcctcttcttcttcttctttcttcttctgtcgcccaggctggagtgtaatgacgcgatcttggctcacggcaacctccacttccgtatctcaaggaattctcctgcctcagcctctgggactacaggtgtgcgccaccacacccggctaatttttgtattttttgtagagacagggtttcgctatgttggccgggctggtcttgaactcctgacctcaggtgatccgcccacctcggcctcccaaagcgctgggattacaggcatgagccaccatgcccggcccatcatgtacccttctgatcctacaagcgcactgtgaggtcggccgggcatggagtttggtttcaacttcacgttgagatcggagcagctctgagaggtcggggcttcatccagggccacacatccagctggcagcagagccacctgtccacccagctctccggatgcccggcctgtgctccctacacagccgcttactgccctgccaggaaaaggcaggcaggagggatctttccactcccattaggggctgaggaacaggcatctaggagctaaatctgactgggggagtctcccagcccagacagcccagggccctgcccaggggtcagtgctttcacttgctgacctcatgcctccaccactactcggggacagatgaggttcagcatgactcaggttcagccaaaggatactaatgggccatggaataaatcctgcctggagccctgttcacctcaggacttgtcctcagaccatggaccttcctccctggtcactcagtcaaggaatcgcaggagatcagtgcaagagtagctctgaatgggccgggcgcggcggctcacgcctgtaatcccagcactttgggaggccgaggcgggtggatcacgaggtcaggagatcgagaccatcctggccaacacggtgaaaccccgtctctactaaaaatacaaaagattgtccgggcgtggtggcgggcgcctgtagtcccagctactcgggaggccgaggcaggagaatggcgtgaacccgggaggcagaggctgcagtgagccgagatcgcaccaccgcactccagcctgggcgacagagcgagactccgtctcaaaaaaataaaaaaataaaaataaaaaacagtagtcctgaagcccccagcccagcacacctggtctttgcaggcccgagacacccacaagagtaacagcagcgcctcattcaggaggctgaggactaagtgagcaaacgcaggccgagtgcttccccaggcctggacctccattagcattcaactgtgttgtcattgctgtcattgctacactggagtcagatcactaggcctttaggaggaagaacgtgcccttcctgttgacaggccgggcctctgacccaggcgtctcctctccgtggggtggcaggaagggcccaggactcaggtggcagatcagggaccccctggcctggcctctgctcagctgtgtgatcttggggaagccccgccttgcgtcccccaccgccttggttttcttcttgctgagaagtgagggaggtggctggctgttcagcagggccccttccactttgggaatccccagtttcagcagcagaacttccccaagcagaaagctgctgggaaagtgggtgcccaggtgggaggcggaagccccagggagaggcagacgaaggtgccctgtgcgggccccgcctccagcctggtggacagtgccctgggtttccatgcccagaccagggccttcctggaaccgcagccaggacgtgagaagctgtcagacagctgcctctgtgttcctggaagctgtggttcaggaaaagtgggagggagagaaggagggagagagcaatcgagggagagcagaagagtgtgaagagaaagagaaagacaggaggaggagcaaggggaagggaggaggcaagcgtggaaaggtgagaagaggtgaggcagaggcctacgtggagaggcagagcctgggacgctgcctgcgggggaggtcaggtgaggagcagggagggcggaggctgtgagcagccaccctggaacagagctcggaacaccattgcttttgccttccttcagcctgaaacactgcctggccacaaagcagaagcagcagttgctttcttaacaggaggcagagccgttgttgggtgaccctcttctcattcccttgaagaatctcagcccatgcccccatcccttctggcctggagacaccagtgttggggagttttgtgtaaaacagtaacaaagacctcgtgtccgaagcagcaccctttacctctgttgtcagggccacagggaaacccgcacccagccggacaggagtcagaggctgttgtcatggtaactggcatcccaaggcctggtctgcctcctgcctcctttatcgggctatgatggtcactgcttcctctgcgaagcacctgtcatgtgtgggggtttgtgccaagctctttccatgcactaggtaagccatgtcataaccacacgatgagatacgacttgtgtgtgtgtgtgtgtgtgtgttttcttctagagatacaattattaatcttacattacagggggagaaaccaggcagcccaccttcagagcccgcgtcttaactgtgaccccacgttgaaataaaatgtggaaactgcccacagacacacctcgtggtggctacgagtcacaggggctgcacttctgcctcttggggagttgcttgtttgctccatgctggtttcctcacctcagaaactagaataacagttccatagagcagtcgtgaggattgaaggaggcagcctggacactgagcacaggccctggcccaggcagggctccatcgagggtttgttagtacaggagttctggcgagccctcagccgctgggctgcttccctccagccattcctctgcatgctaagaactaaagagaagggagtcagacccagatggagcatgggtgtcaggcactgtgcccagctgcccatgagagccagcaaggtgcctgtgtcctttgaggtactaggattctgggccctggatcctgcagtgcggtgacctccccttcccccatctgtccctgccctgctccaccctcagccacctgcagggcccccacccaagggtcagggcagagcagggcagagcagggcagagcagggcagggctgagtgggaggcagcggagggggtcattatcaccggcagcacagggctgaagagagttaaaccttcttatcagttccctgggcctgtgcccagcccagcccagctctgaggcacaggggctggagagcagagccctggggttgccagccaagcctgtctcctctggaatggcccaggaccagggatggggcagcggcctgggaacccgagagtcaccagactggctgcaccgtgtgatctgatgcaaccacttccctctccgggccccagagtccctgcttatgaaattgggggtcgggggcagctggatgaggcagcccgggtcccttcctctcctagagagttaggatcctgtgatccctgggaggtggctatgactgtcagtcctacagacgaggaagctgaggctacgcacaggacagtgacttctccacagcacactagttgggcacagagaggaatgatggggctgagccccaccccacatgcccatgaagcttgtgagccttccagaaggcccatggaggaaaggcgtggagatgggaggtcgctgccctgggcaccccatcccagggtctaacccctttcttcaggtcctaggggccagctggggacctctcagaggagccctagacagtcaggcacctggcggctttgcaggcctggggtcactccttggctccagcccacagaaggcagagatggcagggcttcctgggcgtatagacagtaggccctgtaactgggctctgataacacccctccccttatcagtgggtcaaggactgggtggggtgcatctgagaatcaagggtacattccacagaaacaaggaaggggcagaaaggaaaagtgggtgcagctgaaccgaggcctctcagcccggctgcaaagaatcccggaggggtcccctggcttaggggggagagtgtggagtggtggggagtcaaaggaagggacagtctaagtctcacttaaccctccaggagccaaggggcctgatccaagtgactttcctgaagaaaccttagaaatcctaggctggggccgggcgccgtggcttatgcctgtattcccagccctttgggaggctgaggtgggcttatcacttgaacccaggagtttgagaccagcttggctaacatggtgaaactctgtctctactacaactacaaaaattagctggatatggtggtgcacacctgtaattccagctactcaggaagctgaggcacgagaatcagttgaatccaggaggaggaggctgcggtgagccgagatcgcaccactgcactccagcctgggcgacagagcaagactccgtctccaaaaaaaaaaaaagaaatcccaggctgggagggacagagagacctagaatccacatttagagcaggaggccattgccctcagagggttcatggtctcctttgacactatgaggaaaattatgtctgcccagtggggaaattgaggcccagcgtgtgaggggaaatgactcacagctggcttaaggcttgaaaggcccctgcctgaggctgagtgtgtcccctgcatacctggaggcgaggaccagtaggtgccgtcctgaactaagggacagggtggcagaggaaggtcagggcctccccagatactgggcctgggcttctttgcccctgtgggctgggactccaggcaggcaccacttcttcaaccagccagttccataattcacatcccggccttggcccaggctcctggaccccctcccccgtggcccatgccaggcaggtgggtgaggctgggcctgcacagggaagggtctgaagcctgcagggtcggttgtggcaggacccattgggctggagatctggagggacgtcctgcatcaccagcggtagagaggacaggggctgggccagcgtccccctgagaatgcgctcacaccccagcacacagacacacacacctccgcggcacctgggggtggctcatctgaacccttgggtgacatccttctgcccccaccctcctccacaccctggtttcacccggatacgaaggtggcaggaagcaaacagtgtgacttgggcccattttgacgctccaggtggcagaatcactggaacacctgataaaaattcccaccctcccctgacacggaaaggctgagccagaagagcctggcagaagggacttccctgaagaaaggggcccaggtcagtctcgaaggtggtccttggagaagctctgggtggtgtgtcagctgcgtggtggagaaaatcatcatgatgacactgaccgcgctcactgtgtgcctaccgtgtacctgtgtcccgatgttttgcatgaaacacctcattccggcctctgccagccttccagaaagatgcattattcccagtcccacggtcacattctggccgctagcagagccacagttagatgtgtccccccgacccccccaaccccaggggcctgaagacttgtggggcctgggaccaccccaggggcaagaccagaaccagctcctgacctcccaccaggaaagagggaccagggtgagacacagctgcaggaaagatgcaaggctgggccgtggtggagaacgcccccacccctccacttccccaggacgcggcaggcaggagggggccactcccagcctcagggccccagaaatggtaaggccagccctaaccccaccccagaggctccagagaggcagggctggaccaggccaggcctggtgaatccctgggctgcgagcgccccctgcagccagacaaaggtgtggccgggcagaggccaggtgctccccaacctcggacaccccgacattggtggattttcctcttccatcatctccagccctagctgggagctaggccagtcaactgctgcaattattattattattattattgtctgttgttgttgttgccctttttttttttttgagacagagtctcactctgtcacccaggctggagtgcaatggtgtggtcttggctcactgcatcctccaactgccgggttcaagcaattctcctgcctcagcctccctagtagctgggactacaggcatgtaccaccaagcccagctagtttctgtattttttactagagacagggtttcactatgttggccaggctggtctcgaactcctgacctcaggtggcctccggcctcccaaagtgctgggattacaggcgtgagccaccacgcccagcctattgttgcccaattttaaggaggagagaaatgttaggtgtcttgtccaaggtcacagagccaggtggtgtcaggtcctgaactcaggcctccacagatcctgggtcctccatcccggaaggtctttgtcccggcccattagagcctcctccaagccctcacccaggacggacatgcgcagcgtgacagttgtaagaggcaggcaagagtatttaatgggcattgagggtcttggcagtcccaccaggggagtgggcaaagggcaaggcacagaaaggcttccactcagggctcaggaagtgggaggtaaggaggcaggttcaggaggcgggttcaggaggcgggttcggaggtgagctcaggtgctggtgctgtgggcatctccgggtgcacaggggcgagaggaaggccgaacctcgcctgggggctcctgcagcagcaggggcagcactgggcccgtgtggaactaaacacagaacaggggcatgagtgctctcaacaagaccccgccccgcagctcgtgccaggtctcctgctcctggaggcaaagggagcgggctggccccacagaatgtgctgcagaggccccggggcgcaggggttgcccagccccacggtggcctcctgatgctccacctccatgtctcacggggcttcgagtcaatgtttcctttaaataaaagagtctcccgccacccgcaccccctggccaaattataaaccacgagactcatctcagtcctgcgagtaggtgactggcctgaggcccatcagcacatgtagtgggggagtcatcctccatttgtctttgtgactccagggactcctgggtgtattctagaggcctgggccctgcttccaacgcccctccagtgtagaaccctcctccccccaagctcggagcgctccagcttcagggtcagccaaacctcaggggcctccccccacaccctcacaacctgcagacacccccctcccgacacgcacagacacccacgcacacacacgcttcttacctcctggagagctgcagcctcaccacgccccgggggtcccttccctgctttgtagggacccagaggttggggctggggggttgagagcagagggggacattggagggtgcagattcggcatggatgtccagtcaggccccaccactctctgcagctggacagcttcagccatgtacctggggagcagcaggccagatgcaggggccaccgtcctccctggtccggctcccctgcccgcctcagcttgggaagcacacggcccagggcttagctctgcaggaagctgaggccagcctcatccaggatgcagcagccctgtatgccatagtggggcaggaacacacagagccaaggacgtagggaggccccagagctcccagtgccctggagaaaaccccagaggagcaggaacagtgagtgtaagggcctggggctgtggtaaggagccagggtgaacccacctctgccccacccccagggttcaccagttgggcctctggcttgccaactcacttgggtcccagtggtgcacaaattgttaaataccagttgctggcacagccctggtcgaaggggttgtatccctgaaggtgtctgcactggtcggggatggaaaccggaagaggagctcagaaccagcaggaatggctgggccatcgcccagtggccctccctgagctggtcagctagccagggctcagcccagggcaccagcaagctggaggccaggagactgaaggacctccccaccactgccccatcctcctcctcttggtctccactggccacacacatcctcctgctacctccttccagatactgaatgtcactgtctggaaggtcagttgagcaaggcccagtcgtatttccctaaccatgatcacatggcccaggaaaatctgggctaaaagccttgaacacgcaatgcggtaaaggccaagtcgtcccctgggcactcttgaccttgatcaggttctctccctcctctctccccttcgcccactcactctacccatccacctcaccccctcccaaactccctctccgccacagggcaggctgggcctcacctgacttcaagagcctttgctgtcatgttttgtcactgaaagtggcccagcagcatctctgcccaccaccaactcccctgtgtcccatgtccccgctctccgccgcaaaggctgagattttcaacaccattctccaccaaaggaaccaggactccatgcaaggacagctggcactcactggagggaggaaaagtctggacagctccataacagctcactgtcgccactcactgttgcca

SEQ ID NO: 348 - DNA, 124385 bp, Homo sapiens
actaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggc

SEQ ID NO: 349 - DNA, 151189 bp, Homo sapiens
gatcccagatctagtgatcctataggaacgtctaagacagtgaaacatgaagagttaatggtcactcttcataagaggacacacaaggaagaaattctacagacaacagcaaaaagaaatgctcttgtggggtgaaactacactgtccatggacttttaccactgctttgtggagaattgttgtgaaaatatagaataagtagctgcaggaattctctcatcagacactattatgccacctcccaagtaacattagtgtacagtgcaaaatttggaactaaaggaaaaaaacacttatttgagaaaacattgacatttacaggtagttacattacatttagcagcttgttgttcctttgatcatctatgagctgcctaaagcagtttgctgccgtatggaaaaatctagacccagagaaccaaagatattgtaacatgagccagaatgacattatcactgagaacgcagcaacatgcaatgagaggagtcggcctgcctgagaaactcaagatctccttggaaatgccttctttttctttagacatagtcactgactctttctagcttgtctcaaggtgagacttcatcccaggtatttcctgtgaagtaagattgtttcaccagaacctgaaacatttttccatcacacattgcctcacagtatgtgacaataaaatggacttcagtcatgttatttacatggaagaactgggcttggcaaatttgctatgttctgtatgaaaccaagtataccttttaaactgcctaagagtttgatctattacaaatataacaggacaaactcttttgacccatggttaaacaagctctccaagactggaatttaaaaggacatggcataaattctgtggtgagttgagacctctaggtatcaagtctcagcaaagtcaggtgtccttctcattgcctcccaggtggagattcaagaatgaacatgttggctgggcacggtggctcatgcctgtaatcccagcactctgggaggctgagatgggtagatcacctgaggtcaggagttccagaccagcctggtcaacatggtgaaaccccatctctactaaaaatacaaaaattcactgagtgtggtgggggcagcacctgtaatcccagctacccgggaggctgagtcaggagaatcacttgaaaccgggaggtggaggttgcagtgaaccaagattgtgccattgcactcaagcctgggcaacaagagtgaaactctgtctcaaaaaaaaaaaaaaaaaaaaaaaaagaatgaacatgttgagatgacacattctagcatggacctcccattatggtaggttattcaatccagcttagcaacttattttatcccaggaacaagggactgaattctatgtgggtcacatttgtacagctaaaaccccccgtgatcactggataataatgcagccttatgttctgcacggtctagctgtatatagtggggacacgtgatcaccttctcaggcttggttttttttctgtctagccaatggacttcagactgtcagagagtcttcactttagactgactacaaatcacctgcagagtttcgtatacatacagctgcagtaggtctaggatggagaccagatctcctgtgttaaagaatcttccaggcggtttggacaccaacggggtgtaaaccacactgttgaaccagagagagacgatgactttgaactctgaaggaccatctcagttctaaagcatctagcaccagagtcagcccccagcaaattgagaaactagactttgggctcaggaaatacctccctgggtcaaagtaaaccaagttaaggtggcaaatttccccccaaagttcttgttattgtcagcagcatcaataggaatagggtatttgttcagcagccctgttacattcccaaaggcagattgcaaagatcacgtggctgtgtcatttaaatttcagaaatacaagagacttggagccatttatattagagtcagttttgtcaaaacaatttatggtacatctcacaccctgcatgtttcataaaaccctttctatagaaagggagattattgtggaccaacctaccacagcattgcctactaccagtgactgcattttgtgatatattaagttatcctggttggaattctactgttgattgtctagtgctatatccagtaacaaatcacatgtatgttataagacatccagactgatgtgggctcagaaggcacctgcataaagtttttcaaaagaacagtcataagttttactagatgtgacaaaccttataaaagttaaataatgtcacgctttataagcatttcatttaatacaactgaacacatggagggcattgaggataatatttaattttttccatatgtggatttaataccacatagaagttctagtcccagattgctaattttccaccatgtggtagccatttagttgtattttttaaaatacttaccaaattacagagtcgagtttcagaggcagcagctatgaggaggtttagggtgcatggtatccctttggcttagccctgggtctcatgaggaggcagtaaatcgtgacagtattttcatggcagcactgactgcttttcataagaatgaaggtgagtttgcaaagccacatgctaatgcacttctaaaaatagatttgatgaatgggactccttcaaattctgaccagttttagccacctattggaatgcagaccagcacggaagattcagctttttcagacgtgtctatgaattataaggctttcaaaaaaatttttactctggaaaagtgagctggacccagagttttaattgctcattcttcaaagtgagacttcagatatgtcatttagcctcttctttgcttgtgtatatttatatctttaattgggacaataatattttccttcattttcatagcaaagaaaagaacagtcttagatagtcaggttagaggaacagcacctcccaataccagctacagtttatcttctatgaccataaacagggaattgaatcttctagacaagaaagaccaaacgtctctctatttattcattttctgtcttattctaaaatagctttgagtagctgaatcagctactcaaagaatttgaagaaattcttagaaagagacaaaaccctattggcagggtgtttgggtcggcaggtgaaggcacatatcattcatgcccagcaccaccatctaatgtgatcaatgcacaagaaggtgccgtgaaactttaacgctccatccaaatgttagtaattattattaacccagtgagactgagcagaaacctggaaccactggtcagagccgacatctggattcgatggtcagaaataaggacaccacgctgtatacctatttgatgattcatgtctgtctggcccaggataagaaataccctttcaaaatcatcaacccctgggcagacatgttttatctccctgaaccaattacagttaattctcccgggttcacatagtttgggaccaagtctatttcacacaaaactgaatactccagacaacgtacctgggaaaacttaaaaatgcatacatgggactctccacggagcctcgtaacacagcgtgggcgatgggcataactgtatgactttcgggtttgcaaaactagcgggcgcagccatcagagccccagagtaggagactgtccagtgagagagactgcctgccagaattctggagtgatctctcggccaaagagtatttaatggaatcaaaagtcatacacacttttactcaggcaaagaaaaagtggcatctcgttttctatgactaattgaccctctcacccagcctcacggggctggctaccagagggagttggagtgaaaccctttcaactttccatttaatggtgtctcattctcttacacttcaaaaagtctcgtagcaactggctgtgtctcttggggtaaacattctgactttcaggtatccacagcaatggcccaggcaacaggcatatgtgatgtgaggaagaggctttgagtctgcatgggtcctttgagtcttcactaatttctgctgcagagccaccagctggccacgtttcctgggacctggaagattctgctaaggcatgcctggtgaggttgtctttactttattttctgggacagtgccttgtgcggctgtgggccctttccccaccacctcaccccagatctcttctgtggccatgtctgtctcctggagggctgtttgtggtgtgacctttgcagcaggggtcacacccatttaccacggtggcccctgcaagaaaggcctcagctcccagcagagctggtgaccggggacctcccctgtgccctcagggccccagcaggctaaccaggctccctctgccctgccatagcacattccctctgtgatcacggccccatcccaccaacgttcaaaacagtgcacaggagaacaggcctcctgccacgcgctgtccctcagcctcgcctcctctgtgagatttcagccgggagtgggagccacgatgctcatccgctgtctacctgcctctctctaccttacctgctgcatctacctgcctctctctcccttaccatgctgcgatgcctggctgtgtctacctgcctctctctcccttacctgctgcgatgcctggctgtgtctacctgcctctctctcccttacctgctgcatctacctgcttctctctcccttacctgctgcgatgcctggctgtgtctacctgcctttctctcccttacccggctgcgatgcttgtctgtgtctacctgtctctctctcccttacctgctgcaatgcctggccatgatgtaagggttctccacctcctctgcagcagggaaaggacttccctaagatcggactctggttccctccatcctatgactcacaatacccctctgtgatccaggctggtcacagatatgctaataaagtgaaagaaatttagaaaactcatttccacctctctagcccctggcttttcagcctgaggtagattccaaagcaggggcacgtcatgcagactcaggaggcagctgaaaggtgctcctgcaggcccaataggggataatttgaacaccaaaataattaaggacagtaacaaattacagaccatttacaagatcttgttaatgagtccatgccaataatcaataggtaaacaaatcagtgcagggaaaagaaggatctcactaatagtagaacgctaagcgtcaactgggaaacgtgaagaagcaactgtcacttcgcagccaccacggtaaacttcagttcagtaaccaacagaggccaaatctagggggagattttcgtgtgatttgcatggtctcccagagattaaagtgattcaagttaccatcaacattgaagaacagatggacatcccgtgcccctagagaaaaacacacatcacttctggcccagaatgaggagcctgaatctaaccacgcagagccgtcggacaaacacaaaccacgcagacccgtcggacaaacacaaaccacgcagagccgtcggacaaacacaaaccaggcagagccgtcggacaaacacaaaccacgcagacccgtcggacaaacacaaaccatgcagagccgtcggacaaacacaaaccaggcagacccgttggacaaattcaaaatgagaaaccgtctctctttctgaaacggactgtattcttcaaagtgtccacgtcataaaaggcaaaaataggcttctgaaatgttccaggaggctagaaaaacgcatgacaatctcttcctagactggatcatgtactggaggaagaaaaaaggctgggaaggactttatggggtcagttgacaaaaatggaacgctgatggtagttggacaggatcactgtagcaacattaactgttctaaagagatatccttattcttcaaaaatacacactgaagttttagggccatgatgaatgcaatttactctgaaatagtacaggacaaaaatatcaagaaaaaattaaaatatgcataaaacatacataaaaatagagagggcaaaagtaaaaagagagagaaaaaagcaaataagagagaaaaaggaaaataatgctaaaagtagattaatctgggtaatcaggtgtcctatgtactattcttattttagtaatttttctttaaatgtgaaactatttccaaatcaaagttgttgttgttgtttttaatttctgtctttcccttacatgtgttgtataatttggtggttttatcgcaacctgtaatttctgaaaatattagagtggtctatgaataaataaaataaattttatgatgctttcaaataatctttaacaagaaaaaaatacaggtaaggagcaaattaaacatttgaaaaataaactacagatttacatataaaagcatgatcaccgatttgatcaggaaaaaagctaaatagaactgtgaaaaatgcaatatttttgtcagtttaaaatataaaggaatattttctttagctaaaattatgcacagagtgagattataaaacatattttcacatcatattttttcaaaattgtgtttttaattcacagatatttctagactgtcaaaatagaacaaaatttatttctatagaggataaagtttctagcgtaaacacaacacacgatttttttaggcagtgggaatgctattgttttctctgaattcataggcaagttataataacctcctcttttcaattctatgaagttttagagttttgtttcaggaacttaaaacttcttttcagatttttggtgaaccttttactttctctcttcagatacctggtatctttatgtattttcaaaagggaagctgaagatgtactgaatttaatgtttaaataaagaaaatgtcttactattctaaatcttgtgttctagcaggataaacactttaaagaaatgcaatggaactctttcaacagaatttccgggtccaaaaggtaggtggtgattattttggggagaggtttcttgcaacctgaaattatgccaggtaaagcctacccccaatttcttaagggctgtcctgtggttattgctgtcagacagctgacaaataaactggcttaaaagaaaaaacctaaaataaaatatgtcaaaaagctaaaatataacataaacacataaaatgtaaaactaacacaaagcacaagtttataagtagcttttggacaaagcctgcatttctttgccacatgaaatagaacatgaaagcaggataattcctgcttaaacaaagatcgagtttcctttagatctctgtgacaaaatctcacccactgtcacttccacaagcaacaccgttttctgcggaactgaggagatgcctccatctgagcaacaatgtctaccttctgaccttccgcacttgaacctccctggcgccatgtctccctgagctgtcaacagcacagcacactcccagtcacccaccaaaaatgcaaaaatctcttttaaagaaaaataggaaggcacaagctcactgtgagctggtaaactttagatacatagaatccttatctggtgacataacttgtaacctgatttgctcgaacaccgagagccatgaccagtctacaagggcccttcagggaatgagaaaaggttctctttagagagaagcaatcctccagcaccttctccaattctgtgggttctgctccatgtgatagcatctgaagctgtggttgtctggggttcaactgggctgaaatacgcgaaatgcttcactcatgtgattggcattggtgctggccatcagctgtgagctcatccagggcatctaagggagcatttccattcgcttctacatggcctctccctgcgtcttggacttcttacagtatggagacaggttcccaagactgaggatctcaagagcaagcattccaagagaaatgaagtggctgtcacttaaggcttaggcttaggagctccaaatgccatctctgtcacattctatcctaaagcagtcacaaggccagcttggattctagtgacgggaaatctgttctgtcttttgacaggatgggcaggaagcatatgcggagagaggtggaatgttgtggaccgtctcaggagacaagctaccacactgcacagctgacattgggcagccctgcccgagcccagcggccttgctgatacccatgtcctcggatgatctgtttttggttttgcttttgttatttttgctaggttcacagtcaaatcaggataagtccgaactgtcccaaatcacccgatcctcaacctcattgttctggcagtctaaaaagtaatcatggtctgcctactcacatttaaatacacattttaaaaataattctttccttaaagccgatctttaaatcaatcatccttctgcattttagctgtctggatgccagtcttatctttcccctatggtcttctcatttcccagtcattataaattagtgtgtcaaaaattcacgttgatgtagcacaacatcatatccataatataattcatgccttcaatgaaagagttttgcttcaaaggtagacgtcattagtaagtggtgaaatttcacatgtggttaaaacttctttttgccggtaaaaataaaacactcacaagtaatactttagagccatttttaacctcttataaaatacaaaaagtaaggcagaaaaggaggaaacgatgtttccaatctctgtttaatttattcccactgcgggcaaatcacttttccttagatttacaagttttcctataaatgtgtgacactgcctttgagtaattgctacctaataaatagctctagcttcctccatgttttattactgagagacaaaaccttcaccaaatagactcatttctagttgggagtcatcctcatggtgtctgtgaggactttgctgggtgccaggtcagaaatgaatgagctttggcagagactctgcaggtggcctaatctagtccgcacgatgctccagggaaagacgaaaccctcttacaaagcaaccgtctgttccagaaagggggactatcccccagggtggccatgccagacacctagtgggctcggatgctcagagagtaattggatgtcaactgcctgtttaagcaccgtctgcctctgaccaccagatatgacaagctgtaatatattattcaaaaactgtagagttaagagggtgataagtagagaaacaactacaaaaggaatattcttatagacagaccaagttctaagaagagtcacatgggaaaaaagacatggttgaagttagaaggtgtccgtagaagtgtaattaacacagtcctgcaataatttttaacatcagaagtggactatatatgttgtcatgttccttgtcctatagaacgctcatatacttcactctctttaaagtaagtctgaatctgtgtattaatttcatttttaaagcattttcatatttccatgcagccctgagaagacatgaggacaggaattactactcccattttacaacgaagaaagctaaaaccaaaagtcttcttagattctgacctctaacattagcttctccaaatattcccttaaaggaccaagtctaagcaatttcacaagaaaatgagtttgcacagatattaaatttgctttttgactgttttattaaatactcaaaacagaatggaaaaagacatcttgaaacaaattaaaatacggtcagccctccctatgcatgggtttctcatccttggatagaaactcacagacatggagggtcaactgtactattttccatctggcttcaaccacctgcagatggggagcctgtggacacagagagctgcctgtatatttgcctcatgtggacactgggaaccagacctcctcccacgttgaaaggaaattattccatttaagaagaaaacagtgtcttttaaaataaatgtaactattgaaaagcacaaggtgtcataattaccagtaacatccttttatgagataaaatgtcttaacaggcatcaagaacgtagatcaatgtccagctctcagtgactgcaattatattcagtgacaagattaagtgaagtaactaatcatttactgtatttaaaatgctggcatcacaattcggataatgtatttttaaagggggataatgcacttttaagttctaaattaatatttgcaaagaacttagagacccctgtgatgtgcaagttggatttatacaaatgatctgaaggacaacgtccacccagccaaatgagggtaaccctagggaaggaaaggggtgcgagatcgtcctacgatacagggcaccaaactgattacttttgcttgattttcaggcaatctgaatataccagcaggatccaaactgctctgaaatgtggtctcactgaaacaaattggttttgccagcaaggtggaaatgaattcatcaagtctgtgtcacgagcagccacacagtgtgaaaacagccaacacttctcctgttgactgacatcacttcgcggatttaacttctgtgcttccaagcccaacctcttatatcctctctccaggcattttacatttcacttgccactctctactctctaaaagcagagaagcagctttgcgagaagtagtaaaattatgagaataagctggaagaaatgttttggataaagagctggtaacatttaaggcaaattgctctggtataaattcagtcctgtactagcaccatctcatagatcacagagtagccggtgggtgaagttgatgggatattgattccagcaggaaaataaagggctataaaacaaaagatgattaacacgaaatccttgagtaaagcaaagtcttaatagactgggagctgttaaatcaaagagtgggtgagaggactgggctttcagatcacttacaactgaattcttttcattgtgtattaaaattctcctgtgtgtttttactttcctgtatattatcaatccatattcctccagtgaaaaacatctgaaattgcatgtggggaaaaggaaccaaatccgggacacatcatcaatcagaaagaaggaaactcacaaagcaatggcaatcagggccttaaaaacctataaatactgtcagaaaatgaatatttttctatttctttcatttcattaagtcccactaatgtttctctacataccacgtgcacctctcttttaataaattctgctgcaatgcacgttacaggttgatttgttgcttaaaatatgcagtactcaatgcacagatgtacttctaaaatattcttctagcaagtttccagagccaagtagttttttagtcaaaattactctacaaaggaaatgcacccctgattccctccaccctctatcaacacacacacaccaccaccaccacatcaccaataccacaagcacacacatcaccaccaccacatcaccactgcactagcacacacaccaccatcatcacatcaccactgcactagcacacacaccaccaccaccacatcaccactgcactagtacacacaccaccaccatcacatcaccactgcactagtacacacaccatcaccatcacatcaccactgcactagtacacacaccatcaccacatcaccactgcaccagcacacacaccatcaccaacacatcaccactgcactagtacacacaccatcaccaccacatcaccactgcactagtacacacaccatcaccacatcaccactgcactagtacacacaccatcaccaccacatcaccactgcaccagtacacacaccatcaccaccacatcaccactgcactagtacacacaccatcaccaccacatcaccactgcactagtacacacaccaccatcaccacatcaccactgcactaatacacacaccatcaccacatcaccactgcactagcacacacaccaccatcaccacatcaccactgcactagtacacacaccatcaccatcacatcaccactgcactagtacacacaccatcaccacatcaccactgcaccagcacacacaccatcaccaacacatcaccactgcactagtacacacaccatcaccaccacatcaccactgcactagtacacacaccatcaccacatcaccactgcactagtacacacaccatcaccaccacatcaccactgcactagtacacacaccatcaccacatcaccactgcactagtacacacaccatcaccaccacatcaccactgcaccagtacacacaccatcaccaccacatcaccactgcactagtacacacaccatcaccaccacatcaccactgcactagtacacacaccaccatcaccacatcaccactgcactaatacacacaccatcaccacatcaccactgcactagcacacacaccaccatcaccacatcaccactgcactagtacacacaccaccaccaccacatcaccactgcaccagtacacacaccaccaccacatcaccactgcactagcacacacaccatcaccacatcaccactgcactagcacacacacaccatcaccacatcaccactgcactagtacacacaccatcacatcaccactgcactagtacacacaccatcaccaccacatcaccactgcactagcacacacacaccatcaccacatcaccactgcactagtacacacaccatcacatcaccactgcactagtacacacaccatcaccacatcaccactgcactagtacacacaccaccaccacatcaccactgcactagtacacacaccaccatcaccacatcaccactgcactaatacacacaccatcaccacatcaccactgcactagcacacacaccaccatcaccacatcaccactgcactagtacacacaccaccaccaccacatcaccactgcaccagtacacacaccaccaccacatcaccactgcactagcacacacaccatcaccaccacatcaccactgcactagcacacacacaccatcaccacatcaccactgcactagtacacacaccatcacatcaccactgcactagtacacacaccatcaccaccacatcaccactgcactagcacacacacaccatcaccacatcaccactgcactagtacacacaccatcacatcaccactgcactagtacacacaccatcaccacatcaccactgcactagtacacacaccaccaccaccacatcaccactgccgctagcactgccactacctcaatcccactaaatattattactccggaagctcctttacccaggaaatcaggcattcttcaagacttcatggtttcattacacaaggaaagaggcagcttttgtgaaacagagtcagaactattagggaagtaactacagagcttactgtgtccagtcagccatgcagaactgagagttaaagggacagcattacgagtccatgtgcctgcgttccagagcagaaacgctcatcacaactgaaaattgcaagttcctactgatggaaggacttttttccataagacctcaaaggccctgcagtaccctcagataaaaattaaacatttggaaatattaaaactaggtttgcattgagtcttaccttgggggagcttcagcggaactattgataaagacaaaataattcttgcaatgactctaatcgttaccattctacacaaaatatcaatgaccgaaaacaccgtttgacatgggcaagattgtatgaaaagactaattatacaaagcaagtcgattcaactatttactttcccaatgtttctcttctacccatttcacgggagttttcccttgacctctgtggaatatcatgaaacgccaaatccaagtttcgttctttggacatacacctctctaatttaatgcagggctgcccgacacagcaaataaaatcatagacacctcattaaattctaatttcaaaaaacaatgaaaaatactttagtgtaagtatgtcccatgcagtatttagtaaatacttacaacttttaaaattatgtgttgtttacctgaaaatcaatttatctgatgttttgggttttacctggtaactttaattttactctctgatgatttacattgtattttagaacttgctccatcattaaagaaaataaaacagctgtcagggatagaacagctggagaaatcacaatttgtgaatgagaaaaagtacatgaaggccctttacagccttatatgtgtaataccagtaattcccaatgggtcatggcaaaaaagagggaggggagaattagaatcattgaggaacgtttacctgagactaaaaccactgcattgtacaaatattatgcaggtctttcccatttttattttcatcttggagggcggtggttataggcaccagctttggagtgagactgacctgttgaaccatggctctgcctcttcctagctgttcgatcctagaccaggcatttaacctccctaagcctctactttttcatatttaaaatgaaagcggtgatacccatctcatgtggtaagagaaagcactgatagcggtagtcctctttctaaagcactggaacatgacccggcttaaggtgagccctctctaatcgaatgctgtcattcttgtcatattgtgcaaatgttttcaccatgcctgttagcaacagataaagttccctggcaataatcgtcacataaaatgttccacctactttatctaggagtcagctggggtgcaaatgagaagggcaagcagccacttgtaacttgcagaatatcaggctctacaggagcatttattctgaaaaaagtcaggactccagggaaagtcaagctccattcacagccgtttctctcctcatctgtcctcgtgctgactctctttagaatctctctggatggaattccttcccaactccaatggacagaagcagtgagtccgtccagtcggtaagtcaaacagtccttcgatgactccactccagggtgtgctctgtgtgatcagaacaagtgcttcagcctaacacacctacacattcgaaaaggtttcacacagcctcgttctgctcttagacgccaacactccccacacccaatctaccacaaaatagaacaacagaatcagccaaacgccctctccacggaggcgaaggacacagggtcagccaaaccccctctccaccgaggagaaggacacaggatcagccaaaccccctctccaccgaggagaaggacacaggatcagccaaaccccctctccagcgaggagaaggacacaggatcagccaaaccccctctccagcgaggagaaggacacaggatcagccaaaccccctctccacagagacaaaggacacagaatcagccaaactctctctccacggaggcgaaggacacagaatcagccaaactccctctccacggaggcgaaggacacagaatcagccaaactccctctccacagagacaaaggacacagaatcagccacatcccctctccgtggaggcgaaggacacagaatcagccaaactccctctccgtggaggcgaaggagctgctgcaactgacggagggaccgtccaattgcttggagggtccgttcagcctgtgtgggccaaacctctctaatcattgaccctggaggcttatattgcattttcaggcatattaccttattagaggaaacaggacagctgcttccctgaaagaaatacgggcaaagctcaatttgtgaagtgtgtttcatttcaaaggctgtagcttacaggcaacatggattttgcaggaccaacttgtaatgcagtttcaaacccacccaaaatctggagtttctcttgaagatttttacctttctaacatacttaaggaagtgaagaattactcataatattctttgctacctacagtgccggcaggtgccagcactgttaaaactgctgtaggtggcgggtgctttgccccctgtgccccaacaccacatgaatattttccagctgatcacttttaaacttttaacagacacctagaattatgccgctgaagagcaaatagataagtacacaacctcttgaggtttcttacagaaagaaaaaatgttttcctaggacttagtagtgaaaacacttttgcaaaaattttgacaatgagaggactctgacacagaaacattacgacgcaaaacaaatctgacctaatcgggtccatcttgcctctagcctccaagctgcccttgctcatcctcgagtgtaagccacactaactatgggatcgagtccatcttgcctctagcctccaagctgcccttgctcatccttgagtgtaagccatgctaactttgggaggaatttaggtaatagtttaactttgaaacaaagatgataacagccttccctgaaacaaccccctccttgcctggggaccagatgacctttggaaaattaacaaattagccacaagattagaaattatggctcaggaatcatgcaaccggaggccacaaaatcacggacctctccagttgttcctgtggataacattactattgtaaccctaagattggtgttcaaggtgttttcagacgctgaattttgatggaccagctggcaccacgtagaagggtaaactggctcatctggtattgtggcccccacccaggaaccaactcagcacaagagggcagcttcaactccctgtcatttcttctccaacccagccaatcagcactccccattccctagctcccaccccaccaaaccagctttcaaaaatcctagcctctgaattttcagggaagttgatctgagtcataagaaagctccagtctcccttttagctggctctacgtgtattagactctttcccagttgcaatcccccagtcttgacaaatgggctctatcttggcagtgggcaaaaagaaccccttgggtggttacagtggtctgtttgtttcaaaggcactctcatttccaaactcactagtagagaacacccacacatggacagatgcacaccctttgttttcatggcattcctaagatgctctttcagaaaccatcctttcccctggtgtttatgcagagaaggagatgactagatggtagacatattacacctgcaccttagtggtacccatccttccatcctccacattcccctccagagtgctcccttcctggtcctctcactagtcctatattcaatacagaaacagggagaactaagggtgatggcaattcttgtcctgtgaattctgccctctagccctctgtcaatgtatccagcagcaatgctcagaatgtctaggggactaatctatcaccccttcaagtgcacaggttaggagttggataataatacttgtatcccttaaaaattatcaataattttgattatcttcaaaatttaaggtcaagaatgctaagatcagaaggatctcccaggcccaccactaggcagtggtgcagggctttaaataacatgatcaagatccttgctcatgaggcacaggcactccatgtataaaatgtctgaattttagattttcaaggtgtgtaaacatgttaaaccacatacaggtattttttggtatggtgcaattgagattgtaaaatgcctaatatttgctgattacttctttatatttagtgtatcatgccttttagatgaatgctgaaatttaaaagaatacttttgaccagagatgggcagtgacgcatcttaagtagcatagaatatccctgaatttagaaacaagtagaggtggcttgtagcaaggtcatgttttaaaaacagtgaggagcaacagtccttaacctctctgatcagaaatacaggtcttatgtgaaaagaaaaaaggaaaacaaaaggtaaaatctccagaaagaaggaagacgccgagagcatctgggactgccttgttaacacagccttgggaacgctgtgatgtactttattgcagggatggcacagacatcgaatacatctaactataatcacatagctactggctctttaagttcatagtgggtaatattaaaaagaaaaaacactcttccaaggaggtcattggctacaaagtagatattttatatcctcctcaaaaatcaattctccttcaaagcaaatttgtccacccaaccctctgatcacgtagttggctctcctggcaaccagccccattctgaagctatctagggacccatcaagggtccttactgtaaactcaggcacggttgtcagtggtttattatgaacagcaaaagatggtcctcccaccccgtctcccagaaaattacaagggctgtgggaactctgtgcaaagaacctgggacaaaggtcaaacacatatttcttaggatgccgcagatcacaccaccgttgagcactacggcgactcgaagcaagaagctttcgtctgagcctactaggaatgaacacaccttgtcacgacattgagattcaggcaccatgtttagcctacggtgggaaacgagaaacttgggacctaaaagattgggtttctttttatcctatcctaacaacaggcaatcacagagtcagtatgctgggcactgcaatggcataacatcaaacaaaactcgcgtactcaaggaccctgttctactctgtggatcaacagttgtggtaagcagaagtacaacaaattgtaacttttttttttttagatggagtctcgttcttgttgcccaggctggagtgcagcggtgcaatctcggctcactgcaacctctgcctccccatttcaatagtgctcccacctcagcctcccgagtagcgtacacgtcaccacacctggctaatttttgtatttttagtagagacagggtttcaccatgttggccaggctggtctcaaactcctggcctcaagtgatccgcccacctcagcctcccaaagtgctgagattacaagcatcagccaccgcacccagcccaaattttcttgatagatctaatctgtcagtcagaaagagagttgttgaatactgaacccaccttaaacactagcagggtggacaactgtgagattcatgtgttcattgctcacatactctgaagtgcctacgctgtgtcgcctactaggtggtgcgttctgaagggtggcaacaaagtctcccctgcagcctggcaatagcttgtagatcctatacccagccccagctgcaggaagctgttaaatcctaggcccagccgcagctgctggaaggtgtctcactgcatttttcaacatttgggctgcgtcagccacctccagccacacacccaccagcactcacatgtgcagtcacctggaaatcagaaaagtattctcactcagtccctgaaacaatttaaaactgcgtgacttgtctccagcgtcggccataatcaaacggctaagttggcagcgtggttgtactttgtcatgttttcccttgtcctccagcctgaccccctcctaccccacatcactcctcccaagctgaccaccaggggccctgccaggtgcaactatgcccccaccttttaatattgttttttgagacaggatctcactctgtcgctcgtgctgactttacattttttaaaactctttcccttgctcatttcccttcttccctccactgcatctgaaacctgcccaaggtaacagctagttaatttcagatgagattgaggaattctgcttgacttcttcaggtcgtatatttgcatttgctgaatgcattctcagcaaacaagccttatgcagtttgctttaggtggtgcctgttccagcacacacaagccatgagaagttcagaaagcaagtggggtggaggcggcatggtcagcagttaggagcaccagctccagaagcaggtgatttgggttagaatctgccccacagcttactagtttagcaatttcccctctctgtgctcagtctctcatctgcaattgagagccataacacctaactcagaggattgttacaaatattagatgaactgatacaggtaagaagcttaaaacagttcctgctaagaacacaatcaatgtcacttattatgttactatcagtaagacggacgacataatttgcgaggcccagtacaaaatgaaaatgcaaggccccttgttcaaacttcgttaagaatttcaagaccaaagccacaaaccattaaatcaggtgcagggtcctgctaagcatagagcacttttgagcgcacggccacacattcacagcaccaatcctgcctcccagctttagaacaaaagcaccttattgccctaagatccagggagtcttctgggtgatcattgagaaaaaaatcctggaaacgcatcttttgtttgcctctgggagagtggggactggcaggaaaacataggtagcactttccaaaaatacaaataaaattggcccagtgcagtggcttaggtctgtaatcccatcactttgggaggccaaggtgggtggatcacctgaggtcaggagttcaagaccagcctggccaacatggcgaaaccccgtctctactaaaaatacaaaaattagccgggcgtggtggcgggcatctgtaatcccagctacttgggaggctgaggcaggagaatggcgtgaacccgggaggcggagcttgcagtgagctgagatggcgccactgcactccagcctgggcgacagagcgagactccgtctcaaaataaataaattaattaatttaattaaatgtaaaaccccccaacccccaaaacatcccacagtaggttctgcaagtggctatctcttgcacagctttttgatggaagatcaggaacaaaaatcacttcgcatatttcactaaaactgctccttcagtgatgaaatcttacaagaaatccatgttggtcattcaccataacctcctgcaaacaaaagcttttactacataaaaggaatgttgggacaagaaagtagatttgtaataagtttgcattgcatgtgagattaaaagaaaagatggctctttagattaatttattgctaaaggcataacctttactgtttaatgttgtgtttcaattgcctgtcaaactgtcagaaaatagagcctgagtccacagctacataaaccagttttactttcaccagcaattacagttttttaatcttttttaccagttcattttcaacctctttttattttatcacttgcagtcaaatctcagcaatttactaatacaaatgtgatcaaatgccttccatttatcttaaagatctaaattctgatgaaataagactatgtgatcaatacgaatagcatcctgtatccagtcccagacccttggttgtaaatcatgataggacagtgtcttcccagaggctgaatcaccggaaccagttcacattgcttagtaccagatcacaaaatcttcatgagtcatattactttttccttttttcttcacttcacatcttagtaaaaacacattcattttccaaactcatcatttccagcagcattcatttcaaccataatttcctggacaatctattcattcaggtcccttttttggagtttgtatttgactacgctgcactaaagcctgcctttttttagaactgtgctcatcggctacataacccctgagaaaaggttaatatatccccttaaacattcttaagtgccaaatctctcctattccatgagcttaaaaccatatcaggtaatttcagatcacttgaactatggttccgtgctgtgtccctcggctctctcccattctccttgccgtgtctctcggctctctcctattctccgtgccgtgtccctcggctctctcccattctccgtgccgtgtccctcggctctctcccattctccttgcgtgtctctcggctctctcccattctccgtgccctgtccctcggctctctcccattctccgtgccgtgtccctcggctctcgcccattctccgtgccgtgtccctcggctctctcccattctccttgcgtgtccctcggctctctcccattctccgtgccctgtccctcggctctctcccattctccgtgccgtgtccctcggctctctcctattctctgtgccgtgtccctcggctctctcctattctccgtgccgtgtccctcggctctctcccattctccgtgccgtgtccctcggctctctcctattctccgtgccctgtccctcggctctctcccattctctgtgccctgtccctcggctctctcctattctccgtgccctgtccctcggctctctcccattctccgtgccgtgtccctcggctctctcccattctccgtgccgtgtccctcggctctctcctattctccttgcgtgtccctcggctctctcccattctccgtgccgtgtccctcggctctctcctattctctgtgccgtgtccctcggctctctcccattctccgtgccctgtccctcggctctctcctattctctgtgccctgtccctcggctctctcccattctccgtgccgtgtccctcggctctctcccattctccgtgccctgtccctcggctctctcccattctccgtgccctgtccctcggctctctcccattctctgtgccgtgtccctcggctctctcctattctctgtgccgtgtccctcggctctctcccattctccgtgccctgtccctcggctctctcccattctccgtgccgtgtccctcggctctctcccattctccgtgccgtgtccctcggctctctcccattctccgtgccgtgtccctcggctctctcccattctctgtgccgtgtccctcggctctctcccattctccgtgccgtgtccctcggctctctcccattctccgtgccgtgtccctcggctctctcccattctctgtgccgtgtccctcggctctctcctattctccttgcatgtccctcggttctctcctattttcatattctccatcctgtgtccctcagctctttcatgttttccatgctgtgtccctcagctctctcctattttggttgacaagaatagcattagattaattttcagctttcaaaaaaaagagacaaacttaaaattttttaatatacctcttataattctcaaaaactacattttttaaaaaatgtgcctctggaatcaaatgatttaaaagtctaatttttacacttttagtaaataaaactagtaaagaaatgtactcttctgtggtctttaaaactcctcttagcaagctatttttataaataggctgtcctgactaatgattcttgggctataaggtggcgtgcccacctccctcccattcagttcttgggcaccttgtctctgatgagaagatcaataataattaggagatgatttttaagtttacttaagtgcactgcaattcctctggcttctttacataactgtgaatgatggtgaccctgagacaggacgctggggttcactaggagaagtgacacctgccgtatagtcacacatgcccgccctaccccagtttcatgcagtgctatcacaatggctgtgagggggtgtatatccttaattccagaccacaactactagcaaagcgactgggggtccacagtcatgcaggggaaagcacaggacttggagaagtggtggccaaatgactaactcaaggctggtggcccacaaatctgtcttcaaatccatgacagggacccttaaggggaatagaaaagacaattgtcaatgagagttgtatgcctatcccccagcaccctgtggacttgctgagaacaagggccttgttttcctcgccctttgtggctgacacggtgctggacacagctgcagcctataacttagggtgattcgatcaacgatcttgtctagagtgggagatagctgggagcagtggtgaaataagaacatgaaaacgaaggttttgttagcagagaaaggtatggaagacaggccttaatgggaataacaacaggagattgctgatatctgagggattgatgggagtgacaagaaaaaagaagtaaacaagcggagtcatgggaaaggcaccaaggacaggtttcttaaaaagagctctgaagctcaccagtagcaacaaaatggtggcatattaaaagctgagacagtttcaaccaagggggtgtttaatcatcatatatgggaagtgctagaatagtttctggtggggaatccattttttagttcaaaattgatgttgacctctgaacatctagtcccaatcaacaacccttgaagcttcagcagacactatgtcaaaggctgcttagagaagacatccaggagacactatgtcagaggctgttcagaggagacacccagcagacactatgtcagaggctgttcagaggagacacccagcagacactatgtcagaggctgctcagagaagacacccagcagacactacgtcagaggctgctcagaggagacacccagcagacactacgtcagagcctgttcagaggagacacccagcagacactatgtcagaggctgctcagagaagacacccagcagacactatgtcagaggctgctcagaggagacacccagcagacactatgtcagaggctgctcagagaagggacccagcagacactatgtcagaggctgctcagagaagggacccagcagacactatgtcagaggctgctcagagaagacacccagcagacactacgtcagaggctgttcagaggagacacccagcagaccctatgtcagaggctgctcagagaagagacctagcagacactatgtcagaggctgctcagagaagagacccagaagacactatgtcagaggctgctcagagaagggacccagcagacgctatgtcagaagctgctcagagaagagacccagaagacactatgtcagaggttgcttagagaagggacccagcagacgctatgtcagaggctgttcagaggagacacccagcagacaccatgtcagaggctgtttagagaagacacccagcagacactatgtcagaggctgttcagaggagacacccagcagacaccatgtcagaggctgtttagagaagacacccagcagacactatgtcagaggctgcttaggcaagagacccagcagacactatttcagaggatgtgtagggaagacacgcagccagaagggtttggttattgacaagataaaatgaccaacctgtgtttttaggatgcattgtatgaaatcaccttccttagaaatatttgataaaatatgccatcttttatgctgagcaaaagatatcagacacaaatgaatacatattgtgtgattccacttatatgaagtttgaaaaccagcaaaaccaatctatagggacacagagcaattggtggttttctggggctgaaaaattactggtgaagactgactgacaaggggcaagagggaacttctagagttacagaaatgttctacaccttgggtacaccaacacatacatttgtcaaaacacactgtacttgatctttaaaatgtaggccttttgttgtatataaattatatacctcttaagttgattttaaaaaaaactgtctttacttaaatttagactttgaaacccttcagaaagtcctaaaaattctgtacaattagtattgaacactaggatacacatgggcaaccaatcctagacagctcagcacaggacaaacagaaaggtcatcctgcaacatgcaatctagatgacgaagaaagataactcaaatgagacacctcagagacctctgttctccagttctggctctgattttcatgaattacaaagtaaggaagattcagagttaatagcatagccacaatgtaaaatatatttagtttgttgaatattaacattttaccataactataatgtacatttagtttgttgatcattaatgtttgtttcctgtatgaaaaaaatgtatgcatatataattctcgttctacatctaggttcattcattctatctactaatccttttatggccttttaaaagctggttaaggaatttataagatgactgtctagaccagaggaactcaactgacaatggaagtgatgattctggcagctaagctgggtagatcttactctttacagactggtgtttcaaaaggtcttgctcctgtcgaggggtgagttacttcacctctagtacaagcccaaggtatcctaaaccaaacagcactaacagggcccacccgtctctgggcagcaaaatatttttgtttgttggtgttgctatttttgtttataaatgtgtcgattttgtctaatctgtagaccattctttactgaacatgaggaacaaggcatctttcagatgtagcagagttcagtgcaaaagcactgagctgactaataatttggagacttgggttccaatactggttcatcattaaccagaggcattgcttcaggcaagtcaagggacctctttagatctaatctataaactaggggaaaaagaataaatgaaatataagaaaagattcctttagctataaaagtttatgattctatatgtcaaaaccaccagaaaatcttagacctcacctggaactttaaagaccagagttccctacgaagggattcaggacccttcaggacacatataaactcacaacaatggacctcatatgcctggaggcttaattgacctaggttgttgcaaacgaccaagcttctttctcttataaggctgaatagaatttcattgtatgtgtatagaccatgttttatttatccaatcatctgatggtcacttaagttgataccgtaacttggctattgtgaacagagctgcaatgaacacgggagtgcagacatctctctggcatagatatgggttttgtgtcaatacacacaagcgggattgccaggtcatatggtaattctatttttagttttttgaggaacctccatacagttttccataaaagttgtactaatttacattcccaagaacagagtacaaaagttctcttttctccacattctcaccaaaactttttaatcccttctctctttttttttaaatagccatgttgagaggtgtgaggtgctgtctcattgtggttttaacttgcatttccctaatgattagtgatattgagttttttctttttacatatatttgtaggtaatttgtatatcttctcctgaaaaatgtttattcaggtcctatgcccattttttaaattagtcttatttgttttctagagttgtttgagttccgcatgcattttggatattagcttcttatcagatatgtggcttgcaaatattttctcctaatttgtaggttgtttctgttgtttcctttgttatacagaagctttcatatttcatgaaatcccattcatctctttttgcttttgttgcctgtggttgtagagtaaaattgaaaatgtaattgcccaaaccaatttcatgtagttttctccctatgtttttttctagtagttttacagtttcagattttatgcttaagtcttcgacccattttgagttaattttttcacatgatatgagaaaaggtttcaatttaattcttctatatatagatatccaattttctcaaaaacatttattaaagatatccattttatattgtgtattcttggcacacttacgatcttttgtaatttagttttataattgatcctttgcagaacctggagaggtgcttgtggttttgacttggctgattgcctatttagagtacaattcagtatgttcttccaaactctgcttctgctgcaaattgttaactgaatccagaggtttatttgacaagactatacctgctagcatgttctcccatcaggaatcacatactatctagttgactctatctcttttatgttggcagtctttaatgctcaatgcctagatcaggggtcagtaaactccagccactggccaaattctgacaatcaactgttttatttgtcctatgaatgcagccagactcatttatttaataattatctatggatgccttattgaaaatcaattgttcatacatgtgttggttcctttcttggctctctatcctaatccattcattgatgtgtctgtttttctttttttgtttgttttttgatgtgtttatttttatggcagcactaagctgatgtagtagtatagtttgaaatgagtagtgtgatgcttacagctttgttctttttgcccacgattgccttggctattcaaggttttttgcaattccatgtgaattttagttgtctttttatttctgtgaaaatggcattgaagttttgaaagagattatattgaatttgcatattgcttttggtagtatgtacattttagcaatattaattcttccaattcacaagcatgggatatctttttccatctcttcacttttagtctatatgtgatatatatatatatttattatactttaagttctagagcacatgcgcacaacgtgcaggtttgttacgcatgcctatatgtgtttttaaaagtaagatgagtatcttgtaggtagcatataactgggtcttgtttttaatccattcagccactctgtctttttattggagcatttacattcaaggtaattatgaatgttaaggacttactacctccattttgtgaattggtttctgattgttttgtagatactttgtttccatcttcctttctttctgtcttcttttgtggcttgatgattttctttagtggtatactttgaattctttctatttttgttttgtgtgtctactgtagatttttgctttgtgattagtatgaagcttacataaaacattttacaagtgtaacagtctattttgacagttcatataattgttatgctataacagttgtaggtagtcaaagtcacacaactctccactgttatctccctgatattttacgtttttgatgtacgaatttacattttataatatctatcccttgaaaatgtatttagctaagttttattaataattttgtcttttaacccccatactaggaataaaattgccttacacatcatcattacagtcctagagcattccacatatgattctttattatgccattgagttttgtgcatttgtacattttctgttaataattattggccttttatttcagcttaagaaactccctttagcaattcctgtaaggcaggcccagtgatgatgacctcctttggctttggtttgtctgggaaaatttttatttcttcctcatttcacaaagacggattttctgagtaaaatattcttggttggctatttttattttccttcaacattttgaatctatcatcccattatctcctggccttcagggtttccattgaaaaatctggtgagagtctattgagactattctaggtgctgtgtggctttttatctcttgccactctcagaattttttctttgtcttttatttgtgatagtttattatgtgtcttggtaaactcctctctgggttgaatttgactggagacctctgtgcttcctataccttgatattggtatatatcctcatattaggaaaattctcagccattattttttaaatatgctttcttacccttttttgtctttcttctctttctggaatttatattatgtgtatattcagtctcttgagggtggcacatatttctgcaggctttcttcattcttaaatttattttttttaatttttgctactctgattggataatatcaaatgttctatcttccagttcactgattcttcttttagcttgatcaaacctgctgtgggagctttcagttgcatcttttcagttcagtcattgtattcttcaactcttgaatttctgttggtttttaagaattatttctatttcatcgaagttctcattttgttcatgtattgttttccaaatttcatttaattttctatccctatattattgtagttcatgatcttctttaagaggatttttctaaactcattgtctgtcattttataaattgtcctttccttggggttcattgttaaatctattttagttgatttttctttttaggggtgtcatgatttcctgagtctttgttacccttgtaaggacgttatccttctatccttacattagtgtctgcatatttgaggtgatagccaccttttccagtttttgcaggtattctttggcaggaataattgtcacagtgtagtgtagcctgtggttctgaacacatcagctcataacaaccctgaatatgtagagcttatttgggggttctttcattgatggtgtgctgccttttctgtgagtttgaatggggcagctggctgggatctgctacccaagcaagagctcagcaagaccactaagctgaactctccagtgaggatggactgctggatgggcactgcaatttgcctctgattagactgggccatgaagtgtagtattctctggccagttggtacctcaatttaaagtcagcagttaaacagggttgcagaaagcactctgaggttaggtggagtcactgactaggatggatgggaccagctactatgctcggtaaaaatgcacagttgaggtttgcctacctgcttaagtgaggtcttggggtgggctttgagactaggctgagcattatttaaactcctgggtgtgctaggtcaagtcctagctctttgctgaaatttgctgcggtggttgtccccttccttgggtgggatatgtgtgtgggctttgaggccatgcaaagtactatttaaacactcctcggtgtggccaggcatggtggctcacccctataatcccagtactttggaaagctgggacaacaagattgcttgagcccaggagttaaagaccaggctgggcaacatagtgggaccccgtgtttacaaaaagtttaaaaattagctaggtgtggtggcatgcacctgtagtccaagctgcttgggaggctgaggctggaggatcacttgagcccaggaagtcgaagctacagtgagctgtgatcacgccactgcactccagctgaggtgacagagtgagaccctatctcaaatgaaagtgataatagtaataaactcctgagtgtgacaacactagccctggatctttgccaaaatttgctgtagtggttatctccctccctggacatgttctcagggtagggtctgaggctggtcatctaaggattcaagccaggtagaacttcccaccgcttctgagggtgaccagctcagatttgcaggtgggtatggtgttagctggtactattgattgggtgctactgctggcaggtgtgcagagctacagccaggatctgtctgcttgtcactgtggactctgcctcctcgctttgcttctatctcacccaaggtggtctagccatgccatttcccctctgttcctcctgaggtgagaccagagtgggcttcctgggaagcatctcagaatgctagggaagcttcatgtctgcctctgattctccttttgctctgtaggaactgtagtttctggggaattccatctgcgaggtgctgtgctgacttaggggaggaggaggagagacatggtcaacatgggattgtttttcttaccctttaatgtagtgtttattcctttctggaccacacagctgactctggcttattcccacatgttagggttttcaccaaggtattcttgtctgcaggtgtttgctagctgaactttctgtgtgtggcaggcggcaggagatggtagtgaagccagggtcctcttattctgccatcttgctgacatcactccaaatcacaattatcaattttgctgaatgcaagttacaactgtaaaaacatttccagaattttgagagcacataacattattagaccatctaacggatttaaggaccatccacagtattccataagcaatagatcaaaatgtcattttagcaaagtggcatttccacgtggggtcgcctatgtgttttcttactttcttcaacactgttgcaaagtttacctactaaatgaggttagctagaatgagttctttttttaatggagtggcaaacatagtagctgtttcttccattatattctctcataactctttgggccctggggccacaattatttgtgacatgtttggatttatagaattgtactcttcataatttaactgtctcagggcacaagcacagagaacgcagtcaggaaataaacatagtctaaaagatgaatttgtgatctgctctgagggtcagtaagctagccctctgccaaaccaaggcaggtagagaattccgtgatgaggcctgaagaaccacatactagaagaaattttgtacattgttacctcgaagatcccaaatgaccctaaatattgcctgtaattcagcacgaaatgacaagtttatgctaattttttaaagaaagcacatgctttagaatacgtttagtgaatgtttctgctctcttggtataaacagagtactgagtttgaacactgaaccaacctagtcattaagcatttcagcagtacctgctataagtaaccggtgaaataacactgactgtactaacatatgacatttcaagtgtatttcaaggtgtggctctgcttgaatgacgggtgattgctcttttaacactgtggcatttattactaacctgtcagaaagctgcttaaataagaatgattggagcagcatgtctaacactctggccttaatataaaaacaacttgaaaataggcatttctctttttgtatccatccttctaattacaagcctaaaaaggtgttttcctttcttcaaaaatatttatggcatacccacctctgtgctggtagttgggaaacagagaagagtgaaacaggcacctcactacctaatggggttatagtctggcagagaagacagacatttcaaaatcatcttacaaacaagtcataatctgtgataaatgctatgaaggcaaagaaagtgcagaaacaaaaataaggggcgtagtttagagacggatgggggaaactgttatgaaagagatcttcgaggaagtgagatctgataagcagtagttattcaagcaaaactcaggtgagtctcttaggcagagggatcagcatgtacaatactcctgggtcagacaagagcttgttcaagaaactgtaaaaaggccagtgaaagcaatgacagcaacctgaagctcgaaagtagagtggaaagatgaaacagacaccaccagcaacgctaatgatcttttactttatactaattataaggggaagtgtatttgctctgcaacatcaatcagctcgcttccaggcctccctgtgagagcacttgcgtttccgttccctctggtctgctgtaccagttttcttcactagctcattcatttaccagtgggcaaccatagcaaaactatcacaaactgggtgacttaaacaacaggaatttattctgtctcagttctggaggtcagaagtctggaagcaagatgacagcatggtcgattcctacttggggactcagagagaggagccgtctcacgctttcctcccagcttctggtggttgccgccagtccctggcatcccctggcttgtggcgttgtcaatccagcctctgccttcacggtcgcatggcttctcctggagtgcctctgtctctgtgtacacgtttccctcatagaataccactgtgggctagggctcaccctaagtcagtatgagctcatgttaccttgatgatatctgcaaaaatcctatttccaaacaacgccatagtcaaggtaccaggggttaggatttaaacaagtctttttgagggatacaatttaaccaataacagaaggctattgaaggatttttaccaagggagtgatatcgaggcaggaaaacagggtctggaacttaaggccaatttgtgctgaatcgaggaaaaacaccagggtctgggggccaattggtgctgacttctcaaagctggatcaaaaggaggacacctgggtctgggggtagggaacctaaggccaattaacacgaacttcctaaaactaaaccagaaggggaaatcccatctccccacgccgagcagcaaaggatcaaatctccctacagccctcccgcttccagcacatctcagatggaaagagagagtgccctgattggccaagcatgggccaccccttcctctgcatagggcaccaattcacctcagcctttaattagccaggaaccaaatccttcatccagacaagaggtaacttataggagcctcaaaaggggtacttaaaacccggaaaactggctccttcccccgccctgtggagtgctgtcttgcttcagtgactccagctttcacaccttgtggagggctgtcttgcttcagtgaattcagctttcgctgctttgttcttgtgtctcgttcctttgttgctttgtgggttttgtccaattctttgttcaaaacaccaaagaacctggacaactgacactcaaggccctccttccagtaacaatatgatcctattttcacttaacatcactttagctacttgacagaaaacggatcggaaagagtcaaagaagaagggtgagatggattgagaggctattttggattccattttggtagacgtgttctgaaaaattttcgtcatatttataaatattatataaataaatatttctaaatatttaaaacatttagcaaggcaagaaataataataatataattaactttaaagggcataaaaatattcacaggccaaaaaataaaaagaagacttaaaccccgaacggtgagctatcactgcggctgtggagtgatcaggcagcagcctctgggcctgaaggcttgcattttgcatgatacacaggacaggaggagaggcatgatctcagcccaaagaggaagttacaaataaggtctccaaataaagccagcgcccacaacattgatgtaaatgtttatatactttctatagattatatagaaagacataaaaatatatctctctatatatatccatccactggtttaaaaagatgacaaaaggtgaccaaaaaatgtcatccttagtttggactcaaagtgacaaaaatagatgtttttcatgacaacatctgtacagttgacacgctctggagttgggtttaaaatcataccacgcagtaactccaggaaagttcaaaccgagaaactattttacacaaccttgagtcaggaatgcccaagaaacaaaaacacaaattctctgcggaaggtgcaccctcaacataaaccttgacagattcttgcacgtaaagtccaaacacttaaatgtgagcttaatccaaaatatgtttttgaaaaagcaaaatacaagagttaacggaaacaaccaacagcagaaaaaaccaccaaagactttcaagtataaaaatattggatacaaattataaaataagtatttttaaattatccaaaaaagaaattgaaattatgaactagaaacaaaatgctataccaaagaaaacaggctatttgaaaaaagaaccaaaaagaacctctcaaacagaaaatgtaatcactcaaattaaaaattcagtaggtaagataaacaaaagattaatgtagctaagaaaatgacttatacagaaactactagaatgaagctcagagacataatggagataatgaaatgcaaaatatgaaagaaggtgaagatacaaaaagatcagccctcaaagacacaacaggttctgaagagtggccagaaggcgaggattggccaagcgtggtggctcgcacctgtaattccagcagtttgggaggccaaggcaagtggattgcttgagcccagcagttcaagaccagcccaggcaacatagcaaaaccccatctctataaaattaaaaattaaaaatgaaaaaaataggaggtgaagatagggaaataagagaaaccaaacatttctaagcagattagatgaaaagaaacccacatctgggcacaaacttcaacttcgggccaccaaaattaaaaaaaaaaaagaccttaaaaatagccagagtaaaaagtttaccttcagtgaaataaccgttatatgaaaaacaattttttccaacagtatcagtggatccagaacaaagcactagcctaaaattctgacagaagatagcatccatctcaagatgtttgctcagcaaactattgtgtcataattaggacaaaataaacacattttaggcaaacagaatctatgtttaatataatcagactcttgctaaaagaattgctaaaggaaggccgggcgcggtggctcacgcctgtaatcccagcactttgggaggccgaggtgggtggatcacgaggtcaggagatcgagaccatcttggctaacacggtgaaaccccgtctctaccaaaaatacaaaaatttagccgggcgcggtggcgggcgcctgtggtcccagctactcgggaggctgaggcaggagaatggcgggaacccgggaggcggagcttgcagtgagccgagatcgcgcccctgcactccagcctgggcgacagagcgagactccgtctcaaaaaaaaaaaaaaaaaaaaaaaaaaaaaaaaaaaagaattgctaatggaaatacttcagatagagtaaaatgattccataaaaagggtctgggatgaaaaaaggaacaataaaccaagaaactggtataaatgaaataataaaaacactgtaaatatgtggaggcagaatctaaataacacacaaaaatacaatgtaaagcaggtggcaattgatgagaattaagatacagcattgctaggaaggagaacagattcattttggattttattaagattaagagcagccacagaatgatttaaaaaagggtttatggcttccaaaccagtagagagggtaaaaataattttaaaatcaaaattcagtcaaaaaggagagaaagaaagagagaaacagagaaagaaagaaggaaggaaggcaggcaggaagggagagaaagagggagaaagagggaaggagggagagagggaggagagaaagaaagaaagggaaaaagaaagaaaaaaggaaagaaaaggacaacatagtaacaggaggaaaatgtaaagcacaaaactagatgatgacaataaatccaactctaaaagaaatcatacaaaatatgtggatcaaaatcatcaatttaaaaacaaaattttagacatagtctttaattcagtagtaaattatatataagtgacatatttgaaacacacaagctccctctctcttccaaacaaactagattagatgataagaggcaggaaagagaatgaacctttgcttataacctactgtaatgtaccccctcgtaatttaaattatgtctcagagttagattttattatttccatattacagacaggggattggggtgcagtgcttaacggctgtacccagagtcacacttggtagtaatttgcagagcaaagatctgcaaagactggctcttgtggacatcacaacagtgccatgtgaaacaaagtggctttcagaccaggacagtggtactgagatattcttatgatgcccaagtcacaggtgaaaaggaaacagagctaatctctgctgatggtcccattaacgggttctcagtgttttctgttttcatttctttggggcagtgaacacccagaccactgaattcagaaatctttatattgtaaaccactttgttcattctctactaaattcacctggtctgtataatttgaaaagctgcatattttattctttttgatcaattgtttttattcaaaatgtttcttattctttttgatcaattgtttttattcaaaatgttttacgtaaggagttcaacgttttcgtaagaatgagctacccatgcaggcatctacctgctcactggtgggagagtgaacataaatattgtccagggaaattgagaagaaggcagctgacatgtttctgctaagaagaagccatctctttctttccatctctctctcttcctaagaaaggcagatcaggcctaaagccctagcaggttagccgtgtttcttctagaagtcaggcctacgatggagcggtagaagccaaaggcaagaggaaagaactggaacagagctgggcgcagggtggctaagtccacaacgtaaaaagttgaggtcgtgtgatgtttttatttcaatagctgacaccctgcattttaaataaggcttaactttttaggtacaaattgttaacctaatacattttaatctttttaagatgatgcatagtttgatcttgtacatataaaattttactttttgcctgtctctaactcgctgactagcggttcttcaccctctccatatgtgtgtgtccacgcacctgtctgtgagtagatacacggagagaaacaataagatgtctgacatgacgttcacctaatttaataatcagaatttctaagtagtagattttagttggtatctgttttcactttcactttgttttttttttttgagccggagtctcgctgtgtcgcccaggctggagtgcagtggtgccatctcggctcactgcaagctccgcctcccgggttcacgccattctcctgcctggagaattctcctgctgggaccacaggtgcacgccactgccccgggctaattttttgtatatttagtagacatggggtttcatcgtgtttgccaggatggtctcaatctcctgacctcgtgatccacctgcctcggcctcccaaagtgctggaattacaggtgtgagccaccgcacccaaatgaaaatgcaccttaataaaattttaaaaaataattcatgcttattgtagaacatttagaaaatgttaaaaagtataaaagagcaaaataggtatcacggctaattctatgactgttaacattttagtgagttttcattacaatcaacttgaatgttcaatttggactcctactttttttacataatgtgtttttctgtgtctttaattatttggaggcatggagaatgggactatattccaggagtccggagagtgaggaatgatggtgatctgggactctggttgtgggagtagaaatgaaagtcaatgaagaaacttgagaaatatttagagataagattgacagaacacagtgatggacttgatgtgtatttgaaataactttacgtgttttatttccacaaatgtaaaggtctcataattttgtcataaatcacgcacaaagaacacaagggcaacaatatcttcactggagacacatgcaaatttcttacaaagtcagcgttttaaattgtgaattcatgtgccaacatatttacttaaagggtataaagaaccatgttatgggtattatattttctaataattttactcaacactctgaatgtgcatagtctatcctaaagatcaggtagaaatgacgggatctgaaatgatacaggagaaaaagtcttggctcttaaccagagacttttatggcatatttctatctttactacataacagtgaagtctattaaaagtccaaaactgaagcaaattcacctttttataatgcttcaataattgtgttttgagggtctttgctacatacttgaaatatattttcaaagctatctgactgatttatgaagaaatacacatgtgttttgtgcttcacaaaagcacatttggatattattaaacagaaaagataaaatattacataggtctgaagaattaattttaaaatgtttctttaagataaacagtgtatcaactatatcttaaatgtcatcactttggatgaccaactaagcagatttacagacaaccgcatggctaaacaggaattattttggtctctttgtcataaactattatgtccaaagacagcagcagcatctccatcgaccctgcagtgggaaatctgccctgtcacagtggaatctccacgggcaacaagggaaagaatatacttcacactatgcataattcctcaaaagttttctcattttgagattggctcaaaaacgatgtgctaaataaaattctagccatcacaggtaaggaagaaggaactgtcagcattccatcctacgggctgtaattcagagctgctgtacaagtcacacgctgttcttatcagaaatctgctttcttagcttttctttacacattccaacctatcttcacatatgctgagatttctgtgaggaagggagcactctaacataaaattattggttgctattttatgacttgtcaggtctatggcattcagaaatgcaggcatgcatgctgtgtgtcttacctggccaaggcccaagtcagccagacatgtgtccctgggaatggcccctctgctgattggcatttgtctgcaggatggatgcagccaccccaagaccttctgaattctcaaggttccttgaagaactgcagggaactttgcttctttgattactgaaactggaagatgcagcaaactcttcccaggacaaagagctggaatagaaaggcaaccatggcactcactggcaacactgtctccccatgtgaaggtcattggaggtcaagctccagtaaacccatccaataaacctatttcatggaggattcattcattcattaattctataaatatttcctgaggttctactgtgtgccaagcactattccccacatcaggacagaatagccaacgaaagagtcaaaaacacctttgctcggagcctacatttcccattttggaaggcttcttgggccaaaagaacccagagagaaggactccatcccttctcctgcagcaccagagaagaccctgctgcactctacaatggtcaagtccaggaaagaaaattcaagctcctggttataaatgataactaacaacaaagactacagcaactgagatgttatgttccttctgcaaagctgaatttctctagtcttagtaaacataaagctgcacttttcttagaaaagccaaggggaaatcagaggatgaataatcggaacccttggagtgaagtgtaagccatccgatatttggcttatgtttcactgtctgtttcttaagaggagttaccttgtgttcattaccttagagaagagaaagacagacagaaaaagaaaactgtcacagatgctgggaaagtaagcacttgtattagtaacagaaaaccacagtaacgtgaggagtcactctcagaaagactttaaatcctctctcactctccagcacataggaggcctagggatctttagagaaatcagggagaaggatagataatatctcagcaccatgactctcccaggaacataagatagaatgtgaggcaggggccccatctttcaccagtttctactcattggtaagaaaacaaggcttgctttcttatttaaagaacaaatcctgtatccaccatctgaattattcttggcatctgatgagggatggagactacagaggcaaatttgaaagaagaaatattttattttacaagcttgatttgaatataagccttaaatttatgttgaccaaatccaagaataagattatacaaccaaaacatagcaaggggcaggggaagttttgagtttttttcctaattacaaagcctactaggagactaataatggggaaaactttctcatggagctgaatcctgcaaaacctagtgataaagaacaagaaaataagaattgcagtttatttccattctctttttctttcgttattttatctttcttaacctataatatatatgattttgcttgttctaaaagtgagctcactaaaagtgagccttcgttttatgacaattgtagcccagatatatctattgggaaattttttatatgaatgcagtgtctatatctatataatattcatttttgtagtctgtagatctgaatgggtgactaaattaatgttatgaacggctcacttgaaataacaaagagataattccttaatatataagcacaaaaattaaaatcaatttgcaatcttgatcaaagatatcaatagtcacaaacaaggctgattaagaaagcaacgtgaacattctgtaacttgatcacaacccataatgagtgttgtccagaggagagccttttagcaattcacaaggccctgtgtgcctaacagttaattcctgcttagccagattgtgcagattcattctcaggcacaacatataaaatgctgggaaataccccgatttttggctgcagaactgcaattgagccatgaggaagacagtctccgagaagacataggagggcacagctctcccatgaggaagacagcctcagaggagacataggagggcacagctctcccatgaggaagacagcctcagagaagacataggagggcacagctctctcatgaggtagacagcctcagaggagacataggagagcacagctctcccacgaggaagacagcctcagagaagacataggagggcacagctctctcatgaggtagacagcctcagaggagatataggagggcacagctctcccatgaggaagacagcctcagaggagacataggagggcacagctctctcatgaggaagacagcctccgaggagacataggagggcacagctctcccatgaggaagacagcctcagaggagacataggagggcacagctctcccatgaggaagagagcctcagagaagacataagagggcacagctctcccatgaggaagacagcctcagaggagacataagagggcacagctctcccatgaggaagagagcctcagagaagacataggagggcacagctctcccatgaggaagagagcctcagagaagacataggagggcacagctctctcataaggaagacagcctcagaggaggcgtaggagggcacagctttcccatgaggaagacagcctcagaggagacataggagggcacagctttcccatggcaaagggctcaagaagacctggactctgctgtgaagaaggaaattgtcccagaaagtccagagcaagagtcctcccaaattctttatcagctcatcctaagagctcactggatggcttcacgggggtcattaattcttctcctcactcaggagctctagtccacaagtatccagtttcacacacagctgcaagacactccattctagggccacagtccaggatgcagtcttcacagattttttgatcaaatggatcaagagtagagggtctgtccatgaataataaaacatagggaggaaataagacacatagaatggaattctctctttgggttgagaatatatatacccaataattctttttttattcctttgtaggggaagaaaggtttcttttcctcacccatcactaggactatggccgatgcccctgtaacaaagtacagattgagagaaaagtgtacacatgtatttaaaaagctttatgtggcacaggagtcttcataagaaaatgacccaaagaaacaggaaatcttgtgtatcatagtgcttagttaggttggatgaacagtggactcaggtattggtacaattggacagagtgagtatgctctcatggagataaactgggggaacttagcaaggcctgtgtgttcaaattcttctctgtgtccctgtgtcttcagagataaggatgtttctttcttctgggtataaggactcttcctctcaaatgaggtcttatgatctgctcctggggggtcagagagtgacctgcctgcatctgcttcttctcaaatgccacttgtgatgcccttcctgggagacaaagccatctttgagtatttcaggattccaaaatagactccattccttggatttaccaaaagcaccagcctaaagggcctgtcaggaagttcaccagaaagagaaacctatttccctgtaagggaagtggctggatggtcccgccccagattctctgatgtggacctcacttgggatgcaaccctggtacagctcctccatctcagtcattagaagtaagttcattgaaaatggtcttctgatacagtcattgctgaattgcagtttcaactaattatacccctcagaatctccttgaattctaacaactaagtaactaaatgtctactaagtacctataattgtgctgtcaagagtaataagtgaggccaggcacggtggctctcgcctgtaatcctggcactctgggaggccaaggcgagtggatcacttgaggtcaggagtttgagaccagcctggccaacatggtgaaacgctgtctctactaaaattacaaaaattagctgggcgtggtggagggtgcctgtagtcccagctgttagggaggctgaggcaggagaatcacttgcacccaggaggcggaggttgcagtgagccaagattgcgccattgcaccccagcctgggcgacagagcgagactctgtgtcatttaaaaaaaaaaaaagagtaataagtgaataatatgcaacattattctttctacagcttcatatgcgttgcatttacacatgttcttatgttttttatgagacttatatagtgtgcaatgtgtattttcaacagtgaaactaaaaacttctcatgtgtctttcttctttggccttaaaaattattttttatgctaactaaatcatctacattattactctgtgctaactaacataaataaactagtacactattctcatttacccaacttttttataccgttcctaccaacagttccaaatataagctgtattcatcatcagttagttctaaagagtttaggtgctcccccaatgtgctcctacagcaccctgaacctcctgcgtatgagctttgatcatcctgtattgaaatgagaaaatcctgcatttccactttgtgctaaccccagcataccacgtctgcagagtagagactgtgtgtatcttactcatccttgaagttgcagtgcctgggaccccagcataccacgtctgcagagtagagaccgtgtgtatcttactcacccttgtagtcgcagtgcctgggaccccagcataacacatctgcagagtagggactgtgtgtatcttactcatttgcagtcacagtgcctgggaccccagcataacacatctgcagagtagggactgtgtgtatcttactcatctgcagtcgcagtgcctgggaccccagcataacacgtctgcagagtagggagtgtgtatcttactcatccttgcagtcgcagtgcctgggataggtgctcagttgctgaatggccacagcccgtgtgttctttctgtagtgtgtgtctcattcagaggctcagctgcagacacaggctgaactttacacaaacttctttcccaccagtctgtttcaaaggagctcaaccatgccccaacatactttgacccttttcagtatcaattttcaactgctgttttctactccttgaaagcataacaaataaaagaacttttctttttcagtaaattctgaaacataattaccttaccagtcatgccaagtgaatctcattaagctcttttgattaagataatgctaattcataaaagaaagtatcctaaatttaacaaacaggaaaaatcagggacttgtctaattcaactcacaaaattgagccacgtttcttttaccatgaacatggtgaaagggattcaactaactaaataaaagaaaacaaaaggtaaggttaagtaatagcatattacatttggggatgaaggagagtctctaatgctgtaacagagggattacttttgaacttattttccccgtctttattactgactttgtagaggagtaaattgcatattttttttctttttttgagacagtctcattctgttgcccaggctggagtgcaatggcacgatctcagctcactgtagcctccgtctcctgggttcaagagattttcctgcctcagcctcctgagtagctgggactataggcatgcaccaccacacctggctaatttttgtattttcagtagagacagtgtgtcaccatcttggccaggctggtctccaactcctggcctcaagtgatccacctgtctcagcctcccaaatcgttgagattacaggggaagctgagatagcaaatttgttaaggcttttggagttgttgttggattctgtaggagtaatatcacaaagggtgcccatgtagaaggagcccctttactcacagcatttatcatgacctgggtaacaggcctattcagctggggaatatcccagtcatcataaagtcagccccacacggctcacatacaaagcatatcggctgggtcatctggggtgctccgacacacaaagcatatcagctgggtcatctggggtgccccaacatacaaagcatatcagctgggtcatctagggtgctctgcttggcatttataggtggagttggaccatctgcttatcacggaaaacagaccttcctgtggcttttctctagtccactcgtctggctgttcctgcatgaataacctcctgtgtgtctggatcacatatacccatctgtggttgttcaatagtgagtgtgggtcctgcaccagcccaaacaactcttccactctgcagcatttaaaaccagagacgctgctcctaaattagtcactctcgatctgttttagtaaaagttcctcgagaagttaatgatatcaatgttcaaaatggagcagttccttcacaggacaccctctggtttcaacagtagttggattttcccttctcccacattcactgccttcttggtgaccacagttctgaaggtactttctggtgtccaggcttaatgttcccctttctgggtggctttgaggctggtggcctgagttgagacagacccacatctgagtttattccagcctcaaggccttacccagcaccgtctttaactttcattttagccattatagataacaataaccaagggactgaatcttttgcttttttcttgttagtttgcatttccttatgcatccagtgaactaattcctgggaggttggatccatctctaaattcggctgataacttttacctttagtaactgatctcaacatagctgcagcttcataccatgagtgaccacgtggccacctgggaatcgaagattcttcatcctcccaccctttaatcctttctcttttcaaagcacatgcttccatcagtcagggccatttaagcaaatcccacttcactgacaattatgtagggaaaaactctctcaaaccttgttttttttccctctactctcacaccacaaaaatcatcagcacagaagaagacttctatgaccaaatgtatgggggtcttttccccatgcatcaagcgcagacacaagtttggtgtcctcgaattcagttctgacactgtctaccctgagatagcatcaggtcccatagattgggggctcagtacccaagattctccccagactcccagacacgagttgcaagtctgggcttccagaacatctgactgactggcttcaggttgaagttcccatgatccccgcattgagtttgattaatttgctggaacagctcatagaactcagagaaacacgtttaccagcttatcacaaaagatgctacaacagatacaggtgaaaagacacataaggcacggtatgggggatgtggcatggcacttcctcacctccctggacactaccctcctctacgaacctccacgtgttcagctaaccagaagctttggtgccattttcaaatgccatagcctcactttgtgtctgtgtcacattttggtaattctagcaatatttcaaaatgtattagtatacttgttatggtgctccgtgatcagtgacctttgacgttactgctatgttctggggcaccatgagctgcaaccatgtacgatggcatacttaattgatacatactgtatggactctgactgcctcaccaacccgctgttttcccatctctcttcctctccttgggcctccctattttctgagactcaacaatatgaaaattaggccaattaataatcctacaagccaaataataatcctacagtggcctataactgttcgtgtaaaaggaagagtctcatgcatttctcacttaaaatctaacgctagaaatgattaagcttagtgaggaaggcatgtcaaaacatgagacgggctgaaagctaggcctcttggatgaaacagccaaactgtgaatgcaaaggcaaagttcttgaaggatgttaatccagtgagcacaccatgctaagaaagtgaaacagcattactgttggtatgtggagtttaatggtctggatagaaggcccaaccagccagaacattcctttatgccaaatcctaattcagaggaaggccctgactctcttcggttccttaaaggctgagagaagtgtggacgctgcagaagaaaagtttgaagctagcagagattggttcatgaggtttaaggaaagaagtgctcttcatagcataacagtgcaaggtgaagcaagaagtgtgatggagaagctgcagcaagttacccagaagatctagctgagatcactgatgaaggtagccacactacacaatagactttcagtgtagataaaacagccttctctactggaggtacatgtcatctaggactttcacagttagagagaagaagtcaatgcctggcttcaaaatttcaaaggacaggctgagtctcatgacgggttaatgcatctggcaactttcagttaaagccaatgtgcccttaccattctgaaaattccagggcccttaaaacttacgctaaacctactctgcctgtgctctacaaatggaacaacaaagcctgaatgacagcacgtctatttatactatggtttactcaatattttaagctcactgttgatacctactgctcagagaaaaagttttctttcaaaatattagtactccatgacacctaagagctctgatggggatatacaaggaaatcaactttgtttccatgcctgctaatacaagatcattctgaagctcagggatgaaggagtaatttcaacttccaagtcttattctttaagaaatacatttcatagggttatcgctgtcatataattcctctgatggatttgggcaaagtaaactaaaaaccttatggaaggtattcaccattctagatgccattgagaacattcatgattcatgggaggggggcaaaatatcaacattgacaggagtttgtaagaagttgattaaaattgtcatggataactttaaggaattcaagacttcagtggaagaaataactgcagatgtggtagaaagagcaagagcaaaagaactagaattagaagtggagcctgaagatgtgactgaattcctgcatctcatgatcaaacttgatgaaatgaggacttgctttttatggatgagcaaaaagaaaagtggtgttttttttttgggagggatgaaatctcctcctggtgaagatactatgaacattgttgaaacagcaataaaggacttggaatattcaataaacttagttgatcaagaagcagcaggctttgagaggatggactctaattctgaaagaagtttcactgtgggtaaaatgctattaaacagcatcacatgccacagagaaatttttcatcaaaggaagggtcaattgatgtagcacacttcactgtcgtcttattttaagaaattgctggccaggcgccatttctgatgcctgtaattccacaactttaggaggctgaggctggtggatcacctgaggtcaggagtttgagaccaacctggctgacatggtgaaaccccgtctctactagaaatacaaaaattagccaggcatggtgttgggtgcctataatcccagctacttggaaggctgaggcaagagaaatcacttgaaccctggaggcagaggtttcagtgagccgagatcctgccactgcactccagcctgggaaacagactgagactccatctcaaaaaaaaaaaaaaaaagaaattgtcacaggcactccaaccttcagtgcccaccaccctgatctgttggcagcaatcaacatagaggcaggacccccatcatcaaaaagattacaacttgctgaaggctcagatgatcaatagcatttttatcaataaattattttaaattaaggcatgtacattggtattttcagacatattgaaattgtactcttaatagactacaatatagtgttcacatgactttcatgcattgcaaaaccaaaaaatatgtgtggctcactttattgcagtgtagtctggaaccgaactcacaatatttccaacgtgtgtctgtaaataggacagagatacagtgagtcgttaatggtcaagaaacccagaaacctgatgagagtaaactagcctcaagactgaggaaaaactttccagaagaatttgggcctgttattgtcctcattcatgcatgcaatactaacctgcatgcctacttatgccaagaactattttaagagatagagattcagcaattaacaaaacagtctctgctctcatggagcttgcatagggcaaagtgggagcaaccagtgaagaaatttgaaaatgtgtatacaagataggtcagatgataagaagtgctttaaagaagaataaagtaaaataagagaatagagagtaagaaggtgccattttaagtgaaatggtcagaaaagattcttcttatgacagagtaataattaataattaagcaaaggcctggataagagaggaagtaagccatgctgattcctgatgagaaagcattccaggcaaaggggaccacacatgcaaaggccctgaggcagaagcacatctgcctggtgtctttgaagattgcaataatagaggggagactgatgggactagagatcagagaagtgtcaggggacaagatggtttaagacattcctagccatggaaggttttaagcagatgaaaatattatttgccttatgctttaaaaagacttactctggatcacctgaggtcaggggttcgagaccagcctggccaacatggcaaaaccccgtctctattaaaaatacaaaaattagccaggcttggtgatgcatgcctgtagtcccagctacttgggaggctgaggcaggagaatcgcttgaacccaggaggtagaggttgtagtgagcccagattgcaccactgcactccagcctgggtgacagaggagactctgtctcaaaaaacaaaaataaatacttactctggttgctcagtgaagaacaaagtgcagggagaaagagaaagtgggagaggagttaggaggctattttgataatccatgaaagcaatgacgtaaagtgaagcagggtgtacacaatgggtgtggcaagggaagctcagattctgaatacagttcaacagtgtatgctgatatgaagtgcaagaaacaaagaagggtcagggcaagttttctggcctaacggctggtatgctggaggtgctatttactgagacggagaagactgaggagtgttgggcccaggggttgaaggtggaggatcaagaattcccttatggatgtgtgatagttgtctattagtcttccaagtggtgataactggcagataattagatatgagtctaaattttagaggagaggtaggagctggaaatatgtattcatggaccgtgcacacacacatggaatttaatgccattgggcttcatgagatcacagaggcatgagtgcacctagaaaaacggttgagaactgagacccgggatactcccttgttaaaaggtaaatgttccttttacattttgaacttatagaaataatgacacagtagccagccagttgctgaaactctactcagttcagagtaaaacaaaattcctattttatcgaatcactgaatgccatttaaaattcagaatacttgcagagatcccaaatatcttaataaagatgaatgcctaagttcagattggtggcctagactctgccttccctgattgtctatttaaaaataacaataatgataataataagaagaaaatatttatggatcactagatatgttgaaatacactcaaaggtagattcatttcttttctactatacccttgtaactatcagtctataaaatagttttattagaaagtcacagtcaccctcaagccaatagcagcttataaatacagggcaaggagcctggtgtggggaggctgagaaataattgagagagccagtagatatgaagctaacaaataacactgtcaaccagaattaggcagataagccagaggcagtgcaagtggcgggtcaagacaagtagacagacagaagccaggagtgagagacgggaggtccaaagtgcaataaaacactcaagaaccagtcaatccatgggagcttacagctggaggggcggctgaagggaggagcatccaggtagaggggaaggaatggtggtatgaacaggaggcaggagggctcaagctatttgatatgtttgagagtgaggtgcttttttgaggctgagaaaataactggaagccagaatctggaggactgggtagaccatgttaaacagcaagcacttgattctgcatgtgttggaagccagtgcagggcttctaagcaaggcagtgacatgatcacatcacattttaggaaggttacaaattaggcatggccacaggcaggaagacctgagggatctcttacagtcagggataagagtctaaccaacaaggtggccatgaacattcaaagaaagaagaccgaagagactttagaaggcagcctccacgggacctgactgaaggggtttgggagactcacagctttctgctgtgaagtcaaggatatcacaaactattggaataaaagaaacagtcctagggctgggggtaggtaggtgaatgcagttcctttttgaacggaggagaaaattcaggtaattcattttgattgatcaagcaaaataatttgaagctgaacattatagaagcaacaacaattcttatgatgttggggtataggaaacaggcccaagaaagcacagtatttcctgtttctcttctgattcaataaataataagaatattttctgttaaagtttttgataacgtgttgttttaattaatcaaaaggagacaagatacatttgaacttaaaagcataagaaaatcagttgtctttttagaaaaggtgagtcagcatgggtaggaagaatcaatatcgtgaaaatggccacactacccaaggtaaattatagattcaatgccatccccatcaagctaccaatgattttcttcacagaattggaaaaaactactttaaagttcatatggaaccaaaaaagagcccgcattgccaagtcaatcctaagccaaaagaacaaagctggaggcatcatgctacctgacgtcaaactatactacaaggctacagtaagcaaaacagcatggtactggtaccaaaacagagatatagaccaatggaacagaacagagccctcagaaataatgccgcatatctacaactatctgatctttcacaaactgacaaaaacaagaaatggggaaaggattccctatttaataaatggtgctgggaaaactggctagccatatgtagaaagctgaaactggatcccttccttacaccttacacaaaaattaattcaagatggattaaagacttacatgttagacctaaaaccataaaaaccctagaagaaaacctaggcaataccattcaggacataggcatggacaaggacttcatgtctaaaacaccaaaagcaatggcaagaaaagacaaaattgacaaatgggatctaattaaactaaagagcttctgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagatacttctgaaaagaagacatttatgcagccaaaaaacacatgaaaaaatcctcatcatcactggccatcagagaaatgcaaatcaaaaccacagtgagataccatctcacaccagttagaatggtgatcattaaaaagtcaggaaacaacaggtgctggagaggatgtggagaaagaggaacacttttacactgttggtgggactgtaaactagttcaaccattgtggaagtcagtgtggcaattcctaagggatctagaactagaaataccattttactcagccatcccattactgggtatatacccaaaggattataaatcatgctgctataaagacacatgcacacgtatgtttattgcggcactattcacaatagcaaagacctggaaccaacccaaatgtccaacaatgatagactggattaagaaaatgtggcacatatacaccatgaaatactatgcagccataaaaaaggatgagttgatgtcctttgtagggacatggatgaagctggaaactatcattctcagcaaactatcacaaggacaaaaaaccaaacactgcatgttctcactcataggtgggaattgaacaatgagaacacatggacacaggaaagggaacatcacactccggggactgttgtggggtggggggaggggggaggatagcattaggagatatacctaatgctaaatgaccagttaatgggtgcagcacaccaacatggcacatgtatacatatgtaacaaacctgcacgttgtgcacatgtaccctaaaacttaaagtataataataataaaaaaaagaaaataataagactaaagtcaaactgtccattaaaatttatataattcaattttgagattttcttagtatataatttacatacatgacatacatgtggatgtttggaggtatatccacatacattcacccatttattcttttatttattaatttgtttatttgctcattaaaaaaatactaagtgattactccagggattggggtctaaacatgtataagccttggggcctctccttaaaatccactgaggcaaagatgggcaaataagtggctataatgtatcctgaaaaaaaaaggaaaaggagagtcagtatttcctatggtctgaaatcatctttcaaataatgggatgtgagacaaatgagatgctacttatctagccctttccttgatagattaaaaacgatatcaaaatcttactacattgcaaagacagtaattcactcagttgagaatccacagtatacaaacatataaatcaagggaattttaaaaacaatcattgtgttcaaaatgggaagagtatttcaaattttttctacatatttcagaataatttcacagttaaaaaccctgtactttatgaaatcattatccagtatttaataaagtatatctatgacaatatcaacgttggaatttaacagtttacaaagcacttttgatacatcacatttaaatgaaggcggcaacgagttcagtacattcacgcagattagaaaacagtttttgaagattgcatttgttcatgtaagtcagaaggtttgaactatttcctacccctgctataggtttaaacctaagaattgttattcattacgatttggtctttaaataaatcacgaaggtagagggtagagcacaccccttcaatgcactgaggtgccgtaaggctccaacgccagaggcggccggttggaatttagttcaatcacgcgtttgttatgaaaactctgacaagcttcagctctaaagtaagcttggaaacacaaagaaactctgagaaaaataccaaacacacacacacaaacacacacacacacactcactcctctctttttagctgggcatagaaaatgtaagtgtaccaacaagcaacctccaaagagcaaatgacacagaaaattcaaacgagcgcctggtaggagttgtaacttcaacaaagtgcctctcatatctgcctcataaacccgtactcatttttcacaactaactcacatagcacctcctcagtgacacctttcctgttctgcccaccagatatacctgcggaccaagcgtagtctctcacccagaacacagggcaccttatacagggggctctgtctacagggggctctatgctttgacaggaactgtggacctatgggcagcggtttttcaaatcatgtttgtggctctcattacaattgtcctgcctcaggcacccagcaggcggtaataaatgctggttgaacactaaaaccttggaatgctacatcattgttctaaaggatagtcattttttaaaacattttggaagttcttttgaaactgactttttagattatgaaaatatctcagtgataggttttggttttccaagttagaccttattttattttagaaactgtcaaaagttatacaaaaccaagcatgtatctctgtgcgttttgttttctcttctcccttactgctaaggaagggtttcttctcttttctaggccaaatgctccacaaatgaatgtgttaacaaatgaacaaattaataaatgacacgaatgggagctcaaactgcataaaagtatatttactcaaaaatgggaggtgacgattgctaacatgtcataaccagactctgtcatgacctcggcaagccacaacattgacaataaagaggaaagaggatcaagtccctaaatacccaggtgaactaagaccttcccacgtgcccgaagaagatacacttgcagaggagaaatgatgatgcaggggcctgctccgagatgcaggaggaagtttaattgcctgtgaatttcactgggaaggaagggatgaaacgaggtttgaaaggaaatagagattgttaaactcctgactaggcgataactgccgtccttctcttctatctgcccctgtgactaggcggtaactgccgtccttctctaatatctgcccctgtgaccaggcgataactgccgtccttctctaatatctgcccctgtgactaggcgataactgccgtccttctcttccatctgcccctgtgactaggcgataactgccgtccttctcttccatctgcccctgtgactaggcgataactgccgtccttctctaatatctgcccctgtgactaggcgataactgccatccttctcttccatctgcccctgtgactaggcgataactgccgtccttctctgctgtctgcccctaccttgggccccaaatggctcagcactaaagtgccttgagcaggctccagcccaaaggtggcctccatggttaccacttcccactctgctgccctgcctcgctttcctcctcggccttcccggatggatgaccgatgtcattcccaggttccctaacactcaagcctagcccctcagtttctagcaagcatcaagcttcactgtgtgtctagcctctcaggagtcagacctgagaagtatagcttggtggaaattcagtggcagggaagaaagaaggaaggaaagaagactctgagctggattcatacacatcatcgcaattcatccacaccacagtcctgtaaggtatgtgccattgtactcagaaaactgaggctcaaagagattgagcaacttatctaagccttcgcaggtcctgagagcagagcttggattttaaacacctgggagactctgaaatccatgttagctcttctatacatgagcccaaaacgcagctgtacaccaagactgacttcctcttacagcttatcactagctctgaatacaagagtcctcaaaatgctttataagcaacagtagcatcatgggaataagttggcaagttcccagcattactgctttagaggcacttgaactttttctccatgtatagagtcaagaataagaaaaaggatccaaaggagaaggagagaaataaaacgggactgagccttatacttcttgacccagaacagacaatggtgggattttccttactttttttccaggcaaatccaataaagacgtctgtttctgttacctaaaaccaacttgaaaagtttgctccctcccaccttaagtgtctttgaatagagcccacagttgaacattggttcctacggcaaagattcatttcaaagtgtttatagtattattcgaagcacgtttgatttcagcctgggcaaccatggcagaatgtcagcaatgctccccgtattagctgtcggagagaaaacactgtgaaacccaaacaccttggttattgggccaatgaaacatttatgccctgatcagatggagcaaagcttcggcagggttagtgagccaccttccaagtgtaccaatgaagctcttgcctgctgtttcagataaatgactttcatttcactgttggcttgtgcttgagaaggttattcaattgattccagttgtttgcaatgccttgaaggcaagtaatgttgtagcatccactgtcctcataacacactgtttcttttctaaggaaggttgttgtcataataccctagatatccacagaaaatattctacttcttatcatatattaattttgctctggaataagtaaatgtaactaccagaatgctaatgaggatgttacactgttgtttatttgtgtgttctaatctgtagataaacagcaagatctcttttatttcatgattccaagtctcaggccacagcaggacaagtatcaaaacatctattctcaattcggagttgagatttctaataagaattctattttctccataatcataaaatagcaccaggaaaagtcaatatctatcttaaaatacagaccattgaaaagtagatctttctgcccttaacataaacaaactgtaaaatctgaagttaaaattattccttgtaccagcctcctaatttacccagagttaacagaaaagttatagcagtgcaggaagctctgaggctttgatgggtgtagatatagacatacaaacctatcatttcacactagtcagaataccagtcatagaaatccccgcagggaaaaatctgaaggtatctggtcttatggactgtataattaaactttcttatcattgtacctaaaccaaaatatgcttcctatacaaagaaggtttctttcaagagttaagactgcctcctgccatcctccttaacacacacacacacacatgcacacacacacacacacacacacacagagagagagagagagaattgagagcattagtccttttctcccttagactgattttttcttactgttattttcagccactttgttaacggtggggttaaagggcaggatagatgtaacacccatttcacatacatattgcaacatcagagatgctggttttcattaaaaacaccagatctaaattccttctaaaatatattttaaaaaatcagtacacttggcaccttggaaatgctgaaatgttatcatgaatgctcgttatttgttatgagtcaattgaatattatcttcaatataaactataatttactggtctgatagctcttcctatcttacctgtatatactcaaagggagcgatttctcatgtttagcaaattgttctttaggtaatttgttctttaggttttttgtacaaaagtacaaaatagttatcacagcaaactttccagtatttgttattttgaagctatatggtttttttttttttttttgccatgtcaggcttgagcaggatagcaaatatataaattgagctctctaattataatctcaatatatgaattcttgctaattaaaatactttgcaccagcaaaaacaattttcatgtatgtgtttaggaggtagttaagtaactctatataaaaataagtgcactttcccctcctttcttcagtgactagaaaacgtccatatttttaaaataatcaaataataattttagagagcaacagccctcaactctttgctggtgcttatcacactgcctttcttcactccattcttagctctgctagtttcttcttgtctgtaatgataataagggaatgtgggtgggtcagcacttctgtgtaggtcccctttccaaatttaccttccaaaaagccaaccaaataaacaaccaaaaaattgtgcaacaaaacacaaatagcgttccaatagcaagtgatgcattcacctgagattaagtggttttaggtggtcagtaacaaaatgctgctttgctgtcatagtagaaaggcaacaaattcttcaaagaaaccaagaaggttacaaccttgacaaagtctctcattaccttcctcctcttgtgtcttttttctccacattatctgttgcgtatctactatagaaggctgcaaaacatacagcagaaaggatggcttgaaggcaattgatgtttgtaaaaaaatccacaacaggatccaagctgaagaggtgaacacgtcagcctggtgggacaattctcagcatgtgcaaacataggtaaattctagcctatgttacattaaaaacaatgtcagtgcattttttcatgttaaagtttttttcaaagctaaagtgtgttccttgttgtgctgaccacaaacgagttttaagagttttgaaagtctggcaaaaatagaaaaaaaaaaaaagctgtagtgacattgaactgctcaatgtaagcattgggcatgcacaaattttcaaaacaaaggaaggaaatcatccctcttacaacatggttaggctgatctttaagaaataaaatgtaagaaattagaaaagcaaatgtttggcacctacatatccaatatctggcaccgtgcagagtagaagagtgaaagaaataacgaagaacaaagtggttactttgcttcaggagttcatgatctgtagttagaaaccaatataaacattgtgagtatatttcaaagaaagagaaaagcaggccgggcatggtggcttgcacctgtagtaataacgctttgggaggccaaggtgggaaaattgcttgagctcatgagtttgataccagcctgagaaatatagtaaaacctcatctctataaaaaaaattaattaaaaaaaaggcagagcaaaaacaaatatgaaagaaaacattagaaatcagagcttgggcaaagagttaaatgtgagcaaagcatctctgccttggggggcctctggagcatcccggcttcctgtagaggccccaccacatggccctttcccatcactgggaactgtcttctgtatcgtgccaggattttcccccaaacttctcaacctaatttattcagccaaaacatatatatttcttgaatccttgctaagagcaaggcactgttctacataatgaaaatatggcaatgatataaaacaaaaatatttaccctcaggcaaattacattccagtgagaaaagacagatcattaataaaataaatatgtaaaatatagaatatgccagaaggtaataagtggtacagagaaaaattaagcatggaagggagctcaggaatgctgggagtgggtagatgtgaaggtagttagaatgctcaaggagggagtaataggcagaagaatggcctttctacatgtccatatccctatatggcaaaaaggacttgtggatgtgatgaagttatggatcatgagatgaggagattattctggattacccaggttggctcaatgtcatcacaagagtacttaaaagcaaaagagggaggcaggagagtccgaggcaagaggcgtgacagctagggtcagaatgacgtggtggctgcctggaagggggccaggagccaagggatgcaggcatcctctcaaagctgcagaaggtaagaaagtggtctctctcccctagagagagtgtgtgttctcttagcctactagaggtgtgttaatttattcctgcagtcatagaaaacatatagaaggtctcactgagaagacaacatttgaacaaagattccaaggaggcgagggcaccagctatgcagatatctggggaagagcactcgaggaagaaaaggcaggcaaacagcagggtgcacacctagcccaggtgcatgaagtagagaacactgggagtcagaaggctaacaggagacaagtcagagagagggactggggtgggtcaactcacactcagcctcactggctactgtaagaacttcaagttattctgagacactcagtataggagagtctatgaatatttatagaaattctgaatgtttacaagacgaataaaagtggtatgctagtaaacttattggttgggtggggagaagcccagatttgtagcatttgctgatttccattgtgtaaatatttctactgatggtttgacaaacacttcataaaattcctgggtacttaattatcagctccagtagagcactgcatgtatgacatcccatttgccaattccacactagattctgttggggacaagctgtatgagagtcaactagcaacagaaataaggaagtcctcaataaaaatcagcatttacttttgacagatgtgagattctggaatgtatttctctttacttgctctgcctggtgattaaattatgattttaaaagaaatagttttaattccttatcagaatgctgccaccaaataaataaaatacgtactttaactatatgcaatcttgtctatattatactgttgtcaacggaaacattatcaggggccagcttcatgaaaggagatatgtgatagaagctggagttgttggagtgaaaaaaaaagtcaaattttactttggattaatcagagggaagaaagcagacagataggaaaggaaaggcaggcttagccaagttgaagaaagaggctgaactcaggaggcagtgggagaataggatcatagtttgaagagagctgcaaggctgtttagtccaggtgaggatcataatcccagaagacccagtcacaaacaccataaccctgaatgttgaaatcctgaaagatcaaaattcctaaggtctaaattcatttctttttagtagagatggagtgaattagttcattcttgtgctcccaataaagacatacatgagcctgggtaatttataaaagaaagaggtttaattgactcacagtttggcatggctgggaaggcttcagaaaacttacaatcatggtgaatgcaaacaagaagcaaggcactttttcacaaggcagcaggaggtgctgagcaaaaggggaaaagccccttgtaaaaccttcaggtattgctcactgtcatgagaacagcatgggggtaaccacccccctgattcaattacctccgactgggttcctcccacaacatgtagggattatggaaactaaaattcaaggtgagatttggttggcaacacagccaaaccatatcattctgcccccagccccttccaaatctcatgtccttacattttaaaacatgatcatgcctttctaacagtcccccaaagtcttagctcattccagcattaacccaaatgtccaagtccaaattcttatcttagacaaggcaaggcccttctgcctatgagcctgtaaaatcaaaatcaagttagttacttcatagatacaatgagggtataggcattgggtaaatacacctgttccagatgggagaaattggcccaaaatgaagggactgcaggccccatgcaagtccaaaattcaatgggtcagtcaaatcttgaagctctgaaatgatttcctttgacttcatgtctcacatccaggtcacgccgaagcaagagttgggctctcatggccttgggcaacaggggtgcctgttgatttgcagggtacagcccttctcctggctgctttcacaggctggtgctgagtgtctgtggcttttccaggcatacggtgcaagctgtcagtggatcaaccattctggagtctggaggatggtggccgtcttctctcagctccactaggcagtgccccagtggggatggtgtgggggcccacatttcccttctgcacacattgccctagcagaggttccccatgagggctctgtccccgtcacaaatttgtgcctgaacacccaggcatttccatgcatcctctgaaatttaggcgtagattctcaaacctcaattcttgacttctgtgcacccacaggcccaacacctcgtgtaagctgccaaggcttggggcttgtaccctctgaagccatggcctgagttgtacattggccctttagccatgattgggacacacggcaccaagtcctgagactgcacagagcagcaaggccctgcaccgggcccatgaaaccattttttcctcctaggcctcctgtcctgtgatgccttgagctactgtgaaggtctctgacataccctgaagacattttcccattgtcttggtgattaacattcagctcctcgttacttatgcaaatttctacagctggcttgaatttctctccagaaaatgggttttccttttctgtctcatcatcaagctgcaaaattttttaaacctttatgctctgcttcctcttgaacactttgctacttaggaatttcttctgccagataccctaaatcatctatctcaagttcatagttccacagacttctagggcaggggcaaaatgccgtcagtctctttgcatagtaagagtcacctttactacagttcccaaaaagttcttcatctccatatgagaccacctcagcctggacttcattgtccatgtcactatcagcattttcctcaaaaccaatctgcaaggctctaggaagttccaaacttcctcacatttttctgtcttctttcaaaccctccaaactgttcaaactctgcctgttacccagttccaaattcacttccacatttttaggtatccttatagcaacaccccactacctcagtgccaatttactgtatcagtccattctcatgctgctaataaagacatacccaagctgggtaatttataaaggaaagaggtttaactgactcacagttcatcatggctggggaggcctcaggaaacttacaagcatggcagaatgcaaaggagaagcaagtcaccttcttcacaaggcggcaggaaggagaagtgcaagcaaagggggaaaagctcctcataaaaccatcagatcttgtgagaactcactcactatcatgagaacagcatgggggtaactgcctccatgattcaattacctcccactgggtccccatcatgatatgtgaggattatgggaactacaattcaagatgagatttggttggggacacagccaaaccatatcatggggtctcactttattgccctggctgatttcaaactcctgggctcaagtgaccctcctgacttggcctgccaaagtgttgggaatacagacatgagctaccatgcccagtcctaaagtctaaattcttaacatctaaaatccagaaaatcacaatcacaggagagttgtaccacgttagttgcatcatgttaggtacaactcttgctttgttttcttcttatttggaaattatgtatggtttaagggggtccatatgggtgccaaatctacaaggggtggacttgcagacttaatttcaggtgtcaacttgactggattaaggaatccctggaaagctgggaaagtattattttgggtatgtctgtgatggttttctcagaagagatcagtgtgtgggtctgagcggactaggtggggaagatctgctgtcaatgttttgaatgtcttgaatatcacagaagtgaaaatgaaagtaaaaaatgcacaaaatcttgtctgccaaattatgtaatcatgtaccaagcacctctacacgtagcaccatgcttgtcttcacaaaatgccttttgtcagataataaaaagagttcaacaaattcagtggccttctgaaccagacacctgctggcacagagcttcctccagtgctacaagacatattaaatcatgaactattcttgattagggatttgactgtcaaaaaagataaacatatttatttaccactaagtctaacataacaaaactggtgcatttttcactttggctgatgaatggcactttcaaaactgtccccagtgggtttttataatcaactttatacagtttatgcccccaatgaattacaaaattctataatttaatcttcatgtttatggtttaataactggaaaaagtgaagtactttataaaagcttatttgaagatttggagggctttgcagaagaaaatagatttcaatcagatccccaaattataatgacaagtttttaattaggtgtgatcaaggcttctaaaagtgaattgcaagttgttaccagtaaagtttgtatcttccattcagcccagttcatttgccagaaaattcaggtgagtggattggccaggccatatggcaatgatgaaaattttagttttaaaatgtgccatttgtctgtattggcattccttccacctgataaaactccaggagcttttgataaattaaaaccacaattgcctgaagaagccagaaaaattacatactagtttgaaaataatgatgtgcaaggtgggataagaagtcattcaggcaacggtgttgctgttcaatcaagagtattgtttctgccaaatgagtggcctgtatatgagggcctgcaaaatggatttccacatactcaaaacaatagacaagaatggcatagaagattggaaaatataataggaaatgctcatgtcagtgtgtatcaaattatagaatttcaaaaagagcagtgccacatagaaaatgaatgtgaacatattttatgaggagagtcaaatcctaaaaacaaaaaaggcatcatgatgaaagacttcaaaatacagttaatgataatgagagtcagccagctattatgaactctgcaattgcccataatctatccatgtaatatactttttatatgtcaattttcgttttagttgtttctttttccattttttccactattttaaattgtcagcattttttacaacttggtatgctatgtatttcatcttagtatcatttccaatactggaggtataaattttgcaaagacttttagagagttctaatttgttttatgcttttatttttgcaaatttgactccacaagagtgcattatcacaacactgactttgtgtgtaagcattgtacctgtacataaaaacattaaagcttcctcaataaatgagaagatatcctttttgcacatttgtatttgggaaagagaaaatttctcaagatctcagctctttgactgcatattagatggtgacccatcccagcttttgatgaatctggtcaaaagacttaggttgtctgtcacagtattccagatgacctaagttataaagctgagtgcacccagttaccaaccatgcttttatacattttgctttttgacccatttctttacgagtacaactcatctgctcattactgttatacccataagacgctctttagcatacctgagttttatgcttgcaaatatatgtatgttattattgcctattgattgtgtaaagtagcctaggaagtgttctgttgtgtttttatacgtttatcaaataaattccatcttaaaaatataaataaatgcttttttgttgtttttagacagagtctcactgtgtcacccaggctggagtgcagtggtgcgatctcagctcactgtaacctccacctcctgggttcaagtgaatctcctgcctcagcctcccaagtagctgggactacaggcacccatcacgatgcctggctaattttttgtatttttagtaaagatggggtttcaccgtgttggccaggatggtctcgatctcctgactttttgatccacccgctttggcctccaaaagtgctgggattaaaggtgtgagccaccacgtcctgcccaataaatgctttttaaagaatgtgttaataatttttttccagaattgtattttcagaattttgttttttgaggattgtaattttcaggattttagactgtacagatttagatcttttgggacttcaacatttgggattatgacgttcaggattgtgtcttcctgggctgtgacccaaacccatgtggtccaacgctatttcacatgagaggaaagcaaaccacgtgcacagatgcaatgaaggcttaaataggcgtcatgtattgattatatccctggaaaacatgattaagatgatacgtagcgactttttttttccccagtgaaaaagatccacattctttttcttgtgtggaactaaacacaatttctgaatcaatgtaagtgaatgtgaatcaccatgttcacttagctgatgctcctttattaacggggatagaagggacgtgattcaaagagatggcggcacaggacccatgacctaaggaagctgcagtgggtgaaggggagaaacagaggagcaggggctggagaaagagtggggagtcatcaactaccctccttgctcccggcatctggtgtttggagcccagaggtcttctctaaggcctcggagaagcttccaagtctgttcatttctctttccccacccctgcttgtatcacaaataaagaaattattgacaactgagttcctgactaggtggcaggattttagggatccttcacctcgtccaaacctcatgaaggtagtgggagtcccatgggttagttagcaatagtccttgagattatttgttcatataaataatcacaatactcatagtcatcttgcttttctcataatgcccagctgggggacggtgggggcagagaggactggagtgagaagagatagaacaagagctggctttcatgtatggggctctccagagcaatcaggcctaaggacaatcaagagggatcttgaagcagctctggcaagggcagcctggactcaggccccagcttgcaccaagcacgtcacctgtccaactgggaagcctaagcaatgtgtttctgtttttgttttgttttctggtaaagaattcaatgtcgttagctacattcacaatgctgtgcaatcatcaccactatccatttccagaacattctatcatcccagacaggaactctgtgcccattagacactaacctcctgccagccctgaaaacctctattctactttctgtctctgttaatttgcctgttccaggttcttcatatagatggaatcacgtagtctgtgtctgatgtctcacttagcataatgtttttaagttttatctatgtggtagcaagtatcagaatttcctcccttttcaaagatcactaatattccattttatgtctataccacattttgtttatccatctatccctcaatagactttttaggttgtttccaccttgtggttgctgtaaataaggctgctgtgatgctgcaatgaacacaggtgtagcagccaggtgtggtggcatgcgcctgtagttcctgctactcaggcttctgaggcaggaagatcccttgagcccaggagttctgggctgcagtgtgctgtgttgatcagatgtctgcatgaaattagacattagtacagtgacctcccgggataggggactaccaggttgcctaaggagtggcgaaccggccaacaggggggtcgcgcccgtggacagccctgcagagggggtgggggggaggcggggttgtcgcacccgtggacagccccgcagcagggggctcgtgcccgtggacaggcctgcagcgcggggcgggggggcggggctcgcgcccgtggacagccccgcagcaggggatcatgcctataaacagcccctgcactccggcctaggaaacatagtgagaccccatctattaaaaaaaaaaagggtacggagagaacacaggtgtacaagtatctatttgagtaactgctttccattcttttgaagataggtataggtagatatagatacagatatagagatttacagatatgagtgggattactgaatcatatggtaattctatgtctaaatttttgaggaaccatatgttttccacagctgatgtactatttttcatacccaccctcaatgcacaagagttacaatttttccacatccttgtcagcacttgttattttctgggtgtttttgctttgttttgaggccaaatctccttctgtctgcaggctggagtgcagtggcgtgatctcggctcactgcaacctgtgcctcccaggttcaagcgattctcgtgcctcagcctctcaattagctgggattacacatgtgtgccaccatgcccgactaattgtgtgtgtgtgtgttttgttttgttttgttttttggtacagatgaggtttcaccatgttggccaggttgctgtcaaactcccgacctcaggtgatccacctgcctaggcctcccaaagggctgggattacaggtgtgaaccagcatgcccagcccctgatttttttgttttttcttttttgatagcagccatcttaatgggtgtgcaggtgtgtgtgtgtgtgtgtgtgtgtgtgtgtgtgtgtgttttaatgtcacattggtgattctaatgtgtaaccagcaaagaaaagcatggattctgggtctcaatttttcatctaggtaaaccagagcaaataaaacctatcgaagagtcctcctgatgattgaatgagttcccccatagaaggcaaaatttacaaatgttggttcctctcttattcccttggaattctactaaacttcctgcctcaacatacagagaaactccctgaagcctaaaactatgcagatttgacatagggctgattttaacttctgttttgcttttaccatatagctagctgcagaggtcacatgtgtcctccatgacatctaaatagcactacacctgcaccagctttcctctcaaattaactactcatcagttctattattaaataaacagggagcagctgtaatactcaaggagtgtgtgggattgtgctttaaaattacatctctgccaacactttgtttgcttgttgaataactacaagttttccagttaaattaatagaatacattatacccataaaatcctgacatatttggcaatacacacaacaaaatatttacaagtagagaatataataaatgtatgacactttagaaatgcattgagataagtttaaacagtgtttacttttaattggtgtgctttctttcatctcacagtaataagctatggtttagtttatcggctgaatactcactatgcagtcctttgtaaaattttggaggtccgcagtaatgtgattattgagcttcaacagaatacacagaagatcccaggaaccacagactaatccatccactatgcagtatctaaagtatttgcaaaaataaaaacaaacaacaacaaaaaaacacctgaacaattgactcgtagcaaaactatcaggttagtgcaaaagtaattgtggttttgccattgaaagtaatgaaagtaattgaaagaataggtgttctagctggacattctacaatgcatgccacaaccatggatcaattgtgtattgaaaacccaaaccaactgaggatcactgctgtgcattattcccatcgtgtcataatgtggcaaactaaaactaaggacccataacaagggattttcagagggaaagcaaacatattggttaaagcaaacaaaactggcaattttcaatttgctcaaactattcacatagtttgtatgcttctctacaaaatacagaattttgatataattacccttaggtaaaactctaaagtgagcagcttctgatcaataggcctcaactccttttcccttctgtatcacagactgtgtgggtgaatccaacacatgacctaatacgatttggccagttgggaaaggtctctttaaagaactaaccctcaggctgggatctagagcaaagcaccgtaaacttgaatgtgcataggaaccacctggggaccttgtcaacatgcagattctgattcattggatctagggtggtgcctgagctctagcaagctcccagggatgcctatgtgactgccttggacatcagttacagtagcaagaatataagcagataccagccaacaaagcaggagtgaacgcatcacggcccaggcagccctggaccaggccagctcagggatctgagaaaagagtaactggactgaggtctatgagtgctgccatgagaggtgaggctgagaaggtggacaagatctaggtcaatgtgttaagttcctactaaatgcaaggctaggctctgcataaacagaaacaaataaggcaaacctactccttgcatctttagagcttgtggtctagcagaattacttcatgggtagaaaatcattaaagatttttaaatgaaggagagacatgatctaattgaaatttttgatgaacctctctgggtgtgccatagagaaggtattggagaggcaaaaagttggaaagaggagtatatgtttgcagaccaggtgaaacatgcggatgacagaagtggataattttagcacatattttgaaggtgaaataacaggacttggttgcaagttgtgatggtaggggggtggcaggaagaagaaagcatcaaggatgatgatgctttctggaagaagcaaatgggtaaatggagataatttttacgaagaatggtaaggctgaagaagaaataaactaacaaaagggaaatgattgaggaagtggcatagatttgggggcagaactcaagagttttgaattctgattttaggaatgcctatgaaaatcccagtggagatttcaagatggcaggtgcacataatgttttggagcttgggaggagagctctgtaggagccatatgcatataaacagtatctaaagccataggaattaataaaaccttgtctagagtctgtgtaggcacgggcgtccaatcttttggcttccctgggctgcactggaagaagaattgtcttgggccacacataaaatatactaacattaacaatagctgatgagctaaaaaaaaaaacataaaaaaatctataatgcttgacgaatgtttacaaatttgtgttgggctgcattcaaagctgtcctgggccacacgtggcccacaggccacaggttggacaagcttagtatggaataagaacagaagaggacccaggatttaggaacttcaacatttaaagtttgggcaaagaggcaggagctgataagaaaatagttcaagctagaggaagagatcaggggtctactctactgaatgtttctgagacgccattggacttatatattacataatatgtacaatatatgttacttgggtgatggataccctaatagctttgaactgaccactatgcacggaacaaaactgcacctgtatcccgtaaattttatataaacaaaagtaaataaatagaaggcaggaagggagaaggagaaggaaggaaggaaggatggaaggaaggaaagaaggaaggaagaaaggaaggaaggaaagaaagaaggaagggagagcgaggaaaggaaaggaaagggaagggaaggaaagaaggaagggagagtgaggaaagggaaggaaagaaggaagggagagcgaggaaaggaaaggaaagaaaggaaaggaaaggaaaataaatgaaagggagggaaggaaggaaggaagaaaggaaggaaggaagggggaagagagagaaagaaagagagagaaagaaagaaagaaagagaaaggaaagaaggaaggaaggaaagaaagagaaagaaagaaaagaaagaaaggaaagaaagaaagaaaagaaaagaaagaaagaaagaaagaaagaaagagaaagaaaaagaaagaaagaaagaaagaaagagaaagaaagggagaaagaggaatagtgttcatgatgtttatgaatcaccaattctgggggcactgaattgtgtcccccaagattcctatgttgaagagctgatccccactgcctcagaggggactgatttagagaaggccttcaaagaggtaagtgaggtcaaatgaagccgtatgggtggaccctaaaccaatatggcaggtgtccatctaaaaagagattgagacacaggcaacacagcctgaggacacagcaggaagggagccgtctgcaaggcagcagttctcagaagaaggcaaacctgctgacattccatcctggatttccagtcttcagagctgtgagaagataaaccactcaatctgtggcagcttgtgatggaagcccctagcactcttatatggtgaccttagcacaagcagtttaacaggcttggtgaaagtgaaagccaaactgacctgaataaagagtgaaaggaaaaggagcaaaaggagacagtaagtgtggaaaatccttgaggaaaatttgccaagaaaggaggagatggcttgatagctagaaagacatagagagtcaaaggtaaggtttctccaagatagaagatttttttaaatgaaaaatttatatttaaatgctgacagaaggcatcaaggaggagagagattgaagatgcagttgacaaatggaaaagcaatgaacagaatccctgaaaagtcaggaaaagaagggagattattagagggatgtccttttacagtaagaagaatacttcctccaccgccccaggatttaaaaagcttataaatgacaggtaacattctacctaattatagagctttacacttttcaataaattttgttgtacatgatacagtcactctgtgaattcagtgagacagacagttatccacattttacataaaaagaaagaaaaggcagaaaagaagtgatttgcttgaagtgacacagaaacggctggtagaaccatgcactgtgtagatggcagggctcctgacttctcatttcacaccacaaatgtagacagaattagatataatgacagttattatatttttaaacctttcaaataagaatatccttagattttcattcattaacaaagcacgtgattagcatctgaaaatgttttattatacgatcactagacaccaaaagaggtttccattttcctgtgtatttgaaagagttcaacagccctaagtcacacagttggaggaaactcaaacaagagaaggttcgtttgaagtgatgaaattagcatgatgaagtttacaatacaaagatttttgtttcaagactctgaggtttggtagggaggaaggggaaaggcagatgacaccaaataggactggttggagaggggatgagaagcatcaattagaaagctcttcaaattcaaatggactgttcaaaccatcctaggactagactccaattgggaaagactctgaagaaaatgatctcctactcccacgagatggctaacgtgatttaggtaaaaagcttttagttttatggctggggaggtagcaataaagaaaatgaacttcctgccagtgattctttgtcaagccctgccaatttctgtgtctggggaagctataaagaatgtccagcctcatgtcaaaagaattgccacagatctccagcctgcctgcattcaagcatcgaaacatccctaagcctgttcccaggccagcctggaattgagaatccaggagagtcttttctgttctgctgctgcagctacactatctgcttgttagcataaccagggccaccagcaatagatgctagagaaatacacagagaaaaaatcaacagctgatgaaaagcagaatcttttctttttggcagcaataccaatagcatgaagcacatcccttttggagctttccaaaccacttcaaaagcgagttttctggtgtggatcaagaaagctaggcaaattgcccctgagggcatagccactggccaagatattgatgagtgtaggcagctcaggacccatcctcggccccggtgctgtctttctcagagctctgtttaattccatcaggcatgggcagcgtttggagaaagctgtgttcatttttgtgatcttcagccagcacggaggtggccagttccctagcctcccagcaccgtcctcctcctgccctgccccttcatggcctgcctgggctcactggacccacacttgcctttcacccctgtcaaagcctcacagtcctgtgtgtctgtttccctttgaactacacaaactaactaatttggtgaacccattaagtgaacttctttatactcatggtctagagtgcattgaacgctaaagggtttgctagagattgtcaaaatcaattctgtcttcttccaactggaccaaggcttctttgagttaacaaaactgagaaatctgagttgatttttcgtagtacctctttctattcttttggggtttttttgtttgttttttacttatcatggagattttccttaatttaacccaaaagatatacccatatgacatttgaactaatatgaaagaggtagtaggacaaagaatttgaagacagcctttcagagccccacaaagtacttgaagtttatcaataaacccctcccagtgtttcccaccatgttccacattccatctccatttttagccatgcagcttcaagtggcatctcctcctgtgaaacctacagtttggagataaattattgatgactaatgacttagaagaaccaaagaaaggatcctctagtggagacacagcatagaaatggtggtccagggtgagacagaactgcttccaatcccagtgccacctgtgtggttccagctgtgtgctgctcttcctctaatcttgtttactcgtctccaatacgggactaataacatatacatcagactattgtgagggttgaatgtaacaatattccaaattgttgcatgtgtccagtacttaacacagtgccaagaacaaagcatgtatcagtaagtatgaatggccttcccagcgcacacctccaaacagtggattctggccgatgacaggcaatggttccccgcggtcctacaggccacggtttaacttaccactagccaatcagtaagtttgcctcagaccacatcacgattcttttgcaagcctggagcttggtgaaaaacaagggggaaaataatccatgtccctaaggcagatgctgaaagatttacctcataacataattctctcaccagacttgtttcctgaatgtccatttaaattttaattctgcaaataaaataaaattggtaataatgaaagtgattaagatggtatttgtccagggaaccaatctccccacaagatacctaagaaagagatatatgtacagaaaatgaagcacagtaaaataccacttcattactatctggagattttccccaaacacagagaaagctctacagagctgagcttaaggcagaagaactctgttatttacttggtctaatgccaaaacaggccagagacccctctcacttacttctctttaatcccaaacccatgtctcaatttggtctaagaaagagccgaacacccaggaggcaccagggtagagaaaagcagccagccagagagtgacctccatgccaggggagtgtgtctgagctttgttttatttttcttatttgtctgtagttgtgtgattggtagaagagagtagatatgaagtctactgacacaggattggtcttcaggcatgtcttaccaagcataggggttccacaaataagagagcaatgatcagactttcttctaaaaggagcagccacaagctaccttaactctccaacttgcccataaatcttcacctacagttaggaagatttcaccattagctgtggcccataaaagatccttaagcttgaccaaccacagaggtccatctccttgaggaggaagtgaaaggggtatggacagaagctgtgagctttctgtcctccacaggcccccagctgtgtcttctacttcttgtacaagatagtctccaaatgatgttttctggcagacaatgccacagaactgatccttatctcactatggaaatgaaagatttcaaagaatttgttgcctgaaatatggtgccctaatcacatattaataaagctgctatccaggaagaaggcagatttcaaaagaaaggctgttagccttctcagggacctaaaaagtacatattgtagaacaatggtaaatagatcttggaatcaggtagactttaattcaagccccagctatgccagttattaacttatgtgacattgggaaaggctctcaaatttagttttgcaaaatcagaataatataggtagccaacaaatagggtttaatggaggtaataatgaaggtgattaagatgataaaattaaataatgaatataaagtgcttagcatgtaataaattttattgtatgatttcaaagcacatgctttacctacagtgctataaagctgcttgcaatagtcaaagctaatagaagctctagtcagagctaatagaagccttgtgtatataattatttaagaattctgtaaatatacataatagggtaggaatgagaaaatctttagaggaaatattcaaatatgcttggtttctagcaaatccagatagaccgttttggcaacaaccaagtcataattttaagtcttgttataggagctagaattttattcaaggggcaactgatttgattagataagatgctgtggactgcatgtttgcatcaacaaatgcacatgttgaaactctaacaatagaatggcattagaaggaggacctttgggaagtaatttggttttgatgaggatggagttcccacgatggggttagcatcctaataagaagagaaggagactagagccctcttctctcagccatgtgaagatacaacaagaacacctgcaaaccagtaagaaggccttcaccagacactggctctgctggcccagattttaatctttgatttctcagaactgtgagaaacaagtatgtgctgtttaagccactcagtctacagttgtttgtaacagcagcctgagcagacaaagacatagggttccttttattttcagaattcggtttagctgtaatcacctaccatcctgaaatgctgtttcctccttctgcccttgaaatataagctctgggactacagcttcatggacaaattctgaagaatttgtctctgctcctgtgggatgctaacctaatcaatcaaggaatgtttgctcaatggaatgaaacatcttaatgcagcttgccagccaatatctgcagagcacacctcatgggttctggctggcttggatttctgagactacttcatcctacccatcagactgtggactcagattcagccagaaggcctgattctagcgtcagttttgcctttgggatataaatgcatgccctacttcactgaacatgaaaccctgaatatttggccattactctggcaattgccctccctccctgtgccaattgccagtcaacccaactcccaggcagccttggcagttatgtctgctcggcctgctgtagcagccaatgacttagtaaaagtcagaacatagatctgctagctcccagtccaggatttccccttaactcatccatgtatatattaaacaactaggcttgcttttaaattctttttcatttagcctcttcttagaactgatcattttgagaatcctgacctgccaatattccataatctttctaaaagtgacacagcaaatacgacgcatgcacagtgctaactgcagctgatttcatttttccatcatctataaagcacataaggtaatttctaaaccagcagtaaaatctatttataaagaatgctgatttgttttctgcactttccaacacagagcttcaatttatttccttaccataaaaaaaccattactttttaaaacaatcatagttagtatattttataaatgttttaatttttgtaaagtccaacttgcaaattggagtgtaaatagctttcttaaaatggaaggaaccgtgttagacccagtatgctgactgatttcactgtgcttcaaagcagacgatttcacagtcattcggtaatgagtttttataaagcaattgatatcactaaaaatataattataataaataaaattataggaaaaaggaaatcttcattcagacaatgccaaattttttaactcattgctaaaagattatgtttgtacatgaaaaattttacacattctttctatgagataaacctgataacaccttgaaaacttaatagttatggaaaaggaactactgtgatattttttagagaatgtcgtgttcttgatgttcttgagtgagctgtctcatgttattagaagggaaacagcaccaccttgtggggaaacaacaccaccttgtggacaaacaaagaaagtgaatgaaattttagggccgggtgcttaatcccagcacttttgggagacctgggaggagggtaacttgagcccaagagttcaagaccagcctgggcaacacaatgacacacccatctttaccaaaaatttgaaaaattcgctgggcttggtggctcacacctcaggtcccagctacttggaaggctgaggtgggaggatcgcttaagccctggaggtcaaggctgcagtgagtgtgatcataccactgcattccagcctgggtgacacggcaagaccctagctcaaaaaaattatgtttatgtagcacttcctacaaggaatatagtatcttgtttgtatttaaatgacatcgggaccagcatggtggcttacagctgtaatctcagctcttcagaaggcagaaggcaggaggatcacttgaggccaggagttggaagaccagcctgggcagcataatgaaataataataatagtaataaaaagctaggcgtgctggcacacacctgcagacctagctactgtggaggctgagtggcaggatcgctttgagaccaggagtttgattgtactgcgtattgtgagctacgatcgagccactccagtccagacaacacggcaagacccagtctctaagcaaaataaagggacatcagagcattgcttacagagatttataaatgatcccaaaatgtcttcagggagataaattatctaaatatagctatatggactcttcctaaattccaaatttgggtggaaaaataaatgagatagaagacttcttgaaatgtatcaagactcagaaagacaaaacaaaaactttcattaggcagctaaagaggaaatcccagcgacaagaagccaaaggaaagggaaaagaaatgacaacaatgaccatactttctacacatccaacctcttctctaccaccactcagcaagacctcccacagccaatcactgccttctcttgtggacttaccctctactctgtgaacacatgagccagagaaccctgagaagtccctgggtcccttccaggggctctgcaaggtcaaaactcttttcataaaaatacacaggttttgttgaccttttccaatttcattctctcacaagtataattggagtttcccagaggctacctgacgtgggatgtcacaagaaattaaatgtagaagcagaaaggagaacgaagttttcttctattaaaccagacattaaagacatacttaaaaatataaaacaatgtcaatgttctcaccaactttactgtttaaaaatgataactttaaataaaaatgtgatttatgtaaacatataagtatatttttttaatttctcagctttaatgtttaatatgataaatatagatagatataatccaagtaaataaaagctctttggggtcctcaataacttttaaatgtaaagtggtcctgaaaccaaaaatttgaggacagatgctctaaagctcatactctctgatgtagcttccacccaggtcatttcttaaatacttgatcaatcatttcccatgtccctcaccctatccttgttgcaaaattccattttcctactctagccctccctgtcatgagaaagttcccaggttgtagacattatttactaaatatttcttaacagctttatgatgataacatgacatataaaaattgtgtaaatttaaggtaacttaatgttttgatattttatactttttgaaatgatcaccacaatcaagcaaattagcatatttattatctctacatatttaccattgtgtgtgttgacagtaattaatttatgatctagtcctttagcagaacacaagaatatgacacagtgttgttccatgttgtacattatatctccagaaattattataacttgaactttgtacaatttaaccaacatcaccccgtttcccctccctgagcccctggcaaccactgtcctattctctgtttttatgaatttgactgttgtagattcctcatgtaagtgagatcatgaagtatttttctctgtgtcttgcatttttgcttggtgcaatatcttccagctccatccatgttttcacaaatagaaggatttccttcttttttaaggtcggataatatttcattttatatatacatgccacattttctttacccattcatctgttcctctgccaaaggacatttaggttattttcatattttggtcattgtgtgtcatgctgcaatgaacaggggatgacagacacctctctaagactcttatgtcaatttcattggacatatatccagaagtgaaattattggattgtggcagttcttttttttatttttgaaatggggtctcactctgtcatccagggtaaagtccagtggcaagatcatagctcactgcagccttgaactcctgggctcaagggatcctcctacctcagcctcccaagtagctgggactacaggtgtacaacaccatgtctggctaattttaaattttttcagagatggggtcttgctatgttacccaggctggtctggagctcctggactcctgccttagcttccccaaatcctggggttacaggtgtgagccaccacaccaggccagtgctagtttcaattttctttggaggaacctcaatactgttttctgtgttttactaatttgcattcccatcaatagtgtataagggtttccttttctccacattctcaccaacacttatctttggcctttttgataatagccattttgacaggtgtgacctgatatctcattgtggttttgatttgcatttctctgaagtttagagatgttgagcacattttcatatacctgttagccatttgaattccttcttttgagatatatttatttagattctttgccttaaaataaaattaggttatttgtaattttggaattgatgtgtatgtgtccttattttttgaactccttataagagatatggtttacaaactttttccccatttcataggttgccttatcatttcattagttgttttctttgctgtgcagaagctttttagtttgatgtaattcatttacctattttgcctttgttgcctgtgcttttggcatcatatctaaacaaattattgccaagaccaatgtcaagaatgttttctcctgtcttcttctaggagttttatggtttcaggtattgcatttaaatgtttaatccattttgagttaatttttatgtatgatgtgagctagggatccgatttcattgttttgcatgtggacatccagctttcctaacaccatttgttcaagagcatatcctccccctattgtgtctccttgtcaccctccagggtgatcaattgctgcaaatgtgtgggttatacctaggttctctattttgttccactggtttatgtgtctgtttttatgccagtaccacagtgttttcctttctacagctttgtaatttaatttgaagtcaggaagtgtgatacctgtagctttgttcttgctcaaaattgctttggctactcagggttttttgtgattctatatgaattttaggattattttttctatttctgcgagagacaccattgggattttgatatggattacattaaatgtgtagattgctttgagtaatatggacactttaataatacagtactcactctttcaatccatgggttgtctttcaatttacttcaaatttccatcatcaatcttttgtaatttgtagtgtttaagtctttcacttctttggttagttaattccaaagtagtttatttgatattgttttttaaatttccctttcagacaattcattgttagtgtttagaaatagcaatgatttttgtatgtctattgtatatcctacaactttaataaatttattatatagtcagtccttcatattcatgggttctgcaaccatgaactcaaccaaccatgaaccaaacttgtacatattttccatctgtggtggtttgaatccacagatgtggacccatggatacacagggccaactgtacatgattttacatgagggagttgatcatcacagattttgttatctgagggggtcctgaaacaaatccctggcagatatgaaagactgactgtattatttctaaccaattatttctaaccattttctgtggagtctttagagttttcaatgtataataatcatgtcttctgttaacagagataactacatctttcctttcaattttgatgccttttatttctcttgcctgatttctctggctaggacttccagtactatgttgaataggagtggtgagagtaggcatccttgtcttgttccagatattaaagaaaaagctttcatttttccccattgattattatattagatacaggtttttcatatacagcctttatagtgttgaggtaagtttcttctatacctattttgttgagagttttatcatgaaagtatgttgaattttgtcaaatgtgttttctgcatctattggaatgttatttttgtctttcattctgttaatgtggtatatcacattattaatttttacacattgaaccatccttgcatcccatagataaattccaattagtagtttattgagaatttttgcatctatattcattaaggatactggtctgtaattattttttcttgtgttgttttcatctagcttttaagtcatggtaacattggcctcatgaaatgagtttgggagtattctctcttctattttttctaaagagcttaagaagttttggtgttagttcttctttgactgtttggtagaagttgcccatgaaagcatctgcacctgggcttttctttgttgggaaattttttattactgattgaatctctttgcttgcttttggtctgttctatttcttttttgttccaacttggtagattgcatctttctaagaatttatccatttcttctaggttatccaatttattggcatataattgcttaattgtcctttataatcatttgtattcctgtacatttgttataatgtctccattttcatttctgattatatttacttgagtctctctttttttcttaatgtagctaggggtttgttatttttgtttttatttccaaaaatacaactctagctttgttgatttttatattgttttttattttaaagttattttatttatattctaatctttattatttacttcattatgctaactttgggcttagttagttcttctttttctaactgtttatttgtaaagttaggttgttcaattgagatctttcttattttttaatgtaggtgtttatcactataacatttccctcttagcacttcttttgctgcatcctgtaagttttgttgagttgtatgttcatttttgtttgtctcaagatacttttaaaattcccttttgatttctccttttacccaatggttgttcaagagtgtgttgtttagtttctgcatttttgtaaatgtttctgttttctttgttattgatttctaattttattccattgtggtctgagaagatacttggcattatatcaaacttcttaaatttgtaggatgccttgtgacctaagatttgatctatctcagagaatgttctgtgtgcacttgagaagaatgtatattctgatgctgttggatggaaagttctgtatatgtcagtgtttaatgtaccatgttgttcaagtcagctgtttcctcttttttttcttttttttcctgcctagatgttctatccattattgcatttggggtactgaagttagctactattcttttattgttactgatttctccccttagctttgttgatattaactttatatatttaggtgttctaatgttgggtggatacataatcttcctgttgaagcgaacttttatcattacataatgaccttcttagtctctagtgacagtttttgatttcaagtctattttttctgatctaagtatagatacccttgctcctttttggttaccatttgtgtagagtgtctgttcccatcccttcactttgagcctctatgtatctttatatctaaagtgactcccttataaatatgtactgatgagtatcttttatgcattgtgccactctatgtcttttaattagatagtttaatcctttcacatttaaagtcattgttgataggtaaggagtaacttgcattttgttaattgtttttcatatgttttgcagttcttttttttttcctctcttgctgtcttcttatgtttggttatttcttgtagtggtttggtttcttttcttcttcttcacattttgtgtatctcctataagtttttaatttgtggttgcaaattaacatcttctattaaaagctgtcttaatgttatcagcttttttggaatcattttctttctcttccctcttcagacatatttgcaaatagtctgtttttcaagacacgagtaaatagggctctggttagaaatttatcaatatggaaaaaaaaagatcctctgagtcttttgataagttagaaaataatgatagactgtggcagaatgtcatgtatttcaagtatttcatctgtgttactctgcaatatattttctgtgtgcatttgtcaatgttatatatttataaggtaaatccataaagcatacattctagaatctcctaacttaggtccttaagagatatgctccttataaccttcttggcactcttgaagtgttaaatatttccattgaagaaggttgcatatggtttctgagatgaagtctagacaggttacgattattttttgttccttttgcccacacagcacccactgtcccctccctttgttattagcctttatctgataccctagatgaagccaccttctgtccttcagttttggcgtgggggctgatttcacccccagtttcaggaataagcacaggacagctactaacaagtatgttgttcactcaaggaagaaacccagctaagggagaaaggggggctgaaatccggcctacatgctcttctccaagccacatgccccgatacagggctgcatctaactgcagaaagggtagccattttctaatacttgcaaaggcactgtgtggacagtgcaaactctgtatgagctcatgacacaggcctggccaataaatatacttctaatcctggcacagatcagactagagacggacatgaaatccaagcgtcacacccaaagtcaatctctagtctcttattgagactattagaagtgtttctgtgtttgctttattctggggctgtggaactaaggaagtgtaaactggaggagtgatgatggccacattgcagaacaaagggaaaacttgtctgagaataaagtcaatggggaagaaaaaagcaagaaagctgagaagagctaagtcctgagtccctacgttcagccattctgaagctacaccctggatttttccattatacgagtccacaaattaatattttttttttggcttagaccagtttgagtttgaattctattatttataaccaaaggagtcctaccatattatcatagctggattttcataaacacggtatatgttgatcaacaaacttcctagatgtttcaagttcactccgaagagtgaggggaaaaagaaaagaagggaagaaaatggttacttatcatccacagtagtcaaggaagctacagaagcatcaagcaaaagcagcggaagttagctttgtactcccacaaaccctgctctgaagtactccgcctagtggcccacagcagaagctgcatttctaaaatctttaaaaagatagaacaggaatcaccacttaccctgggaaccctaataggtgagcaggccacatgggaatatgtcccattggtttgaggtagataagtccattttcaaagcggtagtaattccggaaacaagaacatattaattttactttgatcacacaatgcctagttatattaaaagtaaagagacattcaataaataccttttatggaaataaaaacagacaatttaggagagaattaactatcaatgcgttattttcaaaggtaaagaaaaaagaaattattctgaatgcacaaaactattttatcaaatatcatggtaaattatcattatatactaggtcacttaataaatttccagagatgattgtaaacagtttccacaatagattttgtttcaccccaggaagtttcacaaaaagttagttacttatctccattgttactagtgccaactaatcctatcattctgagtcaaattaaaaataacatccacacttttctccagtgagatcacaggagatgcctaagtggagtgtgttttaatgtgaggggataattggtttatatttttcactgacaataacaaataaattctagacaacttaagcaaaataggaattcaatgaaaggatactgaatagttcacaaaatcactgaagatgctggagaagcaaggtaagagctgagggaaacttggcacagccaagttcatcctacggaagcagatcttgggatgccacaactaggatgttgccatttgacactcatcaccatgtagctgggctctgctgaacttaggcacttcctgccacattcctggacctgcatctctgctcagttgctcagaatcatctctgattctttcaggtcttttgcatcatttcgtcgggttccaagttctaataaagagacatccattggctgggcctagatatgtgcccacacttgagtggccaagaaactggaaaaaggatcatgcactccctttcagcttttgtaatggaaggtggggcctgtcctcatactttgcttggggttcaaaaaactaggaagggtgttttgttgaaatgaaacccaaaactatagctatccatttatagcaccttattagtacaggaaaaaaccatgagacaaaatgtataaaagtgcatgggaggtctaaacatatgagggggtttctgaggagaggaagatcatacttgattggtgctgtggtttcactgtgcctcctccgagattcagcgttgacaatgtgatagtgttgaggtggagcctacaggaagtgattaggccatcaggactcctacctcaggaatgggtttaggagccctcatgaaagggcttcatggagggagttcattcctcttgccctcccaccttccaccatgtgaggacacagtgttccttgactctggaggatgcagcataaagacaccatcttgaaaggagagaacagcccttaccaaacatcagacctgccagcaccttgatcttggacttcctagtctccagaactgtgagagataaatgtctggttttcataaattgcctagtctctgttatttcactataagagcataaattgactaagacaactggggattagaaaaagtaatatgaagcggcatttgagaagggcttgatagataagatctctacaaatagaaatagagagatggtttcacatcacccaggtgaagggaataacatagccatgttcagtctgaatgcaaaatggagatggtaaaaaaagtacataggattccaccaccagtgggaggacagaattgcaatgtggcagcaatctgtaaattaaaatatttatcactcattcccatttatttagagtctaatgtgttctaggctctgaaattaagcaaagaaaatctagatatgagtaagtccaagactttgcctttgtgacagtcaaaataatgaccccataaagatgttctagtccctggaatctgtgaccatattactttacatggggcaaaatggattctgtagatgtgattaatccttgagttagggggattatccttgattatcttgggggccaatctaattgcatgtgtctataaaatcagagaatctttcctagctgcagtcagaaggtgacatgaccacagaatataaaatcagagaatctttcctagctgcagtcagaaggtgacatgaccacagaacaatggtcacagatatcccacattactggctttgaagatagagggatggtcctatgatccaaggaatggggacagcatctacaagttggaaaaggaaatggattctctctagagcctccagaaagcaatacagccctgacaataccttgagttaagcccagtaagaccacggtcagaggtttgccctacagaactatagggtcgtaagtctttgatttaagccacaaagttgtggtaatttgttatggcagcaatagaaaattgattttaaggagtttattgtttggaagataggcagaccagaaaatccaaattataatataattcgattaaaacctatggagatttgggctaggtgttttagaaaagaactgagtattaacaagactaacagaagaaattgttctaaaatttacacactaagtacatcacatttttctaatgatcacattgatagagcaacttagaatccatgctttcaacaaaccaacaggcttatatacatatatatataattttatatatatataattttatatatatataattttatatatataatatataatatatggaatagccccacgggcatgggcagccctgggccacagggcagcactgtactagcagcctacaccccaccttacctgcctaccctgagctgacttgtctgctaaatgctaaataaacctgtcaacctgtcgggtttaactcagaagggcctggatgcaacaagcctgagggctgtgactggggtaagagagagcacagacggagctcctcctccttccaccactgcccaccagctgaaaaccaccaactgaagtttgctaagattctcagcctacaccttgttcccaacaaaactcatgcaatactttggcccccactacaatctcttgaataaaatattctacggatctgctttttgagctgcaagttatcttactaaattccaagaagctcatgtaagagaaaaccaccacataatataagattttcaatgtgatcatcattgctacttttaactagaaaatatccagtaaatgtattgtgaactgctttgtgactatggtgatttatttagtctttctgatccttggtttgattatctcaaatatataagtatcaccaattttataaagttgctctaaaaattaaatgagagaaaaataattctccttctccacatactgaacacttacaaaattataggcattgtgtccaggtttttacatacttacctgatggaagtctcctaacaaccctctcttttaaattacaagcattttgccacgatttttacacatgtatgttatggaggcctcgcaacaatcacatcttttataggtgagcaaactgaggctcagacgagttaaaaacacattcaccatcaaatcataatgagggacggaactgggattcaaatccagttctctctgatgccaaaaatggtgcaatttaacaaggaccaagttacacccagaacatggagggatcataacatgtggattcccttttctgccccctcatgtgggaatttcaatagctttcactgcctcagagcaatcctaaactccctcccaggtgccttgcaatggcccccttattcgtgggggtgattaggaatctgcatttttggaccacgagcatccataaacagttgtgttgatcaagaaataaaattttctaggccataggttactgtgaattgtctagcttctctgcaaaaaataaaggggctattccatgtaaaaaaatcacaggatccactgaatttgtgcagaaaaacttagaactataccgcaggaggatcttactgacagctgtgcctgaagaccagcccaaccacacaaagcaatagcacctccaatggccaggtgtggtggttcttgcctgtcatcccaacagtgtgggaggccaaggtgggtgaatcacttaaggccaggggtttgagaccagcttgggcaacacagtgagaccttgtccctacaaaaaaatcattttttattattagaatcaagaagagtacctctaaccccctgtcattgctttagggtagagagctctggtctagaactcaagatatgaaattgtgaatcccagtgtagctacttaagcttaaattcaagagctgccagacatttcctctacagcaacgaaatctgtagcatccattttgtattttgaaaacttagtttttggccagcctctgggaacaaaaggacccagaattgggcatttgggtagggagggaaaaagaaaccggctggatgcaaaaggggaagacgaaggggtggggacgccaggcagagccagtcctcatgcttggggcctggacctaggaaaggaactaggtgaagaagggaggagccccaggctgtggatgtctctgggggaaccttggttcagcaatggccagaggaggtcctgaggccaagcggtatctgtcgcctccttacctttgggtgtcttctggtcgccaatgtgctgcaggtcatggctccggaatcaaattgggctcaaacggggcaagctccaacacagtggagcctggcgctactcccacctccaccttgcggatctcagagctgcaggatggctctgcccaccgcaccctgagctggccccgcttggggctggcattgggggacagtgtgttctgggcgtctctgctcctctctgctggtgcctgtgcctctgctggccgcccactcatagatgtcagagccacaggacggccccgcagaatccctgcgctgaccctgccgggggctggctttggtgcacatgcaactcgtcatcgtggtccccatggggcacctctgctcttctcgaggcagcttgggccttcgcttgcccccacgtctgcagagctgagcacctgccacctctccccaggaaaggcaaccaaatgccaccaacttaaggcacccactgaaggcactaactgaaggccaccaacggaaggccggttgccctgccagccagatcgcgtactgcttaggaagaaccaatcaggccttgagttccctccacgtgctgcccttccatttgtgatgtggaagtccaggcactggctcacaaaaccgcgccccccagtgatgccgccccacctttcatttattggtagctggtagcaactttcaggtttcctcactgtgaattatgaatatgaattatgattaaattactgtatgctaatgtacctcatgcactatctgacagtcaaagtcccctcttcccccatggcctctgagttttttggaaactagaaagaagacacatttctgcaggtgctttcagaaaaaaacattgccacgacctaatgttactctgtgacgtcaagtcatatttcatatatcatacatattcatatttatattcataattcaaaatgcacatattcaatcaaattaacaggactaacaaaggaaattttctaaaacttatacactaagtacattatatttttctaatgatcactttaatagagcaacttagaatctatggtttgaacaaatgaagaggcttatgcaagagaaaaccaccacctaacacaagattttcaatgtgatcatcattgctacttttcactagcaattgtccagtcaatatattgtgaactgctttgtgactatggtgatttatttaaacttactgatcctttatctcaaaaatatgaataataccaattttataaacttgttctaaaaattaaatgagagaaaaataatcctccttctctatatattgaaaacctacaaaattaataacattgtgtccagatttttacacacttaccttattgaagcctcatcacaaccccgtctattaaattataggcattattcccagatttttatacacttaccttatgcaagcctcgtaacaatcccatcttttatagatgagcaaactgaggctcagacgagttaaaaacacattgaccatcaaatcatagtgagtgatggaactgggattcaaatccagttctctctgacaccaaaggtggtgcaatgtaatgaagaccaagttatatccagcacatggagggaccaaaacatgtgaattccctttctctaccctcttacgtgtgaatttcaatggctttcactgcctcagaaccatcccaaactccctcccaggttgccttgcagtggatcctttcttcttggggatgattaggaatccgcatttttggaccacaggcatctataaagagttgtgttgatcaagaaataaaattgtctaggccataagttactgtgaattgtctagcttctctgcaataaataaaggggctattctctttattttttattattccactattcacaatagcctagaatcaacctaagtgtccaagaagactcggtttaaccctggggattactaatgttttcattgtggtcaatgtggtagattatattaccattctcccattatctggtcttcctactgcagtggccctatctcctagaagattatacatttctgtcctattgaagtaagggtcagatttagacatgtgaccggtttggccagtgaaatgtaggtagaagtggcatgtgtaacttgttagcagaaaatttcctttttcaaggatctgggagccatccctttcaaatgtaatcctccagaaagataataccttatttcccagtctctatgagagagtaagagcctaatcttgctccaagttgtaaaaattaccttatattataaagataaaagaaagtttatttttcctttgagaaaagacagttagcaaagacaggtggcctatgatcacccccttactctcgctttcaaaaactccactgccctttgtatcaggggagctgagttcagactaggttctggcctctctcccctgttgaataatatcttccttacttatttaactttttccagtgcaattttttctttgactctttcctccctctctgaaacttgcattgaaattttagtaggatacaaggcaggcaatctcgacccttgaatatataaaagaaccctttaggattaaaaaacccatgttctcttccataagttatttcttcagactattgccttattaaaagtttctagttcttatttttgcattgaaaaggagaatgatgatttttaaataagttcctactcacttttaatttctactatcacaattttattgcttttcatggcaatagatttctctggttcaacaagaaggccagaacaaggaagtacagaaacatctcaatatatcttaaaaagttatttaacatggacagtgtcatttaatatctttaacatccctatcaaatggatgctattattatcccccttttacaggatattaaaacttacatactgtaaataaccagctgaaagtcatatagcatggaaaatacaataagcatacaaagaagcaatggcattagaagtggaggagagttaaggattaaaaggctaaacttagtttggttaagaaaaaagaaaactaggaggtggcaaactcttgttggaaaggggaaggatttgggcagagcaaggtagtggagtcgatctctccagtaatcttacccctacggacacatctatatgaacaactatccacatataaaattacctttacaagagctaacgaaccctgaatacatgagtcagtctatgaagcccctttggactgcaaagagtagaaccatgcttggacagtaagggaaccagtactctgtgactgtgatactcctcccccaggccataatggtattatatgcagaaagtcctccttacagttcttacactgaataaagtgagcagaagttgaatatttttttccaccatactgagtcccttcacagtagactcctgcatcagcccacaagcagcaccatgagtgtcaacagagctgaaccgcccgaggcatgctagggacatagagaaggggttgggttagcaatactcattatatgaaacttagcagtggctagccattcctaccagaggaaacactacaccagagaggttgtttatgggcaccatgctgtgggaaacatgatacacagactgtccagatttgatagcctgacttgttctcccccacagccaggagcctttctgtggatcacccatgggcccattcagttacattgcatcagtggtgaagccccattgtgagacttatgtctaacctttgctttgggcacctcctaatgctaaaatggaatataatggaaatccacaccgaatttctaaacaagcccactgagaaacagtcaaaaacaaacccagactgagaagactgaaataaatatttaattcatcaatgtgtagacagagatatacatctacaaaaaataagaatagcctaggaaaaactgcctcaccaaatggagaaaataaggtgtcagcaactgaacctaaagacatgcaaatgaatgatgtggcagacaaaaaaaattcaaatagctgattttaaaaaaaaaatcggtgaacttcaacaaagtacagagaaacaatatggaaatttataagaaattcaacaaagaatttaaaataatgggaaaaaatcaagtggaaatcctggagttggaaagttcagtaaacaaattgaaaaatgcactagagggcatcaaaagcagaactgatcaagtagaagaaaaaaacagtgagctcaaagacaggctctttgaaaatacactgtcaagagtagaaaagagaaaaaaatgagaagaaacaaagaaaacttatgagatccatgggacaccatcaaaaaaaaaaaatctacagtgttaaagtggaactgagaatgaaaaagagttagaaaattattcagagaaataacagaaaactttttaaacttagagaaacattaagatgtttaggatggccaaagcgcactaatctgatttaatctgaataagacaaccacaagatatattataattgaactttcaaaggtcaaaaacaaagagtaggtcctgaaagcactaagaaaaaggaagcatataatacataatgtgcctggcagcagacttctcagcagaagcaatgtgggccaggagagagtaggataatagaatcaagtgctgaagaaaaaaactgtcaaccatgaatgtagtatccagaacagctctcatttgaaatgaaggagagattaaaacgttctaagacaaacaaaagatgaaggaattcattgtaaccatacctgccttaaaaaaaatgttaaagaaccgtcttcaaagtgaaagaaaagggcactaatatgtaatgcaaaaaattggaaggtataaatccacaggtaaaaataaatattcagacaaattcagaatgctctaatatagtaataattgaatgtaaaccacttacatatttttagtaagaaggttaaaatacaaaacaaaaataataacaactacaataatttgttaagggataagtgatataaaagatgtaaattcagacatcaaaaatgcaaaatgtgggggagtgattgagttaaagagcagagtgattgtttttccccatttcttattatcaaaattaagttgttatccattcaaattacctgttgaaaccataaaatattcttcacatgcctcatagaaaccaaaaggcaaaaatatttaatagatacactaaaaataaaagaacaagaaacaaaaacacacagaaaaaatcacttaactacaaaggaagacaataaaggaacaaaaaggtacaaaaattctaaaagacaacaagaaaaccacgtacggcagtacaagtccttatctatcaataattaccttgaatgtaaatagattaaattatccagtaagaagacagagaatgggtaaatggattaaaaacaagacctaactatattctttctacaagagactcccatcacctttaaatacacgcataaattgaaagtgatcagatggaaaaatatattttacgacaatggaaatcaaaagaatgcaggagtaggtatatttatatcaaataaaatatacttcaagtaaaaaaactataaacacagacaaacaaggccattatgtaataataaaggggtcagtacaacaagagaatacaataattgtaaatacataatgcactcaacattggagaacctaaatatataaagcaaacattaatagttctaaaaggagagacaaaaaactgtgcaataatagtaaaaaaccttgacatcccattttcagtaatgaacagatcattgagagagaatgtcaacaaggaaacatttaaactgcactctaggtcaaaagaatttaacagttatttacataacatttcatccaacaattgaataattcagtcttttcatctgcacatggaatattgtccatgatagatatgttagaccacaaaacaagtcttagctaatcaaaaaatcaaatcatatcacatattttttctgaccatatggaataaagctagaaataaacaataagagaaacttcagaaattgtgcaaatacatataaattaaacaatatatccctaaacaaccaacgggtcaatgaaaaaaaaaatttttttaaatgtcttaagacaaataaaaatgaaatcagaacatatgaaaacttatgagatacagcaaaacagtccttagagggaagtttatagcaatacatttctacatcaataaagaagaaagataatgaataaaccctctaattatgtatttcaaggaactataaaatcaagaacaaactaagacccaaattagcaaaagaatataaagatcagagcacaaatatacaaaatgaagacaaaaaatacaaatgattaattaaagaatcttttttgaaaaggtaaaattgacaaacgttttgtcagactaagaaaaaaagagaaaattcacataaagtcagaaatgaaaaaggatatgctatgatggacactacagaaatacaaggaatcatgagtaagtactacaaacaattatacaccaataaattgaaaaacttagaagaaatacatatgctctggacacatataacctatcaaaattgaagatagaagaaatggaaaatgtgaacacaccaatgacaaataatgagattgaaggagtgatttagtctgtcagtcaaggaaaatccaaaagacttcacacagtagctcccacctgtaatctcacattttaggatcccaaggcaggagaatcactagaggccaggagttcaagattagcctgggcaacacaacgggactccatctctaaaaataaaaataaaaattccccaggtatagtggtgtgtacttatactcaggaggctgaggcaggaggatcacttaagaccaggagtttgaggctgcagtcagctacgactgcaccactgtatgccagcctcagtgatagagtgagactctgtctctaaaaaaatagaagaagaaagaaaagttcatgacttgatggttttcactgacaaattctacaaaatattttaaaaacttatacagattatttacaaactatttcaaaaaaatgaaaaggagggaactcttgcaaactcattctatgaagacagcattacctgaatccaaaatgagacaagaacagcaaataaaactccaggccaatatcattgataaacatacatgcaaacattcaaaaccagcagtgctagcaatgataattcaaaagcacattaaaaagattattcaccataatcaagtggtatttacccggggaggtaaggatggtctaacacatgtaaatcaataactgtgatacatcacattaaacaatgaaggataaaaaacatataatcatttcaatagatgcagaaaaagcatatgacaaaattagacatccttttatgatcaaatcttttgacaaattagttataaaagaacataataaaataaagaccatatgtgataacccacaggcaacattatactgaatggtgaaaagttgaaagctttgcctctaggatctggaacaagacaaggatgttcactttaatcacttttttcaacatagtactggaagtcctagtcagaacaattaggtaagagaaagaaataaaaggcatccaaattggaaaaaaaagtctaattgtccctctttgcagatgacatgatcatatatgtaaaaaaccctaaataccccactgagaatcagaaatagtaaatgaatacaataaggtttcaagatacaaaagcaacataaaaaatcagtaacatctctattcaccaatagcagactatctgaaaaaggaatcaagaaagtaatcccatttaaaatagctattaaaaaaaacaaaatacctacaagcaaattaagccacggaaagatgaaaattattaaacattgataaaagcaattgaaaaaaattaaaataaatagaaagataccccatattcatggactagaagaattaatattgttgaaatgaccacactactcaaatcaatctatagatccaatataatctctatcaaatttccaatttcattcttcacagatattaaaaaagatcttaaaatccatgtgaaactacaaaacaccccaaatagccaaataaatcttaagcaaaaagagcaatgctagaggtattacactatctaatttcaaaatgtattgcaaagctatcctaactaaaacgcatggtattggcataaaaacagggacacagaccagtggaacaaaaatagagagcccaggcataaatccacacgtttacatgcaacttatttttgacaaagatgcaaacattcaatggggaaaagacagtattttcaacaaatggtgctgggaaaagtggatatccccatacaaaagaatgaaagtagacccctatctctcatcatatccaaaaaccaactcaaaataaattaaatatttaaatgtaagaccccaaactatgaaactagtagaagaaaacataggtgaaatgttatatgtcattggtctgggcaaggactttttagaaaagacatcgaaagacatgcacaacaaaagcaaaaataaacaaatgggattacaccaaataaaaacttctgcactgcataggaaacaatcacaagagtaagcagacaacctacaaaatgggagaaaatatctgcaaactattcacttgataaggggttaatatcccaaatttatagaaaactcaaacaactcaatagcaaaaatacaaataattggattagaaaatagtcaagagagctgaatagacatttctccaaataagacataaaaatcaccaacaggtatatgaaaaaaatgctcaccatcactaataatcagagaaatgcaagtcaaacctgtcaggcctctgggcccaagctaagccatcatatcccctgtgacctgcacgtacacatccagatggttggttcctgccttaactgatgacattccaccacaaaagaagtgaaaatggcctgttcctaccttaactgatgacaatatcttgtgaaattccttctcctggctcaaaagctcccctactgagcaccttgtgatccccactcctgcccaccagagaacaacccccctttttcctttacctacccaaatcctataaaatggccccacccctatcttctttcactggctctcttttcggactcagcccacctgtacccaggtgaaataaacagctttattgctcacacaaagcctgtttgatggtctcttcacatggacgcgagtgaaatttggtaccgtgactcagatcgggggacctcccttaggagatcaatcccctgtcctcctgttctttgctccgtgagaaagatccacctataacctcaggtcctcagaccaaccagcccaagaaacatctcaccaatttcaaatccggtaagtagcctctttttactctcttctccaacctccctcactatccctcaacctctttctcctttcaatcttggtgccacacttcaatctctctcttctcttaatttcaattcatttcattttctggtagagacaaaggagacacgttttatccatggacccaaaaccctggtgctggtcacagactagggaaggcagccttccattggtgtttaatcattgcagggacgcctctctgattattcacccaggtttcagaggtgtcagaccacacagggatgcctgccttggtctttcacccttagtggcaagtcccacttttctgggggaggggcaagaaccccaatcccttctctccatgtctctaccccttctccacttttctgggggaggggaaagaacccctcaaccccttctccttcacccttaatggcaagttctgcttttctggaggaggggcaggaaccccaacctcttatctctgtgccccgatcccttatttccgtgccccgacctcttatctctgtgccccagctccttatttccacgccccaaccccttctctgcttttctggagggcaagaaccccccaccccttctccgtgtctctactctcttttctctaggcttgcctccttcactatgggaaagcttccaccttccattcctccttctcccttagcctgtgttcttgagaacttaaaacctcttcaactctcacctgacctaaaatctaagcatcttgcatcttattttcttctgcaatgccacttgacaccaatacaaactcaacagtagttccaaatagctggaaaacggcactttcaatttttccatcctacaagatctaaataattcttgtcataaaatagacaaacggtctgaggtgcctgatgtccaggcattcttttacacatcagtccctccctagtctctgttcccaatgtaactcatcccaaatcttccttctttccctcccacctgtcccctcagtcccaaccccaagcattgctgagtctttctaatcttccttttctacagacccatctgacctctcccctcctcaccaggctgagctaggtcccaattcttcctcagcctctgctcctccaccctataatccttttatcacctcgcctcctcacacccggtctggctttcagtttcattctgtgactagccctcccccacctgcccagcaatttactcttaaaaaggtggctggagctaaaggcatagtcaaggttaatgctcctttttctttatcccaaatcagatagcgtttaggctctttttcatcaaatataaaaatccagcccagttcatggctcgtttggcagcaaccctgagatgttttacagccctaagagcctaaaagatcaaaaggccgtcttattctcaacatacattttattacccaatctgctcccgacattaaataaaactcctaaaatgaaattctggccctgaaaccccacaacaggacttaattaacctcaccttcaaggtgtacaataatagagtagaggcagccaagtagcaacatatttctgagttgcaattctttccctccactgtgagacaaaccccagccacatctccagcacacaagaacttccaaatgcctaaaccgcagtggccatgcattcctacagaaccgcccccactaggagcttgctacaagtgccagaaatctggccaccaggccaagaaatgcccacagccctaagccatgtcctcctaagccatgtcccatctgtgcaggaccccattggaaattggactgtccaactcacctggcagccactcccagagcccctggaactctggctcaaggctgtctgactgactccttcccagatcttcttggcttagcggctgaagactgacactgcctgatcacctcggaagccccacagaccatcacagatgctgagctttaggtaactctcacagtggaaggtaagtccatccccttcttaatcaatatggaggctacccactccacattaccttcttttcaagggcctgtttcccttgcctccataactgttgtaagtattgacagccaggcttctaaacctcttaaaactccccaactctggtgccaatttagacaatactcttttaagcactcctttttagttatccccacctgcccagttctcttattaggccgagacactttaactaaattatctgcttccctgactattcctggactacagctacatctcatttctgcccttcttcccaatccaaagcctcctttgcatcctcctcttgtatcccccgaccttaacccacaagtataagatacctctactcgctccttggcaactcatcatgcaccccttaccatctcattaaaacctaatcacccttacccctctcaatgccaatatcccatcccacagcatgctttgaaaggattaaagcctgttatcactcgcctgctacagcatggccttttaaagcctataaactctccttacaattcccccattttacctgtcctaaagccagacaagccttacaagttagttcaggatctatgccttatcaaccaaattgttttgcctatgaaccccatggtgccaaacccatatactctcctatcctcaatacctccctccacaatccattagtctgttctggatctcaaacatgctttctttactattccttttcacccttcatcccagccttcttcactttcacttggactgaccctgacacccatcaggctcagcaaattacctaggctgtactgctgtaaagcttcacagacagcctccattacttcagtcaagcccacatttcttccttatccgttacccatctcagcataattctcataaaaacacatgtgctatccctgccaatcatgtctgaccaatctctcaaaccccaaacccttctacaaaacaacaactcctttccttcctgggcatggttagatactttcgcctttagatacctggttttgccatcctaacaaaaccattacataaactcacaaaaggaaacctacatgaccccatagatcctaaatcctttccccactcctctttctgttccttgaagacagctttagagactgcccccactctagctctccctgactcatcccaacccttttcattacacacagctgaagtgcagggctgtgcagtcagaattcttacacaaggactgggatcgcgtcctgtagcctttttgtccaaacaacttgaccttactgttttagactggccatcatgtctccatgcagcggctgctgccaccctaatacttttagaggcccttaaaatcacaaactatgctcaactcactctctacagctctcataatttccaagatctattttcttcctcacacctgacgcatatactttctgcttcccagctccttcagctgtactcactctttgttgagtctcccacaattaccatttttcctggcccaacttcaatctggcctcccacattatttctgataccacacctgacccccatgactgcatctctctgatccacctgacattcactccatttccccacatttccttcttccctgtttctcaccctgatcacacttggtttattgatggcagttccaccaggcctaatcaccacacaccagcaaaggcaggctatgctatagtacaagccactaacccgcctcttagaacctctcatttcctttccatcgtggaaatctatcctcaaggaaataacttctcagtgttccatctgctattctactactcctcagggattattcaggccctctcccttccctacacatcaagttcaaggatttgctcctgcccaggacaggcaaatttgctattctactacttctcagggattattcaggccccctcccttccctacacatcaagcttaaggatttgaccccacccaggactggcaaattagctttactcaacatgccccgagtcaggaaactaaaatacctcttggtctaggtaagacactttcactagataggtaaaggccttttccacagggtcgaagaaggccaccacggtcatttcctcccttctgtcagacataattccttggtttggcttcccacctctatacagtctgatagcagaccggcctttattagtcaaatcagccaagcattttttcaggctcttagtattcagtgaaacctttatatcccttacagtcctcagtcttcaggaaaagtagaacagactaatagtcttttaaaaacacacctcaccaagctcagccactaacttaaaaaggactggacaatacttttaccactttcccttctcagaattcaggcctgtcctcagaatactacaaggtatagcccatttgagctcctgtatagacgctcctttttattaggccccagtctcattccagacaccagatcaacttggactatgccccaaaaaacttgtcatccctactatcttctgtctactcatactcctattcaccattctcaactactcatacatgccctgctcttgtttacactgccagtttacactgtttctccaagccatcacagctgatatctcctggtgctaccctcaaaccgtcactcttaactcttaaagtaaataaaaaatctttgctggcaaagctatgctgaacctccttaggcactctctaattagatgtcctaggtcctcccaattgttagtcctttaatacctgtttttctccttgtcttattccgtttagtttttcaattcatacaaaactgtatccaggccatcgccaataattctaaatgacaaatgtttcctctaacaaccccacaatatcaccccttaccacaaaatcttccttcagcttaatctctcccactctaagttcccacgccgcccctaatcccgctcgaagcagccctgagaaacatcacccattatctctccataccacccctaaaaaattttcactgtcccaacactttaccactaattcattttatttttcttattaatataagaagacaggaatgtcaggcctctgagcccaagctaaggcatcatatcccctgtgacctgcacgtacacatccagatggccggttcctgacttaactgatgacattccaccataaaagaagtgaaaatgccctgttcgtaccttaactgatgacattatcttgtgaaattccttttcctcgctcatcctggctcaaaagctcccctactgagcaccttgtgacccccactcctgcccgccagagaacaaccccccttttgcctttacctacccaaatcctataaaatggccccaccccatctcccttcactgactcttttcggactcagcccacctgcacccaggtgaaataaacagctttattgctcacacaaagcctgtttagtttagtggtctcttcacacagatgcaagtgaaaaaacccacagtgagatatcatctcaccctgcttagaatgccttttatgaaaaagccaaaaaataacaaatgctggcaaggatgtgaagaaaggggaatgttcatacactgttggtggaaatgtaaattagagcaattgttatggaaaacaatataacttccaaaaacattaaaaatagacttaccacataatccagcaatccccctactgggtgtatattcaaagaaaattaaatcagtatgtcaaagagatttctgcactctcatgtttattacagcactattcacaatagcctagaatcaacctaagtgtccatcaatgaatgaatggataaagaaaatgtggcatatatgctgtatttggccattcttgcattgctataaagaaataactgagattggataatttataagaaaagagacttaattggctcctggttctgtgggctctacaggaagcatagtgccaacatctgcttctggggcctcaggaagcttgagaacttgttcactatcatgaggatagcaccaagccatgagggatccacctccatgacccaaacacctcctaccaggccccatttctaacagtggggattacaatataacatgagatatgggtcaggacaaatatccaaactatatcatatgcacacttggccataaaaaaaggataaaatcgtgtcatttgtgacaacatgaatgagtagagaggacattgtggtaagtgaaataagctaaccacagaaagacaaatatcacatgatctcattcatatgtgaaatctaaaaacactgatctaatagagagtagaagagtggttaccagactgggaaagttagggagaagaggttttaacaatgtatcatgtatcaaaataccacattgtaccccatcaacatgtgaaattatcatgtgtccacttaataaaaaaaaagaaaatggaagagtcaagatactggggcacttgaagagatagaaggtgaattggcagtaaggaagagagagtctgaaagagcaggtcacagagtggaacattaaagtttataacattagaaatcaatttttaagttattgaaaagtttatagccatgaaagtgagtagctcaattgaagtgaaagtaaaagtcaatgaaagattaaattagaaaatatattgcttggcatttagtagttacttcagaaatattaataaatcttaagaaaattaagaacgccaaagcattcatagtgggccattatcataatacaaatgtatgtggtaatattttattctttctagtgaagggagtaattcaacagtcttgattataggttagaaaatgattctccaggtgtgacccactgaccacattcattgtatttgaattgcttgagcaacttgtttcagaagaaaatggaaagattttaagatggaccaatgaaattaccactgagtgtcttcaagaaatctcagccttgcctagaataacctgggttatctgtttctatggggtctttttgccttttgttttctttgttatttgcaatcctgttagtcatagattactgatagtaatgcaaatattcttgtccatagacatgcaaatgactgatttgggtggaagtataattaattttccttttttcaccttccatcaagaagtcagttttgaacctatcaagaaaatttatttcagtgttccttagtgcatagagatgtgtggctcttttaattttccataaaactcattataacatcttactgactccctcattaaataaatgagttaaacaaaaatcttagacaaatgttcattttatatttgtaagtcataatttatcctacttgaagcaattttcctttaacattcctaaaaatacagattcctatgccccatgctagacctactgaatcaaaatctcaggcctaaggcacaagaatttgcattgttagtaagcttttcaagtgatttttaggcatactatattatattaaccattaccattctaattctttaaacttgaattattgtgtttataattccaacttcatcaaagtaaactttttgttagcaaaaacggtagaaacccccttattcaataagattgggaccagtaataaatagattaataacaaatttaagttagatggaggaatcataagaagtattagatgtaagtccttaaaacaactttaatttaaaagacatgtgtaaataaatttgccactattttgatgacaaggtcaaagccttgcacggattcaatgagtggagtttcttgtggaaactatgccaatgatatgttgtcattcatttctcgttcactttctgtgaagacaactggggtaaagcaatctgaaatcctagagtatacaatttttcccatttgtttctagttgtcttgcccactgttaagttggcagcaactgtttgagtgtctcattttcccaacacatttggtttatttctcaaagaaacaacaatactactcttgttgtactcattttctcagtttacataatatttattttttattttatttattttttttttgagatggagtctcgctctgttgcccaggctggagtgcagtggtgccatctctactcactgcaagctccgcctctcaggttcacctcattctcctgcctcagcctcccaagtagctgggagtacaggcgcccgccaccacgccctgctaatttttttgtattttcagtagagaccgggtttcaccatgttagccaggatggtctcgatctcttgacctagttatccgccctccttagcctcccaatataatatttaattaaattgcataactacaagagcaagaacaaatggtgtaaacatatttaggaatgaacacagcttcctcttagaaactatataatttctgtgatggaaggagaaatgtacaggcattaaaagtagctcaaaggctttcagtttgcaatggacatcagtcaataagttgtacaggggtaccagaaagtgctaattgtaaatcagttaagtggaggtcagttaaggcagcatccactgtatcttaatttgtgaagtgaatgttctaaaactgggttcacttttgctataaaggaccagatgataaatattttaagctttgcaaaccatacggtctctatagcaaccattcaactctaccattgtagcaggaaagcaccatagatccatggatgtgctccaataaaactttattaaaacaggcagctggtctgaggtccatgtatatatcttgctgttttcatacaattttctaagttagtagtttcctgcctttttaacaatcacggattacttttaatcctctcctctgattttatgtttcaaaagccttaagaaaaacccacaaaatatatttattttgtaattttgggggtggttcttattttattaataagtaatcaatgatatataaaggctacccattaggtcagtatgaaataatcaacattactaactctaatgacttagttctggatagaaataaaatatattcaactatatatacataacttaaaacctgtatagctgtttctggtgtaaatatataacttttcgagattttttcaagtattaaatacaacttttgggaatccccacacctggctccctatgatgacgttcaagaattccttaggattctgggaatcttagaatgaaagtcactgctctgtaggaatgaatgaatgaatgaaaaagaaaacgaaggaagaagacagagcatgtctactaattataaattaatcatcaatgaatgtttattttataaataaatttgtcaactttaggttgccaaatctaacaagataccaacatggcattcatggtgatcacacctctagtcaaattttattttagttcattgactatactattaatatcctgaaatactcaaaacttctgtctcaattcggtgaataattcacttattaatcaccgtatacactacttaatgaatggaatggtgcttggaataaagataattacagggctaaaaggtttttctctggaggcagggcatagaattttgttgtctgactggaataaaacaaaattaatcaatattttctgcaaccagtggcttttgacttagtcgtctattaatatctatcaatcactataatctcagtcctatttcctccatttttctttttgctatcataaaaacttgtccatttttttcctgttagatctatatgtttctcctcttttcttttcatccaaacaactggacatcaacttagtacacatagtccaatttatccgaaccttacagaactcactgtttccatttacataacttacataactgtcaagctgaaatcactctcaaatttttttaattcaaaattttaatttaatttaataatatttatttattcattaattaatttattttgaaaataattttaacttgtattttacattcaggggtacatgtgccagtttgttacatgggtatatctcataatgctgagttttggggtatgaatgatcccatcatccagatgctgatttggtatgatttgactctgtgtccccacccaaatctcatgttgaattgtaattcccaatgtagggggaatgacatggtgggaggtgattagctcatgagggcagatttcccccttgttgttcttagatggtaagtgagttctcatgacatctgatggtttaaacatatggcaaatcccccctggctcacttgctctccttccgccatggtagaacgtgccttgcttcccccttcaccatctgccatgattataagtttcctgaagcctcccagccatgcttcctgtacagcctgtggaattgtgagtcagttaaacctcttttctttataaattacccagtctcaggtagttctctacagcagtgtgagaacagattaatacatgagcataatacccaataggtagtttttcaaaccttgccttcctccttctcccctctagtagtcccggtgtttattctttccatctttatgtccatgagtacccagtgtttagctcccacttataagtgggatcatgtggtattttgttttatgttcctgcattaattcacttaggataatggcctccggctgcatccatgttgtttcaaaggacatgattttgttatttttatggctgcatagtattccgtggtgtatgaaatggtttggaaggtggcccctataaatctcatgatgaaatgtaatcctcagtgttggaggtggggcctggtagggtcatggggatggatctctcatggcctgatgccgtccttgtgatagtgaattctttcaagatctggttgtgtaagggtgtgtggtacttacccccactcccattttctcttgctcctcctcggaccatgtgatgtgcctactccctctgtgccttccatcatgagtaaaagctccctggggcctccacaggcgccatgcagatgccatcaccatgcttcctgtacagcctgcagagatgtgagccaattaaatctcttttccttataaattacccagcctcaggtatttcttcatagcaatgcaagaatggcctaatcatactgtgtagatgtaccacattttattgatccaatccactgtcgatgggcacctaggctgactccatgtctttgctattgtgaatagtgctgcgatgaacatgcaagtgcatatgtctttttggtagaataactgattctctttgggttatataccagtaatggaattgttggcttgaatggtaattctattttaaatgctttgagaaatttccaaaccgctttgaacagtggctgaactaatttacatttgcaccaattatgtgtaaatgttcccctttctccacagcctcccaagatctgttgtttttcaatttttgaatagtagctattctgactggtgtaggatggtatctcgttttggttttgatttgcatttctctgatgattagtgatgttaagactaatctttgccaccaaaaaactaggaaaatacagtgtcacttgtcaaaataaattgttttactttgctttaaaaataatcaattgagtagtatatttcttccagcaaaattaagaagtaaacatttagaattgtacagtaccttgctgttaagtcttcgcacaagtataccaatcgaacataaaggccaccttaaactttcatttgaaatgaaagacaatttttaagaggttaagggctagtaatttcttaaagtcctgaagttaaattagctcaagtaaatgcaaagactttcctttaattaaagacttttaaatgaacactttaaagcatagttggtttctccctcaaatcttgtccaaagccactgtttacaactcagcatatcaaagaaggcttcagacatgattgtgaagctccctcaacttacagtgtgctatttgcaaccttagatgctatcattctggcttttctaacttttagcaacaataagcacacccttctcatttctcccccaccctgacttacccctcttttcatttaatatacaatttttctcagagtgttcttacacatctttaactgtaaatatgacaaaagcacacagtatagtacatttatcacatgtataaatgctgtatctagtcatacaattttccttttaaaaaagaaatattttattttcaaaaagcaaagactctaggaatcttttctagctgccagtcataaaaacataaattcctggttagtttcccaaatttgcctgaccataagaaccacttgtgatacttgtcaaacacatgtatgctgagtcccatccatgatctcctgaatcagaatcaccaggtgagaggcctgggaatacacattttaaacaaatgtccacagtgattatgattagtaaagcttgaaaaacatttcactaggatctttatgactgaataacctcacaaacataggaaagttactggaaaaaaatatgagcagaatttcagaattctgcctttgctgaaagtgtttgttccctcctcctctactcatcaagacctgactgcttatgcaactcccccaaaccatcaatgggaagagctgaaaatgattttaatgaagaagaaaagctgatgtttaatttcaaaactgacggtttgaatagaagggagaggcatgaatttatcttgattctaacagaaagcattgtatttgggtctacaaacgaaattggtttcatttttattttttgtaagttttcgccaaactctgtgcatatatagaggctgggcaagaaagaaagaaatccagaaatacggcatatgccatcccttatttatttccccatgcgaccagccaacagcttcttcacctagtccctgcttcaagctgactttcagtctacttctctatcggaaatggagcttccccaaagactgcctcaatgtcagttacccagaggccttttttccatcttgggctcctaaacttctatgatattaaatgatactaccctttctggaaattctccttagctttgatttctataatttaactctgtttcattccttcttttatagcctttcttttctctatccctttactgtagacatattgtacgactttgttcttgaccttctgatctctccacattcattccttcagagcatgtatccattttcttggtgtcaggcttcctgactatctgattattaccatcatataacgatgttggtgatgagcatagctaacatatcctaggcattttccatgtaggttataataagcaccctatataactcgtaccatttaattcttcaaccctaaatgatactattactaaccacattgtatgagacgaggaaacagattttcatcaaaaccctggaaagccaacgtgaggagcccctgtgtgtctcctttgttaatgactccgggcatcatggcatgtggattgccatggaatggggattaggaagcgcagcactgtgaaaacaccagaaaatacgttgatagcggtaaggacgctcatctctgcacattgtgacggttttgtttctgagtcaggtttgagatgagccaatcctgactccatggtgccaccagggatcacgaatttaataagatcttcgtggatgcttggaacccaactggtctcggttttctactttagggaaagagccacagcttgagtggggtggttttggtgtcacatacgcgattaataacacccaccgctgcagaggaatcaccgtggactactcctcctttcatcccatgctcttgcgatggatccctctcacctgtttactgatttcattcaaattcttcagcgaccacaggaccccgacttgccttctctatcctggttccctcactctgctttacaggcctggcctgctcgctgctcctcacaccagcgctgcacggctccctccacgcctccgccctgtttcctccatcagacaggactagcttcctccatctctgtcgggcaaatgcctgcccagccttcaagaccctcctcagatgccgcctccacgattaggcttctttcagacccctgagcctgtaacacgggctaccataactctccacctcagcccacattcccacagcactcgcgacgtccgcgaccctcaacatggcgcttcattctcttttagggtatttcctgcttgtttcctgcacacacagtcgcgcgaggcgcagtcctgagtgacccacgcacgagtggcccgcgcttccagccgcgccgccgcaggccagcgagggcagcctgagccgcttcccgccccggcgaggaccgtcgccagcccgctgctctagcaggaggcggttccacagcgcacccggcagcccagccaccgtcagcaccgcgcctcgggcgggcttttctcccttccgggaggcgcgaatcctcaggggctccttgagagggcgccagggagcagctgcgcgcggatgccttttggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagaggtgggtcctgcagcttgggcgggagcctcctccgttcttttcggacgcactccacccccgcaactccggtggaagccgtggcgcggagagccggctttgtggcctcccaggcttcgccctggcccctgtccgggctggacggaggccgggccgcggttcccggcgtctgtgcagagaggggcagcctcccgcgcggacgaccctggaaacaggatagacgggcaggtgacccgtgaccccgtacccacgagtttgggtcccctgaggcatctctccaggcctctgcctggggggtctgcattagtctgatctcgtagttcatgataatttcctttattagggattattattttctccattgtctcttttctttctagaaaacttattaattttttctaatctaatatgtacagtgaaaccaggatgaatcacacagtggttgaggtgtatatgggctttagggatatgggctcgaacctgcactcttgtcatttactagttttgtaatttgtggcaaattggttaatatgtctgaacttccatttactcattaagagatcaaatatctgaacctccgtttacacatttatactttcagacgttttttatacttttagaagactgtgaggattaaatgagagaacatatatgcagaaaataaattgagccaaatgtgaggaggaggtcgtaatggtaatttattagctttttaggaaaaaatacctgtgcactcatatccccgcttcttttttaactggcagatttgcccgaggtacatacaaatgtcgagtatttcctcctggtctccgtgataaacagaggttttgatatttttaggcgagatagaaagtatcaaggagtgagttgaagccactggccttgagaaccctctcgaggagtctggcctcatgaagatgccagaataaatggcaggtttatcctgaatgaatgtgagatttttactctgtgaatttcctgggaggagaggagagttatcttctgaaaactttataatgaaaatgcagacacgggtgtcttaagatcatcgtaataatcataattaatgctcatatagcactgtcaatgtgccaagaaattgttgtaggcactttgcacattaactttttttcaaatcactcttggttttttatttttttattgagatataattcataattataaaattcacccttttgtacagtcaggggtttttagtatatattcaagaggttcaccactgtctagttgctcagcattttcatcatctcagaaggaaatctccccctacccattaaagcagtcacatcccatcctccccctctcctagtccttggcaaccactaatccgctctctatgtgaaatcgcctattctgaatatttcctaagaaatcatgcaacatgtggccttttgtatctggctcctttcacttataacattattgaggttcatcattgttgtagcgcctgttcctttttatggctgcatagtattccattgtatggatgtatcattttgttcatccattcatcaactgatgaacatttgggttgtttcccctttttggctattgtgactaatgctagtgtgaatattcttatgtaagtatttttgtgggtgtatgttttcatttcccttgggtatacatacttaggagtaaaattgctgggtcatgtggtaactttaactttttgaggaaccccaaactgtttcctgtagatgctgcaccattttacatttccaccaggaatgtgtgaaggtacatattacctcttaatcctcacaatagccttaagagttaggttaagttactatcctaattttttaagtggggaaactgactcagagagattcagtaccttttccaaaaatcacggagctaagaagtgaaagaatcaggatttaaaatctggcagtgtggctctacaatctgctttgaactctaacgtaatatgtgcaaagcctgaagcaacttctcagtactgtatttaagagggcatatcaatgtaagtcttcctaaatcaataatttataaatgaaacagcttaaaagactttcaagtttcaatcttacaatatttatcgtacaaatcaatatacctaaactcgtctatataaattatgtcctgtagtaagaagaaaaagagcaaagataagaaaagaaaaagagaagaagatgaagaaacccagcttgatattgttggtgagtcagttttcagtgctctattctgaaaaaagttaatgtttcttgagatctccttgaaagtgttttcctagttagaaatttatgatgtattcatatttgtcttaaagtgcttaaatattacctacagttataaattccatttattctttaacacagtagatgctactgatgcctttacttcattatcaggagagaaaaattataactctctgacttagtaggcaccattagactgcttaatagccagagattctaatacataattttaaaggcctaatgtaaatgttattcaaccaaatatcttttacaagttattttctttgcacatgtatgcattttaattgtagaagtcggttgtctcttaaaggaagtatcttcacaggaaaaatcattattttgtgaactctgaaatgaatgaaaattttaaatacaacatcagggtagcctgtaaatgatactagaaataaactgacctaaacacacttaaccagcctgttttccgtttagttcttttccatacatatttttttctcttttaaaacttggcaagttgcattttgaatcttcataaattatggtaacttaatatataaaatatggaatggtataaagctaatgttctggaagaatcattgctttcaaaatggcaaatcaacaattctaaaattagggtaaatatctagggtagatatgtagatgtggaattgctgtgtcaaaggataggtgaatgtttaactatataagaaaatgccaaaagttttctaaagtggttgtgccattttaccctcctaccaagaatgaattagtgctccagttacatccttgccaagagttgatggtgttatcagtcttttctcccagtctgagttttaccttttcagtttcttaatggtggtttttggatgagcagcttttttttgagacaaattctcactctgtctcccaagctggaatgcagtgatgcgatctcggttcactgcaagctccacctcccgggttcatgccattctgctgcctcagcctcccgagtagctgggagtgcaggtgcctgccaccacacccggctaattttttgtgtttttagtagcaacagggtttcaccatgttagccaggatggtcagaagcttttaatttttataaagctcagtttattttttttttcttttatggttactgtcttatgtctttgatctaagagatctttgcttaccccaaagtcaggaaaatattctacattgtcttttagaggcatcatagttttagtttttacattaaatctgtcattcatctcaaattaaattttggcatgatgttgtgagttcggtttcaagatttactttttttttttaaacatcttgatagccagttgtgccagcaccactggtgtttcctttttccattaatccactttggtatcttcataaaaaatcaattaactttctatgtattggtctgtttctggactctgttctatcgatacgtttgtctgtttttctgttggtatatttctcttgattgctataatttcatgaagtcttgagatcaggtagtgtgagtcctccgactttgtacttattaactgttaatttattaatttctgcagtgaagtttgttggattttctcgagaactgtattgagtccagatcatttgggggagatcaacatcttaatattgggcctcaatatttcataattttcaatgtagccatcttgcatgcctgtttaaacatttattcttaagtattttataattttacattactgtcaatagaacctttgaatttgattttccagttgtttgctgtcagtatgtagatatacaattgatttttgtatagtgactttgtagtctaagtctgtttcacttattacttctagtggtttgcttatatagaaaactaagaaatttgcaattatgtttcctgtgactatcgttttacttctttctttctaatccttttgtcttgtctttctttttattggtttattatactgtccaggacttctatagcattgaacagaagtcatgagaatgggcataattgcattgctctcaagcttaggcagaaagctttcagtagtccaccatatggtatgacgtctgtaggatctgcagagaaaacttttatcaaaatgaggacattccttttaaaactttgtttcttgggagtttttatcataacgatgtttaatgctgtcagatgcctctttctgtatctgttgagatgattatacagctttcttcattctgccagtggattatattggtttcattttcaacttttaaactaactttacatccctgagataaaccccacttggttgtggtgcgttgtcctttgggatattgctagatttgatttctaggtgtttgtgttttttgtttttttttaagatttctatattggtgttgatgggagatattggacttttgtatccttttcttgtaatgtctttttttgattttggtgtcaaggtgatactgggtgtcacaaaattagatggaaagtgctgtctcctttcctatttttggaaatagctgtgtagagatgggtatgagttgttctttacatgtttgatagaattcaccagtgaagtcagctgaacccggagggttttgtttggtttggttttagttttttgtgggaaaattaaaattttttaagagatattttcagatttttctgttgtgtcagttttggcaatttgtgtcttttaagaaaatttcatctaagttgttggatttattggcatagaattgttcagaatattcctttaatatgcttttaatgtccgtagaatctcatctgtattgcagtctcttcatattggtaatttgtgtttttgctatgttttcctggatcagtcagtctagctggaggtttctcaattctttacaagatcatttattttagatcgttaatgatcgtttagtacaggtgtattcaatcttttagcttccctgggccacaatgaaaggagaggaattgtcttgggccacacataaaatacactaacgataagctgataagccaaaaaaaaaaaaaaagcaaaaaaatctcataatatttcaagaaagtttatgaatttgtgttgggctgcattcacagctggcctgggccacatgtggccctcaggttggacaagcctgtttcaatattacttattttctctttttttcattttctatttcatttattttcagtcttttatttttttcctccctttaacttattttcagtttactttgctcttgttttattgcttcttaggaagggagttagatctcttcattccactttagtttcagttatagtcaacacattttgttttcattttcattccattcaaaatatcatctagttttccttgtgatttttcttttcatggacacgtgagttatttaaaagtatattgtttttaatttctactacatagagatattataggtatgttattgttgctgatttctaattcatttatagtatagttggagaacatactttcttagtgaatttccatgtagacttgaatgtgtattctgcagatgttggttcagggttttttgtttgtttgtttgtttgtttttttggagatggagtctcgctgttgcccaacaggctggagtgcagtggtgcaatctcggctcactgcaacctccgcctcccaggttcaagtgaatctcctgcctcagcctccggagtaactggaattacaggcacctgccaccacacccggctaattttttaaatatttttagtagagacagggtttcaccacgttgaccaagctggtctcaaactcctgacctcaggtgatcctcccgcctcggcgggatccaggcgtgagccgcggtgcccggccagttcagtgttctttagatgtctgttagatcaactggtagagcttgtgactatgcatatcttctgtgtccttactgattttttactaatgctacagtgtattgatagttatgttaaaatctccagcggtaattctagatctgtctacttgagcagtttttgcttaaagtattttgaagccgtcatgtgtacacatttaggattgttaagtcttccttataaattcagtctttcattttcataacattttaaccttatttctgttaaatgtcttgatgcctagtcaaattatttgaccacccttttgctcctgtcaagcctgggcctttgttagtttgtgcttatttattagggttttgctcgtagacttagacagtgactcttagtctaggaaaggttcatcctcatgggcctcagccacatgttctaggtatacttagtgagttctctccactctgctgtgtcccaaatttgtgtgatctctggcatctccagtcagccctcagaagtgccagccactctgcagaggccttgtggagcctgcctgctgcatgcactccccccagcccttggccacagacctgcagagaacttttgcgtactcttttgaggcctcacctgtatgtagttccctcttctccagtaccttattctataaactcccaacatgttagcactgtaagactctcagcttagtgacagtgacattgcctcatttctggaggtctctacctctctccgtgtggtcaagaaactgccattgggcagaaaacacaagtgtgtatgagatttgcctccagtgttttcctgttctcaaatatcacagtcctgttctgcctgtgttccaatctctgaaaacagttttctcaaatattctatccagtttcagttttctcgttggtcatggtgggagggcaagtccatcttggctggaagaggaagtccttctgcgtctttttctctttgtccttccacatggttttgcattgtggattttctaaacttgccgtataagtaagcatgtgcctatttgtgaagggaaagaaaaaaaaccttttaattttttaaagctgttctgttggttcctcacaaggatctgaagggattggtaaataggatgaaagaaattctgtctttcacatggagaaaaccaagtgtgacattaataaaaacgagcatgtctgtaggcaaagagtttcactgagctctgctagattcagaagcagttggacttacaacatcgtactttgcaaaacacatatattttatttacccaggaactaaagctaagtcagctgtggattaatagaaggtctgtgaagggtacttagactacagtaagattggggaagaaaattccatttccaaatctaagatatatcattcctttgtgccaagcacataatgatagtagagatttaagggggcccttagcacggaagcactgggttagtcagaaggtgaggtgagctgtcacacagccttgatgctagaatgagggtgccctggtactatcttatcagccatgacactggtgcattgggccatttttttgttttgttttttttgagacaggctcttgctttgttgctcaggctggagtgcagtgacatgatcgtggctcagtgcaccctcgacctcgtaggctcaagcaatcctctcacctccgactcccgagtagctgggaccacaggctcgtaccaccacacccagctaatttcttaatttttttgtagagatgggggtctccttttgttgcctaggctgattttgaactcctgggctaaagtgattctcctgcttccacctctcaaagtgctggattacaggcatgccagacatatgtaaacattctaaactatgtgacaatatgtgtaaagctttctcatgcattgtgagacaacacagcaggaatatttcaccatctgcctaaggtttaaaaggaaataactttaagcatgtgtctaaatagcaagtaatgttttagagcggattctcttaaattcagcttgggcatctgcaccatatacacagcttgagctgtcacctgacgtagagacaggcaacttcagtgcccgtgttcataggatccactgctttctcacagctaaaaccccagagtggcaccattaagtattatgttatgttactttagtcgataaacatataagcatacctccaaaggttgaatgtaggccacttgcagaaagtaggcagaatgctcacatttaattcttgatgatactgtgtttatatttcttattctttgaaattgcattgagaaaaaatactggcatctgctcaaagtaatttctttttcagttgacaatattaaagtaacgttattgtatcatttccctacttggacagagtgtgaaaattttaaggagcttgtctgccagaaatttcttcttcatttgcaaaacattaatgagttattatatttaaatgattttatttaatattaagtgtacttggtcaatgtggcatagaacatacaaaataaatctaatttaaaatcattaactattatatttataagaaagacttgctaatcataacactgttgataatgattctgaataaagcattatttcttttcctgaaaacaattgtagctataattcaatcatctaaattgcttattagttttatttctttttaattgtctttagctgaaattttaattttgattaattttctttttctccattggttttgtgtgtgtgtggaggtaaaatatacagaatatagaatttgccagtttttctatttttacgtgtatgcttcagtggcatttaaatacatgcaccattttaccttcccaccagcattgcacagggtttccgtttctccacatcctgcccaacatttgtttttctggctttcttggtttctgttttttgtttgtttgtttgttttgataatagctattctaatgggtgtgaagtggtattgcattatggttttgatttatatttccctagtgactagtgatgttgagcgtcttttcaagtgcttattggccatttgtatatcatctttggagcaatgtccgtgtatatcctttgcccagttttgaattgtggtatttgtctttttggagttctctatatagtctggatattaattccttataatgtatgtagtttacaaatattttctccattccctgggttgccttttactctgttgatggcggttcttgatgcacaaaagtttttaattctgatgaagtccagtttgtccacgttttcttttgttgcctgtgcctttgatgttctacataagaaatcattgccaaattcatgtcgtgaagcttttcccattttcttctaaaagttttctaactttagctcttacatttaggtctttggtctgttttaagttactttttgtatttggcattagataagggtccaacttcattttagctaaaattttatgtattttaaaatttattatggaaagcatgaaatgtttagttgaatagaaaattttgtgcagtggaattaactgaatctttaaaacctttttattatggaaatatccaaactattccatacatagaagaatataatgagtcccccatgtgcccaggccccagcattaattatcaatattttgccaatctcatttcatttacacacatgcccccacacacattttttcttagaaaattttaagtaaaatcacagatgttatgtcattttacccatgagtacataaacgtacatttcttaacgtggtatgtctttctgtcatcacctgttttgttctttatttttatatattatactatgtcattatcagaccttgtaaaattaacaagaattccttaatatgtcatatccagttaatgattgactcatttctactctagctaaagtacaatttaggaggaggtttgaggatattttttaacattaagatataaacttttataacaacggcttaaataattgttcctagagtctaatatttctattggcaaattggaaattagtatacatagacatagattctgctcattttactttcaatctaaaatcatagttaagattactggccaggcgcggtggctcacacctgtaatcccagcactttgggaggcagaggcgggtggatcacgaggtcgggagtttgagaccagcctggccaatgtggtgaaaccccgtgtctactaaaaatacaaaaaaaattattcaggcatggtgataggcgcctgtaaccccagctactcgggaagctgaggcagagaattgtttgaacccgggaggcagaggtcgcagtgagccgagatcgcatcactgcactccagcctgggcgacagagcgagtctccgtctcaaaaaaaaaaaaaaaaagattgctatgctagaaagtcttcctgtagaggcatttttaagaaacattatgataggcattggctctggaaagcaggcatgaaatagatgactggggtctatcatgagagagaccattctctatatgtcactttgtaccttcacatgttgcctcttgttttgttttggtctttttttgagacaggaccttgctctgtcactcaggctagagtgcagtggcatgatcatagctcactataacgttgaactctgggctcaagtgatcctctttccccagctccccgagtagctgagattacaggcatgcacccccatgcctggctgtatgttgctattttatgttttaaaaacctaatcctgactgtgctggtagtcgcatgaatctctgcacatacatgcaaacaagtacatgtaaaactggtgaaatctgaataagcttcatggattatatcaatttcagtttcctgattctgacagtgtatgatacttatgcaagatttaatcgagacaaagtgagtaaagaatatgtgagatctttgtattatttcttacaactgcaaaataagaagtttttaaaattaagttataataacaaaaaaaagaactctgtgtcaaaactaaaatataaagttgaaatattgattttattttttaggaatctggtggacagtaacaaactttggtgaaatttcaggaaccatagccattgaaatggataagggaacctatatacatgcactcgacaatggtctttttaccctgggagctccacacaaagaaggtttgtgtctggaagggaagaggctgccacaagtgtagattttaggacattcattcacttaggccaaactctaactagtctcaaacattttccaaaggaatggaaccattgcatttgactcttccatttttttttaattccttaatatttaccagccattggcaagtccctctttctaatataagcatttgaaaacattccgtatagttccagaagagtatctttggaaatcaaaataacatgaataattaaaatagtaagtggaaagaaaaaagaaaacctatttgagtcaaaatgtttgaatttcttttttattcagacctattgccaaaactaacctgggtgcgtttaacagtttgaagtttcctcattttctttagcccattagaggaagcactaatgagatatgaagtaattagaagataaaaagcagtatcatttggtcagcaaggccatcccttgaataagtgaaagcatttagctttttaaataagtgcttatttatgactgtattttaaaacataaagagaagctatctcaaaagttattaaataagcattatatcaccctgtcttactcagtgtataaaattaacactgtagttaaaagaaggtaaaatagatcttgattccaaagatacagtattacagtgacatcagtatatctgaatattcttacatttaattgcagaagaaaatagccacattttttaaaacaaaataatgtctttatatttatagcaaatgtcaaatttattttcaaatgttttttctccaatagttgatgagggccctagtcctccagagcagtttacggctgtcaaattatctgattccaggtgagcttatgttgtaatataattagtaaccagttattttaaaaatttaattgtattcattaaaaattttagtatctgtcttaagcccacagggtaattttgatgtaaaaaacaaaatagcttttttgaaaagtagattttgtgatctacttttaatggatttcctatcaatatataatgctaggctggaaaaaaaataagttaaaaagtgaagattaataatttcacataccgaataagatagattaaaaaatgaatcaaatagtacaaaacctggttcactgttgctgtgatatttaaactcactgtttggaagtccaaaggcaaacaggaagactaaaaaaaggaatattgttgaaaccagcagagaatgttacagaatcataacgaccaaaagaatatttttactcactatttttacagtcattttataaagtaaccttttttattctcaccttgtgcaaaagtatagaacgattctttgggcagaagatactgaaagtgaatttacatattttagtaattggttacatcaatatgataatgatttctgttatataatcattaatgtataaaggagtaaaagtcaattctggcatcccaggagattctcggtaaggtaaaagattagaaatcataattttaaaaaatcacattaagatgattatttctgtactttctttgaaagtctgataagtatggtgaaagacagaataaaagcagaggaagaaaaaattcaatagttttaaactgctttacaattataaacaaaaaaggattataaagaaaattaactgacaaatgaggaaaatatttgcaacaatcttaataggcagtgagttcttactcttcatatgtatcttgtatagaattcatagcactgatgaccccagtagaaaaactgcgaacaatcagatctcaatagaaaaatggacaagggacattaccagataatctaaaaactaaaaaggaaaggaaaagaaaaacaattgttattctagttaactactaaaatgcaaatttataggatactgttttttccatatcaggttttcaagtatttttttaaagtcataatgtttaaaaaaaaatgcgtgatacaaaacatactctgttaatttgaggtaagaatgtaaatggaagcagcattttctggaaaacagtttgatgacataagaactttatactcttcgatccagttatttctaggaattttttctaaggataaagcagttttatgtacagaatagatgtacatagaactatttataataagagaaaaagtaagttttagtaatttattcttgaactttataactaaagaggtataattgaagaatgatgaatttcaaaaatatttgttatgtaatatataaggtacaatgtttatattaaaaaagcacaatataaaactaaatttaaaactgcactgtccaacatggcagcaactagtcacatgtagcttttttcttttttttttttttaaaggcacagagtctcactctgtcacccaggctggagtgcagtggtgtgaccgtatctcactataacctcaaatttctgggctcaagcaatcctcctgcgtcagcctcccaagtagctggtatcacatgtgcatgccgccatgcccagctaactttttaaattttttgtagagatggggtctcactgtgttgtccaggctgatcttgaacttcttgcctcaagcaattctcccgttggcttcccaaagcacagagattacaggagtgagtcaccactcagccacatgcagcttttgaagacttggaatatgtgcagtctgaaattttagatatgtacacagccacacacatacgcatgtcctgttttgatgtcctataattaattttctctcagtctttaacttttatctatgttattaatgtacagaatcgccctgaagtctggctatggaaaatatcttggtataaattcagatggacttgttgttgggcgttcagatgcaattggaccaagagaacaatgggaaccagtctttcaaaatgtaagtgctgttattgtttataaaaacttcctgtcagtttaacagaaagtctgttaacagtcaatcataatatatttaaaaagaaaaagtaggatgcaatagtgtaatacattaaataggaataaatcaataagaacatagagccttaaagagatctcaaaatatagtgcaacaaaaatcgcattagtccttttgcccacaattatttctgtatacccttagtgcctagatatggatctcatttccattgaagaaccagtcaattttaggtctcagagtaggaaaacagagtagttcctaagtatctttgtagcagaaatcatggatgctttcagaaacattagagactgtaagcgaacagtggagcttgctaagaccaagttgtgacaatttgtgcataaaataaataataatagttcattgaagtaaattatctctaaaagactttcagttcataagcttaaaatagcatacgaaaagatagttttaatataagaagaaaaaagataatatactaattcttaattttagtaagtagacagttgtatatggatgttttgttaaatctttgttgacacagaatacataatttcctttttctgtttgtgtgagaagtaaagattgaacaaaaatatgtgagtgctaaacagtctttaaaaagtagataactttatcaaaaacagtaaggaccaatgggcaccacgcagagcaagcaaatagaagataagcttagcctttgagtagcagctttggtagtatacactaatgaattgaaaataggaactcagcagtgttttctaagatgacagattaaacaaacatccctccagaaagaggtaatcacttagactaatttcctcatcccctaggataaaatcttaactcagtgacttgaaaactattttggcccaacccattgagaaatgcatttttacattgcagcccagcacacatgtataactgaagcaagagttgtacttaacaatacttacttatccatgtgttatgcaccttgatatttcttattctcttttaccccttcctctgtgagtctgtgtgtattccttcccccgccccccataccgtacaggaaacaacactacattgatttcatgacccgctaatgtgttgcaacccctttgagatgatcctactagttaggatgagatacttctaataaaagttacaccggtagaaaaggccaatatatcataaggccttagatgatgacttagatagtactaataatacaacactttaggaaagttcgtttcattttatttttaggaaggacactaagtttcaaaaatttaaatttaaatgaaagagggtcttaaaactattgcaaaagggactcagctgaataatctgtggcacaggtttaaatcgtcttggaccacaccaccatgttccagggctcaccaggagccatccagatgagagaccacccagcccttgtgaccttgactaagaaattaaatccatgttatcagcacttttttaacttgatgtgatataaggttaacatattttgtaatcattgtatttataaatattttgtctaaatgttatggtattccaagttttccaaaagaatcaaccaaatacaagttataaataaacattatatttgttaagggagttaagctaaccaaatttataacccagatttagatacacaagaaaatcagtctttaaagttttaatagaaagcagtgtaatatatcaaacattaaacaactaaaaaagtatatgaatatttattttcacacacaaaagtccctcagacattgattcttaaattcaaaacaccaaagcattgtatgtaccttttcatgttttctaattgtgaagaaaataaattttacttaaaatgctaatatttgaataaagtatgcattcataattatgttcttgtctttaaagttaatttttcaaactgaactaaatcagttatgtcttcagtagatcttttagaaaggaagcaatcctacctcatctacttagaatttagtcctactaggaagatacactacaaatgtttattgtggtaatctttgaatagtaaaatgataggtgattttggtttcttttctatatgttcttgtattatatttttcaggtttttctctaagttcttttctgtgatttttaaatcagggaggaaaaattaattcagtctaaacacttaatgtttctcccacaagaagtatcctcatggctattttgttatttgtttcacttaggggaaaatggctttgttggcctcaaatagctgctttattagatgcaatgaagcaggggacatagaagcaaaaagtaaaacagcaggagaagaagaaatgatcaaggtaatgatgacattttatacagatgactgcattcacacatgcgatgtgactgtatctctttaaaatgttaaatggtcatttactgtcactttaaagatttacttaatagctttttataatgtggtgtttcaaatagactcatttttaattataaatcccatagttgatgtcttgtttatacaatgtggtagagaaatgagtgcatctaggagctaccttgccattatctccatggattagtatcttcttctggtagttccacatgctctttttaagctttcattttcttgttttcttgcttgtattttaaaatctaatttttaaaatagataacatgtacacgtggtccaacattttcaaataaaagcatgtgaagacgtatgcctgccatgcgtcttactcacctgtgtcccagcacctgttcgtctttccctttgtttttttatagcctcctaaaatttctttataaacatatgaatatgtttataattttcaactgttttacgctaaaggtagcctcctctatagtctagacttcaatttttttttttccttaaaattgtatcttggagagttttctactatgagtttgaatgtagaaagttttctctttttcttgcttttcctctctttctctctctctcaacagccacataatattccatttcagggatgtaccttaatttatttagtcttttatagatggaaatttaggctgtttccagtcttttgctcttataaacagtgctgcagtacataacattgaatatgcatcagtttgtagatgtgcgggtggacctgaaggtaaatttccagaagcagaattaccaggtcggggtatatgcgtttgtatttacgtaatgcttgagcttctgtgatgataatcactctatgaaacataaaaaatcatagcagaacttctggggccttagccctcagattttaaaaatatttttattaatagtacccgtcttctttgcattaggagaaacatgaatcacataaaacatgatttttattttatttttaaaatttgtgtgcgtcactaagctggaaataaaagttccttattccaggctaaattccctcatccgtagtcagacgcgttatccattgcaccagtggcctgtgccctctctaatcctactctttgttttacatcattgtaaaagttacacagacatcttcatatcaaggtgaaattctaaataatactgttaatataacctagataaatcaagtagttaattggaatctgatgaaaacatttaaggcttaattttttagactcacagaagccactgatctttaatgataaacatataccaggatgtgtctaaagaataactccccacttcttgacacatggcttttctgtgtcttggcattccatctcagtactgagcatcctgaaccttgctttgtttgtctctgttgggaatcacaggttgcatccagtctgacccagatttcctctgtaaggcattgtgggggccagagtggaaggctctaagagagggggcaagtgccttttctaaaatgcccttcgttcttataattagagcataaaaatttatgttacatttttctctactaccagtgcaatttaaaagcatctatcaaatctctgtacatacttcatgttagatttcctgtcataagtttgattttctttttagaatagtcttgatttcaaataatttcaaatctaaagctcaaacaatttcaatctaaaatgtaggtattttcttacagaagggaaatgttatattttttcattgcatgcacccagcacatgcgttgtagtcttgaatttccataatgcccctgtgaggtggatgtgagctcagcattacagacaagaagacagcctctgaccctccttacatcctcgtggtttttgtcagtcagttcatggaaatcacagtgatttcaaggtgtggtaagacaggatgtgtacccaggcccagctgactccagaggccactctcaatatttcatagcacattgcttctcaggaaacaggtcattggggaaatgcagatgggtttgtgacttacatttaattttatttatttatattttattgtatcatgtttaaattattttgcatctggatatcatcacaaaagtgttactgaaggcaacaattgcaaatatatgtgcagtgctttgcacttatacaaagatacaaagatacttacacaaagattgcctttttcactatttaaagcaattttcagacgaaatacaaagttttctgggtctctttggttagtcaagtacctggaagctctgaacagtgattatttaggactcttttcctttaccatttaattgcaggctctcctaatctctgtcagcccttcacctttatgaccttgccttatctaccagaacacagatccctcttactaaaggtagccttgtgttacctctgtcagcccttcagctttatgaccagaacacagatccctcttactaaaggtagccttgtgttacaggccctagcagggaatgttttcaggtctgggacccctctaatcagaactgtcacaaagatgtcatttgcacaaacacgttatttgtcatcactttctaagcagccctggaactggactctggccacagagatcccttaggagacatgagtccttaccattgctaattgcctgttctgtgggtgatcctaattgttgaatgcagattaattaacttatgacatgtggtagtaaacatctatccaaacttaggaggatataagaagctagtaaaagaggtgggttccaattagttaaaaacaagttgtgtaatgttaaaagttttaatactttggtaatagtctgtgcaacataaaatagctattaagctttcaatccgatcaaatgaacacttgtctactagggataatttgatcctagtgtattcacttggaggacaaaattaaattagttaatgatcgctttatttcctagcaggatctgatgtgtaaaatgtttctgaaataattttgtctgtagtgtttctgacacaatgctgtggaggaagcatgtgatagcacttactcatatagattatatatatgaagtaaaaacacatagccagaacctttttctgaatatagttgctcagttaattttttcttctgcataagaaatcatctcgaatgttcttatgtgatacgtaaagtggggaaggtggaagataaacatataacccattggattctcttttccaatatctagattagatcctgtgctgaaagagaaaccaagaaaaaagatgacattccagaagaagacaaaggaaatgtaaaacaatgtgaaatcaattatgtgtatgtattcttttccttttagacctacagatttgacagtgaagtgcttctcaaagtgctttcaaaataaattacctacttagctgggcatggtggtacatgcctataggcccagctactcgggaggctgagacaggaggattgtttgagcccaggagttcaaggctgcagtgagctctgatcaccactgccttccagcctgggtggcagagcaagaccgtgtctgaaaaaatgaaactgatggacaagaagagacgacacaatgtagcctctaggacagagcactgagctaaatgcttttcttttcttgaggcttcagttttcctaatcatcctaccacctcccaaagctagtcactcaggttagtcaatctctctattcattcatagaatgggtgtgatgccagtcaaaggctgtgctatggccaggacacaggggactctagccagcatgccctaatagaagtggggccttgtgctacccagtcaatgagtggccctcctcttgagaggtcatgaaggtcatctttgttgaaaagctccagcttatttaaaaaaatacaattagacctttttttttctcccccaagatggagtctcgctctctcccccagactagagtgccatggcgcgatctcggctcatcgcaacctccgcttcccaggttcatgtgattctcctgcctcagcctcccgagtagctgggactacaggcgcgtgccactatgctcggctaatttttgtatttttggtagagatggggtttcaccatgttggccaggctgttctcgaactcctgaccttgagcgatgtgcctgccttggcctcccaaagtgctgggattgcaggcatgagccactgcgcctggcctacaattagacttttttacaagtgaaaaagaaattaacagtatttataaatttaatagtaaatatgtataatcagagtttgaggtatttttcaatgaagacattttctttacagaaagaaatttcagagcttccaagaccacaaacttaaaataagtaaagaagacagtaaaattcttaaaaaggctcggaaagatggatttttgcatgagacgcttctggacaggtagctatttatttacttatttccactattttcagtagccaatagaaatggcatgtagaaaacctacattctcttaaattactgtagtttttcacatttttgtctttatttctaatttatgagtgtggcaatattacctaaagaggacatcgtaagtttgggaaaagactgtcatgaaagaatatctaaaaattataaccgattctaagtatatacttgaagaaattcaggtttgactgtatctacttcataaatttatcatctttttataactattagaaccagagttagaagcagtttgactaatataaaaattatgtggattctgttagagtagttcaggttccttaaaataagaatagatcaactaaaaaactaagtataaaagctaaacaagtgaaattgaagcagttttattataagatttggaagagtgcaggatgtttatcataccacattattaatatttattactcttcctaggtagataagtaatgtcctagatttatgacatagaaaaacagagacgtttagctgtgagtgtacaagtataaatcaattaagtgccagattttgataatcaccagccgctcattcaagtcgtatgttgcaaagttactcttacccttttttttacattacttgataaaggcaatgtttaattacgtatttcctgttaactagctggtagtgttcatacctaaagtcagtaaataatgttaagaattttttccagctgagcaaatgaatatgtatctcattgtaagaaatcaagaagaggatataaaatataatcaggatgtggactctaaaacggaataagctctatgtcctgtaacttttatcacttgtaataatacagcattctcaccctgttaaatggaaatttagagcagccttaaattccggaataattaaaattgctatttggattgaaaaagcccttaggcaacatttattgaatattaggaaataacttttataagattagaatccattttttatagaaaccaaatttaaaagtatacatattttaataaaagtgttgtggtaataaccaaaattgaacacacagttttaaagctttttatatttagtagcagttgaatatatatggcatgttttacatagattaattttatttttctttgtttaaacaggagagccaaattgaaagccgacagatactgcaagtgactgggatttttgtttctgccttatctttctgtgtttttttctgaataaaatattcagaggaaatgcttttacagagttcttgagttgtgaaattattgtttagctagtttaaccaggattaaacaagtttaatcaggattcttcatggatgtactttttagctaactacagtttttcacatggaaatgaaacttacagttcacacttaatgtaccacagaatttttttctggatttcctgtcctgaagcatgaagtgtactagaaaccaattcttcctgcgctacttgtggaatctgtcttactggatcataatcttactttactttatataatagatgcttaatcagtgcctttaatagaagttagaaactcccaatccaatcaacaaggctttggttctaccttctaagtactacccagatcacagacaatccaaatatcagaactagggggctgggcagagaggacaaatcatctattagggagtgggacagaaagcagaaacattacaaaggagcaagtaggctcagaacagaggggagagtagtactggggaaactccctgctgaggacaggttagccacagtggatatgtatgtgatgcctttgtccttgtgggctggaatggaagctggtaagggaataggaacagctccagtctacagctcccagcgtgagcgatgcagaagacgtgtgatttcttcatttccaactgaggtaccaggttcatctcactggggagtgtcaggcagtgggtgcaggacagtgggtacagtgcaccgagcatgagccaaagcagggcgaggcatcaccttacccaggaagaacaaggggtcagggaattccctttcctagtcaaagaaaggggtgacagacggcacctggaaaattgggccactcccaccctaatactgcgcttttccaacactcttagcaaacggcacaccaggagattatatcctgcgcccggcttggagggtcctgcgcccaaggagcctcgctcattgctagcacagcagtctgagatcaaactgcaaggcggcagcgaggctgggagaggggcacctgccattgccgaggcttgagtaggtaaagtggctgggaagctcaaactgggtggagcccactgcagcgcaaggaggcctgcctgcctctgtagactccacctctaggggcagggcatagccaaacaaaaggcagcagaaaactctgcagacttaaatgtccctgtctgacagctttgaatagagtagtggttctcccagcaagcagctggagatctgagaacagacagactgcctcctcaagtgggtccctgacccccgagtagcctaactgggaggcatcccccagtaggggaagactgacacctcacatggccgggtactcctctgagacaaaactttcagaggaacaatcaggcagcaacatttgctgttcaccaatatctgttgttctgcagcctccactgctgatacctgggcaaacggtctggagtggacctccagtaaactccaacagacctgcagctgagggtcctgactgttagaaggaaaactaacagaaaggacattcacaccaaaactccatctgtacatcaccatcatcaaagaccaaaggtagataaaaccacaaagatggggaaaaaacagagcagaaaaactggaaactaaaaatcagagcacctctcctcctccaaaggaacacagctcctcaccagcaacggaacaaagctggacggagaatcattgacgagttgagagaaggcagcttcagacaaactactccgagctacaggaggaaattcaaaccaatggcaaagaagttaaaagctttgaaaaaaaattagacaaatggataactagaataaccaatgcagagaagtccttaaaggacctgatggagctgaaaaccacggcatgagaactacgtgatgaatgcacaagcctcagtagccgatttgatcaactggaagaaagggtatcagtgatggaagatcaaatgaatgaaatgaagcgagaagtttagagaaaaaagaataaaaagaaacgaacaaagcctccaagaaatacgggactatgtgaaaagaccaaatctatgtctgattggtgtaccttaaagtgatggggagaatgaaaccaagttggaaaacactctgcaggatattatccaggagaacttccccaatctagcaaggcaggccaatatttaaattcaggaaatacagagaatgccacaaagatactccttgagaagagcaactccaagacacataattatcagattcaccaaagttgaaggaaaaaatgttaagggcagccagagagaaaggttgggttacccacaaagggaagcccatcagacgaacagctgatctctccgcagaaactctacaagccagaagagagtgggggccaatattcaacattcttaaaagaattttcaacccagaatttcatatctagccaaactaagcttcataagtgaaagagaaataaaatctacagacaagcaaatgctgagagattttgtcaccagcaggcctgccctaacagagctcctgaaggaagcactaaacatggaaaggaacaacctgtacaagccactgcaaaaacatgccaaattgtaaagaacatcgaggctaggaagaaactgcatcaactaatgagcaaaataaccagctaatatcataatgacaggatcaaattcacacataacaatattaaccttaaatgtaaatgggctaaatgctccaattaaaagagagagactggcaaattggatagagtcaagacccatcagtgtgctgtactcaggaaacccatctcacatgcagagacacacataggctcaaaataaagggatggaggaagatctaccaagcaaatggaaaaaaaaaggcaggggttgcaatcctagtatctgataaaacagactttaaaccaacaaagatcaaaagagacaaggccattacataatggtaaagggatcaattcaacaagaagaactaactatcctaaatatatatgcacccaatacaggagcacccagattcataaagcaagtccttagagacctacaaagagacttagactcccacacaataataatgggagactttaacaccccactgtcaacattagacagatcaacaagacagaaagttcacaaggatatccaggaattgaacccagctctgcaccaagcagatctagtagacatctacagatctctccaccccaaatcaacagaatatacattcttttcagcaccacaccacacctcttccaaaattgaccacatagttggaagtaaagcactccttagcaaatgtaaaagaacggaaattataacaaactgtctctcagaccacagtacaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgagacacattcaaagcagtgtgtagagggaaatttatagcactaaatgcccacaagagaaagcaggaaagatctaaaattgacaccctaacatcacaattaaaagaactagagaagagcaaacacatacaaaagctagcagaaggcaagaaataactaagatcagagcagaactgaaggaaatagacacaaaaaacccttcaaaaactcaatgaatccaggagctggttttttgaaaagatcaacaaaattgatagactgctagcaagactaatgaagaaaagagagaagaatcaaataggtgcaataaaaaatgataaaggggatatcaccactgatcccacagaaatacaaactaccatcagagaatactataaacacctctacgcaaatcaactagacaatctagaagaaatggataaattcctggacacatacaccctcccaagactaaaccaggaagaacttgaatctctgaatagaccaataacaggctctgtaattgaggcaataattaacagcttaccaaccgaagaaaggccaggaccagatggattcacagcctaattctaccagaggtacaaggaggagctcataccattccttctgaaactattccaatcaatagaaaaagagggaatcctccctaactcattttatgaggccagcatcatcctgataccaaagcctggcagagacacaacaaaaaaagagaattttagaccaatatccctgataaacatcgatgcaaaaatcctcaataaaatactggcaaaccgaatccagcagcacatcaaaaagcttatccaccatgatcaagtgggcttcatccctgggatgcaaggctggctcaacatatgcaaatcaataaatgtaatccagcatataaacagaaccaatgacaaaaaccacatgattatctcaatagatgcagaaaaggcctttgacaaaattcaacaaaccttcatgctaaaaactctcaaaaaattaggtattgatgggacatatctcaaaatagtaagagctatctatgacaaacccacagccaatagcatactgaatgggcaaaaactggaagcattccctttgaaaaccagcacaagacagggatgccctctctcaccactcctattcaacatagtgttggaagttctggccagggcaatcaggcaggagaaggaaataaagggtattcaattatgaaaagaggaagtcaaattgtccctgtttgcagatgacatgattgtgtatctagaaaaccccatcatctcagcccaaaatctgcttaagctgataagcaacttcagcaaagtctcaggatacaaaatcaatgtgcaaaaatcacaagcattcttatacaccaataatagactaacagagagccaaatcatgagtgaactcccattcacaactgcttcaaagagaataaaatacctaggactccaacttacaagggacatgaaggacctctttaaggagaaatacaaaccactgctcaatgaaataaaagaggatacaaacaaatggaagaacattccatgctcattggtaggaagaatcaataccgtgaaaatggccatactgcccaaggtaatttatagattcaatgccatccccatcaagctaccaatgactttctgcacagaaatagaaaaaaatactttaaagttcatatggaatcaaaaaagagcctgcattgccaagtcaatcctaagccaaaagaacaaagctggaggcatcatgctacctgacttcgaactatactacaaggctacagtaaccaaaacagcatggtactggtaccaaaacagagatatagaacaatggaacagaatagagccctcagaaataatgccacatgtctacaaccatctgatctttgacaaacctgacaaaaacaagcaatggggaaaggattccttatttaacaaatggtgctgggaaaactggccagacatatgtagaaagctgaaactggatcccttccttacaccttatacaaaaattaattcaagatggattaaagacttaaatgttagacctaaaaccataaaaaccctagaagaaaacctaggcaataccattcaggacataggcataggcaaggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatcccgaatctacaatgaactcaaatttacaagaaaaaaaacaaacaatcccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtccgtgtggtggttcctcagggatctagaactagaaataccatttgacccagccatcccattactgggtatatacccaaaggattataaaacatgctgctataaagacacatgcacacatatgtttattgtggcactattcacaatagcaaagacttggaaccaacccaaatgtctaacaatgattgactggattgagaaaatgtggcacatatacaccatggaatactatgcagccacgaaaaatgatgagttcatgtcctttgtagggacatggatgaagctggaaaccatcattctcagccaactattgcaaggacaaaaaaccaaacacagcatgttctcactcattggtgggaattgaacaatgagaacacttggacacaggaaggggaacatcacacaccagggcctgctgtggggtcaggggaggggggagagatagcgatatgagatataactaatgttaaatgaagagttaatgtgtgcagcacaccaacatggcacatgtatacgtatgtaacaaacctgcccgttgtgcacatgtaccctaaaacttaaagtacaataaagaaaaaaaaaattccatagtggcgatatagaacagtttgtttaaccattcagtcattggaggatatctgggttgtttctagttctaggctattacaaataaaggtgctctgaacatttctgttaaaaaaaaaaaaaagttaagacgctacgtgttgcttaggtctgctttgttgaagcctgtctctttcagagttcctaaacacaatattcccatggcatctaatcctagtgagtgctccaaatccaggctgtgtatcagatgccacgggaaattctgcctcaggactgagtttggttcaagcatctggatgttgtcaaaagtccacgttgtgtgctggcctaatctgaaagaccctaactagttctagcctttaaatgccttctgtcatcaaatctagagttacatggcatttgtacaagctaggtagctgaggcacggaatcagccctataaaggagcttttggtgcttttgttgtaggtctagctccaacttggcactccagttcccatagctagactttctctcatcgtgtgttctgatccttggattaggaacaaagtaactactctgatacaaagcagtggtttcggttcccaactagtgactattttgcctcccaggggacatttttggttttcacaactgggatacggtgttagagggtagaggctagggatgctgcgaagcatgtggcagaatcctcttccgccccgaatgctaatagtgccaacgttgtggaggcttcccacccaagggcttggtctattccttgcttttgccagctccctaaaccttaaacacatttcaaatttatatgcataagcatctcctagggacctgcccgtttccaatatcgactactgagacccatccgtagagatgcaggcttaggaggtctaggattgggctgaaaatttgcattttaacaagtactccaggtcattctgaagcaagtgatacaaaccacacactgaggaacacgccttcaagagactgaatcttgcttcccaacactagcttgctatctgagaccatctgcctgctgctggctttcctggcacaaacattctgcatgtaggcacagtgtgctcctggactccatgtcacctcgttcaccctcatgttccctcggttcctgtccccagtccagcaagcagaactgattacagatcttaacagaagatacagattgaaaataacttgcctgttcccgtggactttatccactagtcaaggaggacaagtggacaaggggagagggtaggtgggggctccttccctgttcctcccattccactttatacaaaccccagctagaccactgggagagcaacagaggttaagaatgactgcatctaaatatttaatttggcccactcttcttctgtcttgaacacaagggtatcatgagttttgtttaaagcactactgaaaccaagataaattctggcttagcatgcccctgacagatcaatctagtaatcttatcaaaaagattgagaaatcggatggttgctgtgtctgggtagaaagaagtagacatgggagacttttcattttgttctgcactaagaaaaattcttctgccttgggatcctgttgatctgtgaccttacccccaaccccttgctctctgaaacatgtgctgtgtccactcagggttgaatggattaagggcggtgcaagatgtgctttgttaaacagatgcttgaaggcagcatgctcgttaagagtcatcaccactccctactctcaagtacccagggacgcaaacactgcggaaggccgcagggtcctctgcctaggaaaaccagagacctttgttcacttgtttatctgctgaccttccctccactattgtcctgtgacccggccaaatccccctctgcgagaaacacccaagaatgatcaataaaaaaaaaaaaaaaaccaagattacctaaaagcactaaccaaaggaaaactccctcacctcaacccgtgactgctcacatttttcagattgaataatttcaattgtattttaaggttgactctttaccacctccaagctgctcctgaacacaactattattttttaattttgaaaaatttttcacttctagaatttccacttgaggctttgttattactgtagtttcttcttctctgctgtgattttctatccatttattataagagtttttggggttttgattttagtaagaattataataactactttaaaaaatccatactaattccaacatctcggtcgtctcgaggtcagtctcgattgattgcctttttctttgaatatgtttcttggtatgtttgatataatgggattgaatcctgaagattgtaaaaactggatattttttgttcctctgaaaattgataattttttgtatttttttttctattgtatactttacattttcctccaagggttttaacatttctagttctcaaaacatttacatttatgttaaaaattatacaaagtagcttggtacagtggctcccatctgtaatcccagcactttgagaggccaaggcaggagggtcactcgagtccaggacttggaaaccagcctagacaacaggacaagaccttgtctccacaaaaaattattagggtgatacaaaaagtaattgcaggttttgccattactttcaatggcaaaacccacaattcctcttgcaccaacctgataaaaaataagctgggtatggtggtggtatgtgccggtggtctcagctatttgggaagtgaaggcagaggtgggaggattgcttgagcccaggagttccagaccaccctgagaccctgtctctacggggaaaaaaaaaaaaaaaaaaaaaaattagctgggcccacgtacctgtggtactagctacttgggaggcaaaggcagaggtgccagaatcacttgagcccagaagctcaaggctgcagggcactgtgattgtgccactgcactccagcctaagtgatggagcatgaccctgactccagataataataataattacaaaaaggaaagacctagaacaccaggttaaagtattctaaaatttagctgacttactctgctctctataaaacagggttgccacagaaaatatagcatgcccagttaattttaaatttcagataaacaaatacttttttcagtgtaagtataccccatgcaatatttgggatatgcttatactaaaacttattctttgtttatctgaaattgaaatttaactgggtattacataattatagcagcctgaccataaaagatatgtaggctgagcaaaattctactttaaacttcaagctttataataaatgcattattaatcaacaactattatttactgagacctgtgtagatccccatatttatttttaaatgtggaactaggaaatctatataaagaacatttatagaaatgaatgactgttctatagagctgaaaggaaaactctagcttttatttttctccccaaacttaagctttattttacatttgtataaacaataaaattaccactcaactttggaagcacagatcataatatgaaaataaagcaaagatcccagaaacatttaacaggcaacaaatctttgacatcatcttactatagcaactaaacgtataataatttagaacgatccattaattataagaataaattcttttacaaagcataactattaatattatttgaccatcataagaacaaacattttaactaaaacaccatgaatactttacagaaaggggcgagttgcagacacagtccttcttggatttcttttaacaccaggctttcttcccttttgacctgagctgggagttgaatatttcctctctttgccctctgaccctctagtctctgaagcatcttttgtactagaggtgtgtgcagagacttcctggaaatttggatctgtaaattgtgctgttgtatcttctaagcactgcagtgatctggatatagagctgttgctcttgcttgtataagtgtaatattctgattcaaaaaaggaagtgaaaggaagggagttgattacatttggctacagaaaaaaaaagatgacactaataataaaaataaataataattgtacttgtaatataaacatctgaaagttttagttctaagaatggcagtccacataagaaaattaggtaaaaataattaatatctattataattatttttctttaaccaaagaaaaagtataatttaaagatggctgtttaagcatcaaattgcagccattggtaaaagtagatattagtcatatttattaagtgacacacagtgatactgaaggcacttgtttctcagcaacatcattttttccccaataagaacgtactgcatcctagacgtgaaatgaaaataagctttaattttcaccacaggagggcgacaaccagagaactgagggggtacagatccattagaggaccatatccatgagcttaaaatgctctactgtaagagcaagaatttttaaagaatctcggtgaaggctccttttcaaaaaagcacaaagattaaagcctttgaaatgtaaattattttttgcagttattacattgaggacaaagttatagtcgcaaagttaagatttttataactatccctaaaattgatcctcagtgactccttgatctacatatgttaaggaaaaaggcaagacacagatatgtttaaatagtttccaattttcagtaatcagcttcaatataaggtatacccaaataatggtgaattaaatgaccatgaaagcacgttatagcagatgcccgctcatcaatatgccttgaaattaaaggtttataaggtgcataagggcaaaggttttgatgttgccattacattcgcaaaagtatgtgaggcacgtacagcatgaagttcactaagtgcttgcaacataaccagcactaaattttgttgaataaataaatgaatacttttgtatagcatctgttcaaaatctgatgtaaaaatgaaaataatctgaaaatatgcaaaactgaaatttcccacagacggctgccaattcatacaaaccataagatgaatttcaaaatgagaacgtgacaataaaatcaagtttcaaaatggctggccttttttttttttagcaaaacccatgttcaaaaaaaggaataagacatcaaatgttttgagaaccaaaattttactgctgcttttctaacaccctgttgctaacctgagcccccatcctcttactgtcaataacagattttcatcatcaaacacaagaaacacgctgggcacagtggctcacacctgtaatcccagcactttgggagactgaggcgggtggatcacttgaggtcaggagtttgagaccagcctggccgacagggtgaaacctcatctctactgaaaatacaaaaattagctgggtgtggtggtgggcgcctgtaatcccagctactcgggaggctgaggcaggagaatcgcttgaacctgggaggtggaggttgcagtgaactgagatcgagccactgtactccagcctgggtgacagagcaagactctgccttaaaaaaaaaagataaaaatacaataaacatctcataaaaacaaaataat

SEQ ID NO: 350 - DNA, 174311 bp, Homo sapiens
cttccctctttcttagaaatctcttgcaatgcatctgattgtcaaaatgcgaatcacagctgaagccctagctgcaaagaaaactgcaatgtaggaaagtacacaggaggagggtagagtggatgttgagtcccagtgttccatatccagccgtccatgttttatatatatatacacacacatacatatatatatatatatacaaatatatattataatgcatttttacataaaatataaaattataaaacaatgtataaaatatataaatataaaattctaataatatattttaaatttaaatatatgaagatatttttacatgtacaattattatgcattatatgttatatatatacacatatttttttttttgagagacaaggtctcactctgtcacccaggctgtagtactgtaatgtggtcatagctcactgcagccttgaactcctgggctcaagcaatcctctcatcttggcctcccaaagtgctgagattgcaggtgtgagccaccatgtcaggtctatatttattttttatatgtaaatgtaatgtatttagacatatatcatctttactgagatataattcacatctcatacaatttacccatttaaagtatacaatcaatggtttttagtgtattgacagaattgtgcaaccatcatcatgatcaatcttagaacatttttatcaccccaaaaagaaatcctggaggtggagcaagatggccagatagaagcctccaccaattgtcctccctcctgctgccttctggacagcaggcgactccaattcaaccagtcaaaaatgatataggttctgctatatcattttgagttctggtttctacctccacggctactgaactccactccatctgcaatgaccttgttgctctgtcctcatgctcttgacaggaggtggtgcaagatggccgaatagaagcctcaactgtctacacacaaaaaagcaccattgtaagaaccaaaaatcaggtgagtgatcacagaacttggttttaactttatatcgctgaaagaggcactgcagagggtaggaaagacagtctcaagttgttgccatcccttccccatccctggcagtggtcatgtggtacagagaatttgtgcatttcagagagggagagtagagtgattgtgggactttgcatcggaactcggtgctgccttatcacagcagaaagcaacactgggcagaactcagccaacgcccacagaggagcatttagaccacccctagccaaaggggaatcatccatcctggcggctggaagctgagttctggcgagcctcaccactgcaggctgaagtgctctggggtcccaaataaacttgaaagtcagtctaggccacaaggactgcaactcctaggcaagttctggtgctatgctaggctcagagtcagtgtcttactagggcatgaaccttgtgagataccagccagggtggccaagggagtgcttgtgctactcttcctccaaccccaggcagtgcagctcataactccaagagagactccttccttctgtttgagaagaggagaaagaagagtaaagagggctttgtcttgaataccagctcagctacagtaggatagggcactgggcagagtcctgaggcctgatgccaggccctaggtcctggatgacatttctagacatgccttgggccagaagagaacccactgcctcgaagggaaggacccaatcctggcagaattcgtcatctgctgactaaagagcacttgagccctgaataattaacagtggtagccaggtagtacacaccatgggccttggatgagactgtaagatgtgctggcttctggtgtgacacagcacattaccagctatagtggctatggagagagatcccttctgcttttctaaagcagagtaaaatggactttgtcttacagcataggtaccacctcagccatggtagagtagagcaccaagcaggcacttatggttcctgatcccaggctacgcccttagatggcatttctggacctgccctgggccagaagggagcccaccgccctgaagagtgagacccaggcctggtagcattcaccacaagcaggctgaagagcccttgggccttgagtgaacattggtggtatcctagcagtaccccacctttgaccctgtgggcctgtggtggtggtggccatggggagagactcctctgcttgtggaaagggaaagaaagagtggggaagattttgacatggggcttgggtgtcagttcagcagcagtacaacaccaggcaaattcctaaaatttctgactccaggtactggcttctagatagcatctctggacctccccagggctgggagaacttgctgtcctgaaaggaaagacatgagtctggctagctttactacttactaattgcacggctctagggccttgagcgaacataggtggtatccagatagtggtcacagtgggccttgacgagacccagggctaggctggcttcaggtctaaccaagtgcaattccagtggcggagacaacagaggtgcttgtgtcactcctgccccagctgcaggcagatcagcaaagagagataagctctttatttgggaaaaagtaagggaagagagcaagagcctctgcctagtaacccagagaattctttcagatctcatcaaagaccacaaggcagatcaattctgctattaagagagtctgatgctttcttgagtatgacagatacatttttcaactccagaatttctgcttgattctttttaattgtttaaatctctttgttagatgtatctgataaaattctaaattccttctttgtgttatcttaaatttcattgagtttcctcaaaacagctattttggggcacatgttctcaggacctcctgaaggctgtgtcatggaaaaaaaaaccccagctattttgaattatctgtctgaaaggtcacatatttctgtatctctgggattggcccctggttccttatttagttcatttggtgaggtcacattttcccagatgttcttgatgcttataaacgttcattggtgtctcggcattgaagaattaggtatttattgtagcctttgcagtcagagcttgtttgtacccatacttcttgggtaggctttccaagaatttggagggacttgggttttctgatctaaaattttggtcaccgcaactgtatctgcacttgaggcatcccaagcccagtaacactgtggcttttgcaggattggccaagcagaagaaaaaatcagtgagtttgaagacaggctatctgaaaattcatagttgaaggagtcaacagacaaaagaatgaagcacacctacaagaattagaaaataggctcaaaagggcaaatctatgagttattggtgttaaagaggaggtagaggtagaaagtttattcaaaaggataataacagagaacttcccaaacatagagaaagatatcaatattcaagtacagtaaggttatagaaaaaccaagcagatttaacccacaaaaaagactacctctaggcatttaatagtcaaactcccaaaggtcaagggtaaagaaaggatcctaaaaacagcaagagaaaaaacacaaataacatacaatggagccgcaatacatctggcagcagacttttcagtgggaaccttgcagaccagaagagagtggcatagcatatttaatgtgctgaaggaaaaaacttttaccctagaatagtatatctagtgaacatatccttcaagcatgaaagacaaatggagactttcccagacaaataaaaacagagagatttcattaacatcagagctgtctgaaggaaataaatgctaaagagagttcttcaatccgaaagaaaaggacgttaatgagccataagaaatcatctgaaagtacagaactcactggtaacattaaatacacagaaaaacacagaatattataacactgtaattgtggtgttgaaactattcatatcttaagtagaaagactaaaagatgaactaatcaaaaataataactacaacaactctttaaagacatagtagaataagatataaatagaagcaacaaaaagttaaatagtggaggatgaagttaaagtgtagagtttttattagttttctctttgcttgcttgtttgtttatgcaatcagcattaatttgacatcagtttaaaataatgggttataatgtattatttgcaagcctcatggtaacttcaaaccaaaaaccaacagatacacaaaaattaaaaatgagaaactaaaacataccaccagagaaaatgaccttcaccaaaaagaacacaggaaggaagaaaagaccacaaagcaaccagaaaacaaataacaacatggcaggagtaagtccttacttatcaataataacgttgaatgtaaatggacggaactctccaatcaaaagacgtagagtggctgaatgggtgaaaaaacaagacccaataatttgttgcccacaagaaacacacttcacctaaaaagacacacatagactgaaaataaaggggtggaaaaagatattccttaccaatggaaaccaaaaaagagaaggagtagctataactatatcaaaattatattttaagacaaaagctgtaaaaagagacaaagaaggccattacataacaataaagaggttaattcagcaagaaaatataatgattataaaaatatatgcacccaacactggagcacccagatgtataaagaaggtattattagaactaaagagagagatagactcaataaaataactactggatacttcagtaccctacttccagcagcggacagatcatccaaacagaaaatcaataaaaaaaaattggacttaatctgcactatagaccaaatggacctaacagatatttatagaatatttcatccaatggctacagaatatgtattcttctccttggcactgttctcaaggagagatatgttagcctacaaaaaaagctttaaaacactccaaaggattgaaataatatgaagtatcttctccgaccacaataaaatataactagaaatcaataacaagagaaattttggaaattataaaaacacatggaaattaaacaatatgcttctgaatgacctgtgtaccaattaagagattaagaagaaaattgaaaaatttcttgaaaaaataacaggaacaatatgccaaaacctgtgggatacagtgaaagcagtactaggaggaaagtgtgtagctataataagcacttacgtcaaaaaagtagaaaaacttcaaataaacaatctaatgacacctcttaaaaaactagaaaagcaagagcaaaccaaatcctaaatttgtagaaaaaagaaataataaacatcggagcagaaataactgaagttgaaatgaagaaaacactacagaagatcaatgaaatgaaaagttggtttttttgaaaagataaacaaagttgacaaagcttcagccacactaactgagaaaaaaaaatacagaagacccaaatgaataaaatcagagataataaaaggagtcaccaaaaccaatgctgcagaaatccaaaggatcattagtggctataatgagaaattgtatgccaacaaattggaaaatcaattaatagaagaaactgataaaagagcatggtggtgcaggatatggggtcagtataaataccaacgcatagtccctttgcaagagtgagggcccaagttaaggtaatgagttcggcttgctgagaggtagtggagatggggcacagcggtagcctcaatgatagatgtggaagatactatagcatagcctgcctttgctggtgtttggcgattaggcctggtggaactgccatcaataaaccaagtgtgatcagggtgaggaacaggaaagaaggaaacatggggaaatgaagtgaatgccaagtgtatcagagagatacagtcatgggggccaggtgtggtatcaggaataatgtgggaggccggattgaagtccaggccaggaacaatggtaattgtgggagactcaacaaagagtgagtacagctgaaggagccagggagcagaaagtgtatgtgtcaggtgtgaggaagaaaatagattttggaagttatgagaactgtatagagtgagttgagcaaagtttgtgattttgagggcctctggaagtattagggcagcagcagccaccgcatgcagacatgagggctaggctaaaacagtaaggtcaagttgtttggacagaaaggctacagggtgcggtcctggcttttgtgtaagaactccgattgcacagccctgcactttggctgtgtgtaatgaaaaaggtttggaatgagttagggagagctagtgtgggggcagcttctagggctgtttttaaggaacggaaaggagtggcaaagggatttaggatctatggggtcagctgggtttggttttgtgagtttacataatggtttagtcaggatggtaaagctaggtatccaaaggcggaagtacctaaccatgcgtaggaaggagaggagttgttttgtagaagggattggggtttggggaattagctggacatgatcagcaggcagagcatgtgtgttttcgtgaacaattatgctgagataggtaacagatgaggaagaaatttgggcttaactgaagtcatgggggctgtccgtgaagccttgcagcagtacagcctaggtaatttgttgagcctgatgggtgtcagggtcagtccaagtgaaagcgaagagaggctgggatgaagggtgcaaaggaatagtaaagaaagcatgtttgagatccagaacagaataatgggttatggaggggttgtggagggaggtattgaggataggagagtatatggctttggcatcacggggtggataggccagacaatttggttggtaaggccagatcctgaactaacctgtaaggcttgtccagtttttggacaggtaaaacaggggaattgtaaggagagtttacaggctttaaaagcccaagctgtaacaggcgagtgataacaggctttaatccttttaaagcatgctgtgggatgggatattggcattgagcagggtaagggtgattaggttttaatgggatggtaagaggtgcatgatcagtcgccaaggagggggtagaggtgtcctatacttgtggattaaggtgggggtatatgagaggaggatgcgaaggaggctttgaactggggaaaaagcagcaatgaggtgtggctgtagcccaggaatagtcaggaaagtagataatttagttaaaatgtctcgacctaataagggagctctaggcaggtggggataactaaaaaagagtgcataaaagaatgtccatgttggcaccagagttggggagttttaagaggtttagaagcctggccgtcaatacccacaacagttatggaggcaagggaaatacacccttgaaaagaaggtaatgtggagtgggtagcctccgtattgcttaagaaggggacggacttaccctccactgtaagagttacccaaagcatccgcgatggtccaggaggcttctgaggcgatcgggcagtgtcagtcttcagctgctaagccgagaagatatgggaaggagtcagtcagagcctcgggccagttggacagtccagtttccagtggggactcacatagatgggacacagcttaggaggaatcccaggctgcgggcattccttggcccagtggccagatttctggcacttgtagcaagctcctgagggaggaggttctagaggaacccctggcagctgcggttcaggtgtttggagttcttgtgtgctggagatgtggctggggtttgtctcacagcggaggcaaggaattgcaactcagaaatacattgctacttggctgcctctactctattattgtacacctaattaagtcctgttgtggggtttgagggctggaatttaatttttggagctttatttaatgttgggaacagattgggtaataaaataaaatgcatattgagaataagacagccttctgacctttcaggatctggggctgtaaagagtctaagggttgctcctaagcaggccatgaactgggctgggttttcgtctttaccttgagtagttcctttaagtttgtcttaattaacagctttgtaagctgcctttttaagcccttcaactaggcaggaaaccatgtaatctcgcctagctatacctggggaatttgcctgatagttccattgggatcttctcggggaactgctctaatgccttcatggaggtctggctcatgaagctggcagttatcagtgtgaaattgggctagagaaaaaactctttcccgttcatttggggagagggtagaagttaggatgacatttaagtcattccaggttaaactgtaagacagatttagatatcggaattccagtatatatttagtggggtctgatgagaaagagcctaaacgctggctgatttgggaaaggtctgatcgagaaaaaggcacatgtaccctgactatgccttcagctccagccacctctctaagaggaaattgttgggcaggtggggagggctagtcgtgggaacaaaattggaagccagaccggtgtgaggaggggaggtgattgaaggattttagggttggggagcagaggctgaggaagaattgggacctggcttggcctggcaaggagcagcctggggagaaggggagaggtcagatgagtccatagaaaagaaggattcaaaggactcatatcttggggtggagactgaaggaacagacaggagagaaagaagaaagatttgggacaagtctcattgggagcagagactagggagggaccgatgtgtaaaagaatgcctggacgtcaggcacctcacaccttttgcccatttttgacgaaaattatctagatcttgtaaaatggagaaatcaaaagtgccgatttctggctatttagaaccattattgagtttgtattggggtcaagcggtattgcagaagaaaataagacacttagattttaggtcaggcaagagttgaagaggttttaagttcttgagaacacaggctaagggagaagaaggaggaatggagggtggaagtttgcccatagtgaaggaggcaagtgtaaagagaagggtagagacacagagaaggcgggtggggagcagccctgggctgcaacgtgggtgagcagccaaagcaggcgtccccgcaattgacttgccaccaagggaatgtgggtgaatgaccaaggcaggtgtccctgcggagatcagacaccaatggaatgtgggtgaataatcagagaggcgtccccgcaatgattaaacaccaggggaaggctgccttcccgagtccgtgaccagcgccggagttttggttccacagataaaatgtgtctcctttgtctctaccagaaaatgaaaggaattgaaattaagagaagggagagattgaagcatggcaccaagattgaaaggagaaagaggttgagggatagtgagagaggttggagaagagagtaaaaagaggccacttacccgatttaaaatcggcgagatgttccttgggctggttggtctgaggacttgaggtcataggtggatctcttcacggagtgagggtgaagacaggggactggtctcctgaaggagtcccactgacccggatcttcggcaccaaatgtttcacgtgtccatgtgaagagaggaccaaacgggctttgtgtgagcagcaaggctgtttatttcacctgggtgcaggcagactgagtccaaaaaaggagtcagcaaaggatggtgggattatcattagttcttatgggttctgggataggcagtggagttaagagcaatattttggggacagggcgcggatctcacaaagtacattctcaagggtggggggaattacaaagaaacttcttaagggtgggggagattataaagtacattgatcagttaggttggggcagaaataaatcacaatggtggaatgtcatcagttaaggctattttcactttttttgtggatcttcagttgcttcaggccatctggatgtatatgtgcaggtcactggggatatgatggcttagcttgggctcagaggcctgacatgcaccaacagtgaccaagctgagagtcaaataaagaactcaaccccttttacaatagctgcaaaaaaataaaatacttaggaatatacctaaccaaggaggtgaaagacctctacaaggaaaactacaaaacactgctgaaacaaatcatagacaacacaaatgaatggaaacttgtctcatgctcatggatgggtagaatcaatattgcaaacatgactgtactgccaaaagcaatctacaaattcaatgcaattctcatcaaaataccaccataattcttcacagaactagaaaaaacaattataaaattcacatggaaccaaaaaagagcccacatagccaaagcaagactaaataaagataacaaatctggacgcattacattacctgatttcaaactacactataaggccataatcatccaaacagcatgatactggtataaatataggcacatagaccaatggaatagaatagagaacacagaaataaactcaaatactcacagccaactgatcttcgacaaagcaaacaaaaacataaagtggagaaaggacacccttttcaacaaatagtgctgggataattggcgagccagatgtaggagaataaaactggatcttcatctcaccttacacaaaaatcgactgaagataggctgggcacagtggctcatacctgtaatcccagcactttgggaggccgaggcgggtggatcacgagctcaggagatcgagaccatcctggctaacatggtgaaaccccattttgtattctctatctgggtggcaatcatggtcattgtggtagccttaaactcctgctgtccctgcccccttctaccacttgagagggttgagatgggcccaagagagcactaaggaaagatgtatagcagcactaaacagattatccaatgatggaaatttaatcattctacccatctcgcctcatcccacttgttctccagagacaaatacttgcagtgtagcaggatgagccgcagacaaaactcctcagacaccaagttaaagaaggaaggagtttattcggctaggagcatcagcaagactcctgtctcaagagctgagctccctgagtgagcaattcctgtcccttttaagggctcacagctctaagggggtccgtgtgagagggtcgtgatcaattgagcaagcagggggtatgtgactgggggctgcacacaccagtaatcagaacaaaacagaacaggacagggattttttacaatgcctggaatctatagataacataaacggttaggttagggatcgatctttaactaccaggcctagggtgtggtgccgggctgtctccctggagatttcatttctgccttttagtttttacttcttctttctttggaggcagaaattgggcctaagacaatatgagggatggtctcctcccttagcagcagtgcttccaacattttttccagtattaacctccatatttctaagtaaaataaactcctacttattttatgatttctcaattttaataatcatttgctgacttcatatcataaaagttgaatattcagctcattatttctcattttcctcatctcttctcgatagagactataataattttggttaaattgggattcagattattagaaccatgaaatgttgaaccaagtactataattaagtttcatttcttttgtaccttttttatttttctgagagatagtacttgttttccattgctccatttgttaaagtacttaccacttagtcttaatctttctgcattctcaaatagtctctcgacacaattttccacatagtcaaacacctaacatatcagttcccctttctaattaaaaataaacaattcccttcattctgctctaatctgaaccaataactccctagacttgttcacacagctctcatctgggacttttcttggctacatcctgaaaattccctttgcgtctctcctctgttcaatcccctaacttctggaccctgggtcagacaccttcctgatagagtatatcctgcatcagcttcccagaaaaagagtttatgaggtcagtgtgagtggcctgatagtttgggtaggtctataattctaggttgaaaatcatttttcactcagaattttgaaggcattgtggtgttatcttctagtgccagtgtggctattgatacctcctggtctttatatgtgatcggatttttctctctggaagttttggaagcttttcaaaaatcattggttttctggaattagtgccttgatattggtctttgcatgttccttctgctgagagctgggtaggccctttcaacctgtagttctttcagttttgagaatttttcttgaattatttctgcattttccctctccagttcatccttttccaaaacatctaaggattagatcttggacctcctggactggtattatatctttcttttctctctcattaccatctttttgactttttgttttgagtgatttcctcaactttattttctactgctcccactggatttttttttattttagtgatactattttaatttccaaatgttctttcttattgtttcttttgtacaatgtcttgttttctttcattgatgcaataccttctttctctgaggattactgtatgtggctattagggttgagattttttccctgtaagttttcttctctatatctattttctctgaaatgcttttttggggggatatttttctgtttgtttttctagttctgactagagacccttctcaaatgtgcaatgatctttggctgttactggtttttaagagcaaggcaccaaagaacagtccaagggtgggatttattagcttactatagaggattgggtaattgacttccttcactcatctaactgactcccagatgtcagtatctgcaggtctgttctcttgggccactcagagaaagatcttacaaatgcttgcctggttaatataaacctgagaaatgcatggggatgaggagctgcagacctcactgttcaatatgtagactttcacttaacctccatgtttgcatccagccttgcacagtacatggtgttctgagtccagggattttctggttcaccttcttcaaaaatgaactcactagtattggaatagtgaacctgaggtctaactaatatatttgcagatttttctaccagtcacgcagttttcagctctactctcacacctagtgtccatggaaatcggtggccccaatttctaagctttccaaagttttgtggggcaaaatcctttctctctaactgccaacttgacatctctactttgatatccaataggctagctaatttaacatatccaaagctgtctcctgatattccccaagtgggttcatggcatattttttttccagttgctcaggccaaaaaccttggagacatctttgcttcttctctcacatcccacatctagtctctcagcaaaccctgttggcttgctttcaagatatactgagaacctgatcttttgtcatctccattgttaccaccttagtgaaagccatccgtatctctcacctctattgttgtagtgatcttcaaactctatccatgcttctggtctcactcataagtggaaattgaacaatgagaacacatggacacagggaggggaacatcacatattgggcctgttggagggtggggggcaaggggaaggagagcattaggacaagtacctaatgcatgtggggcttaaaacctagatgacgggttggtaggtgcagcaaaccaccatggcacatgtatacgtatgtaatatacctgcacgttctgcacatgtatcccagaacttaaagtaaaattaaacaataacaataataataacaaaactctagctatgcttcttttcttgccccctaagtctattctcagtacggcagccacagtgatccacttaaaatgtaagtcagaacatgtcaggtctctgctcaaatcctccaatggtttcccagcttacacagagtaaaagccaaagcccttactataatctgcagggtcctacataaccttctctcacctgttgtctttctcattcatatctcattcctacccaccatgctgactccactgcttccacactggtctccttgctgtttaaggaactaatcgtgcgtgctcccactacagaagccagctacattagccattcactgggaagtctcctacccaggaatccgtgtgaacagtttcttcacttctttcaggtcttttctcaaaagacaccttctcagtaaagcctttccaaagcaaccaatctaacatttctgcccaattccatcatattctgtattctgcgtccatgctttagtttttcttcataatactatatatttgatttgctttttatctatgtttcttaactagaatatagctccacgaggaaaaacatttttgcctattttgtttactgctatatccctggtgaactatatgccaacagcaaacaatctgacaaagaaatcaagaaagtaatcctgtttacaatagctacaaataaaattaaatacctaggaattaaccaaacaagtgaaagatatttacaatgaaaactataaaacattgatgcaggaaatcaaagaggacaccaaaaatggaaaaatatttcatgttcatggattgaaagaatcaatattgttaaacagtccatactacccaaagtatctaccaattcagagcaatccttatcaaaataccaatgacattcttcacagaattagaacaaacaatcttaaatttatatatatggaactacaaaagacccagaatagccaaagctacctgagaagaaagaataaaactggaagaatcacattacctgacttccaattatactacagagctatcatcaccaaaacagcatgatactggcataaaaacagacacgtagacctatggaacagaatacagaacctagaaacaaatccacatacccacagtgaactcattttcaacaaagatgccaagaacacactttgggaaaaggacagtctcttcaataaatggtcctgggaaaactggatatccatatacagaagaatgaaactagatcactatctcttgccatatatgaaaatcaaatcaaaatgaactaaagacttcaatctaagacctcaaactatgaaactactacaagaaaacattgaggaaactctccaggacattggactgggtaaagatttcttgagccatacccctcaagcacagacaacctaagcaaacacagacagatgggattacatcaagttaaaaagctcgtccacagcaaaggaaacaatgaacaaagtgaaaagacaacccacaaaaagaatgggagaaaatatttgaaaactacccatctgacaagggattaattaccagaatatttaagaagctcaactaactctataagaaaaaatctagtaatccaatttcaacgtaggcaaaagatttgagtagaaatttctcaaaaagaagacatacgaattgcaaacaggcatatgaaaaagtgctcaacatcattgatcatcagagaaatgcaaatcaaaactacaatgagatattatctcacctcagttaaaatagcttttatccaaaacacaggcaataacaaatgctggcaaggatgtggagaaaaggggaccttcgtactattgatgggaatgtaaattagtacaactactcttgtactaatagtggagaacagtttggaggctcctcagaaaactaaaaatagagttaccatatgatccagcaatcccactgctaggtatatacccaaaagaaaggcagtcagggagaaggctggtcaagatggctgactagaagcagctagtatgcgccactctcatggagagaaatagaaacggcgagtaaatacagcaccttcaactgagtcatccaggtataagcactgggatttatcaggaaaacaacttaacccacagagaatggagaaaagcaaagtaggacattagcctgcccaggagtgacacagagctaggggagcctccgtgagtgagtgaacaaccccagagacccatgtgtccccgatatatttttgcaaccctcaggtcaggagatcctgttatgaacccactccagcatggtctgcattctgacacgcagagctacgtggaattttggcatagaagccactcaggcatacatggatccccaggagctttagataactggacttcctggcaaacgcagctgtaactctagcaaagtgggaagttctacccctagaaaaggagctgaatccagggggctgagcagtgaccatctgtaggccctgcttccatggcaccttgcaggataatgcccactggcttggaactccatccagccactggtagcagcgttatacctccctggaacagagctcccaggaggagggacaggccaccatctttgcttttttcacagccttaggcattattgccttcaggatctagagagtctgaggttactagggactggaggcaatcccattcacaactgccacaaagagaataaaatacctaggaatacagctaaccagggaggtaaaacacctctacaatgagaattacaacacactgctgaaagaaaccagagatgacacaaatggaaagacattccatgctcatggataggaagaatgaatatcattaaaatggccatactgccaaagcaatgtacagattcaatgctatttttatcaaactaccaatgatattcttcacagaactagaaaaaactatcttaaaattcatatggaaccacaaaagagtccaaatagccaaaacaattctaagcaaaaagaacaaagcatgaggcatcccattaccttacctcaaactatactacagggctacattaaccaaaatagcatagtactggtgcaaaagcagacacatagaacacagtagagagcttataaataaatctgcacacctacaaccacctgatctttgacaaaactgacaaaaataagcaatggggaaaggacttcctactcaataaatggtgctgggataaccagctagccatatgcagaatattgaaactcaaccccttccttacaccgtatgcaaaaatcaactcaagatggattaaagacttaaaggtaaaacccaaaactgaaaatcctgaaagacaacctaggcaataccattctggacataggaaatggcaaagatttcatgatgaagatgccaaaaacaatcataacaaaagcaaaaattgacaaatgggatctaattaaattaaagaatgtctattactcaacagagtaaacaacctacataataggagaaaatatttgcaaactgcatctgacaaaggtctaatatccagcatctataaggaatttaaacaaatttacaagaaaaaacaaccccattaaaaagtgggcaaaggatatgaacagacatttttctttttttttttctttttctttctttctttttttttttttttttttgaggtggagtctttctctgtcgcccaggctggagtgcagtggtgcgatcttggatcactgcaacctctgcctcttgcgttcaagcgattctcctgcctcagcctcccatgtagctgggattacaggcatgcgccaccacacccagctaatttttgtatttttagtagagacagggtttcaccatgttggtcagggtggtctcgaactcctgacctcaggtgatctgcccgccttggcctcccaaagtgctgggatgacaggcgtgagccaccattcctggccaaacagatacttttcaaaagaagacatacgtgtgtccaacaagcctacaacaaaaagctaaatatcattgatcattagagaaatgcaaatgaaaaccacaatgagatatcgcctcacaccagtcagaatggctatcgctaaaaagtcaaaaaataacagatgctggtgaggttgcaaaaaaaaagggactgcttatacactgttggtagaaatgtaaatttgttcaactaccgtggaaagcactgtggctattcctcaaagagctcaaaacagaactcgcttttgacccagcaatctcattactgagtatatacccaaaggaatataagttgttctaccataaacatacatgcagacttatgttcattgtagcactattcacaatagcaaagacatagaatcaacctaaatacccgtcagtggcagattggataaagcaaacgtggtacagaaacaacacagaatactatgcaaccattaaaaagaatcagatcatgtcctttgcaggaaaatgcacagagctggaagccattatccttagcagactaacacaaaaatggagaaccaaatacctcatgttctcacttataagtgggagctaaatgataagaacacatggacacaaagagggaaacaacagacatgggagcctacttgaggctgaaagttgggaggagggagaagatcagaaaaaataaccattgggtactaggcttagtacctgggtgatgaaataatctgcaccacaaacccctgtgacacaatttacctataaaacaaacctgcacatgtacccctgaacctagatacattttttttaaaaaagaaaggaaatcagtatatcaaagacatatccacactcctatgtttattgtagcactattcacaatagccaagatttgaaagcaacctaagtgaccatcaacagatgaataggtaaagaaaatttgatagatatacacaatggggtactattcagccatgaaaaagagttatatcctgtcatttgcaacaacatggatggaactgatagtcactatgttatgtgcaatataccaagcacagaaagacaaggttcacatgttctcacttatttgtgggagcttaaaatgaaaacaattaaacttatagagacagagagtagaaggatggttaccagaggctgggaagggtagtagtgggtggggagaagttggagatggttaatggctacaaaaattagttagaaagaatgaataagatctagtatttgacagtacaaagggtaactacagtccatcataatttagttgtacatttaaaaataactaagagcagccgggcgcggtggctcacgcctgtaatcccagcactttgggaggccgaggtgggcggatcacgaggtcagcagatcgagaccatcctggctaacacggtgaagccctgtctctaccaaaaatacagaaataaattagccaggcgtggtggcgggcgcctgtagtcccagcacttgggaggctgaggcaggagaatggtgtgaatccgggaggcagagcttgcagtaagccaagatcgcaccactgcactccagcccaggtgacagagtgagactccatctgaaaataaataaataaataaataaataaataaataaataaataagagtataattgggttgtttgtaaaagaaagtataaacacttgaggtgatggatacccaatcccaatgtgaatattatgccttgcatgtctatatcgaaatatctcatgtatttcataaatatatacacctactatatacccacaaaaattaaaaattaaaaaaatttctcatctccaagttactccccaactcattgcaatcataccgatattcccataaataataactataaattctggacaaggtaccacaataaacaacctgaatgcactggaggataaaaaaatacagattctggagggagtcaacacttaagggaactgcactacccaacgcttgtgaaaatcccaacattagttgacacgtggaagcaggaaactgtattgagtgagtttctattttcacagcttctagtataagggcagagcacctaggctatctaaagctctaatagggaagtcactgtctttctgtcctaaagaacctgaggacaaccgcagcagctggaaagtaatggtgaaatctcagaaaggagagtgcagagaggggaagccttaaattctgcgaataaactctgcccaaatccctggatgacccctgaattacatacacaggagagaagttctaagtaacctagttaaaaatctaaactgagtttgaggagatgaatatctcaattatactgatttaattattacacattgtatacaggtataaagatattacatgtactcccaaaatatgtgtaactattatatgttctttttttttaaagaacacagaaattttagtcaagtaaaataaagaaattttttttttttttttttgagacagagtctcgccctgtctcccaggctggagtgcagtggcccgatcttggctcactacaacctctgcctcctgggttcaagcgattctcctgcctcagcctcccaagtagctgggactacaggcatctgccaccttgcccggctaatttttgtatttttagtacagacggggtttcaccatattggccaggctggtcttgaactcctgaccttgtgatttgcctgcctcggcctccaaaagtgctgggattactggcgtgagccactgcacccggccaataaattgtatcttgatcttggaaagaaacaaaaagagcccaaattgagacttgagaatcaaagattgcctttgcatcccgccagttaactgcctgcaacaaacaaacaaacaaaaatcaatggttttcagagggagctaaaagaagccagcatctatacaacataatattcacaatgtctagaattcaatcccaaattacttgaaaagcaaagaaacagataaatgtgatcccttctcaagagaacatacaatcaaaagcccaatccaagatgacccatatgttgtaattattagacaaggattttaaaacacctgttgtaaccatgcataatcatgtaaagaaaaatatatatctgtaataaataaacaaatggaaaatctcagcagataaataaaaactatacaaataaaccatgcggaagttctaaaattgattaaaatatctaaaattaaaaattaacagcagttagaagatgacagaggagtcagtgaatttgaaactagatcaacagaaattatctaatctgaagaaaaaaaataaaatagaagagatcctcaacatcaaaatgtctaagacacttttaatgagtcccagagaaagagacaaagaatggggcagaaaaaaatcttgcagaacaatggctgaaattttccccaatttggtgaaagacattaatttacaggcacaagaaattcagcaaaccccagtcaggataaagatgaagaaatctatgtgtagacaaatcattatgaaactgctgaaaaccaaagataaaaagaaaacctgatgcctgtcagagaaaaatgacagattacatacaggggaatgacaactcaaatgaccatgtacttctcaccagatactatggaggccaaataacatttgtaatgtactgaaagaaaaaataaactgtcaacccagaattctacttccaatgaaaatagccttcaagaattggggcaaaataaaggaattttcagataaaagaaatctaaaagaattcattgccagctgggtgcagtggctcactcctgtaatcccagcactttgggaggctgagatgggcagatcacctgagatcaggagtttgagaccagcctggtcaacctggtgaaaccctgtctctactaaaaatacaaatattagccaggcccggtggtggatgcctgtaatctcagctactcaggaggcgaggcaggagaatcacttgaacccaggaggtgccggttgtagtgatccaagatcatgccattgtactccagcctctgtggcagagtaagactccatctcaaaaacaaacaaacaaataaacaaaacaaaacaaaaaacaccaccaccaacaaaaagaattcattgccaaaagacctacactacaaaataaaaagtgctttaggctgaagggaaattaaaatgtatggaaagaccttcagtaaaaactctggacactaaagctcaggtgagctacctggcaggtgatcatacatcaatgtgctaggaaggtgatgcatccccaagcataaattaaaatggaattcaaaaaaatattcaaagaatccaaaagaaggcaagaaaagaggaacacgggaacaaaacacaagaggcatacaggaaaaatgacaataatgttgcagacctaaattcaaccatatcgacaattatattaaatgttaatatactaagcactccaattaaaatacagaattggaccctgttcacaagatggcgccaaaagcgaagaaggaagctcctgcccctcctaaagcagaagccaaagcaaaggctttaaaggcagtgttgaaaggtgtccacagccacataaaaaagaagatccacaagaaaagaagatccacccaccttctggccgcccaagacactgtgactcctgaggcagcccagatatcttcagaagagcgcccctgggagaaacaagcttgatcactatgctatcatcaagtttctgctgacccctgagtctgccatgaagaagacagaaggcagcaacacactcatgttcattgtggatgttaaagccaaaaagcaccagatcaaataggccgtgaagaagctctgtgacattgatgtggccgcagtcaacaccctgatcagcctgatggagagaagaaggcatatgttcaactggctcctgattacgatgctttggacgttaccaacgaaattgggatcatctaaactgagtccagctggctaattctaaatatatgtatatcttttcaccataaaaaaaatatggaattggaagtagctccccaacttactgcttgctgaagaaaaggcatagatcatccattcccattgcttccatactcatatgaaatatttggtatatatctacccaaaagtaatatgctgttccactcccctgtactctgccttctgcctcaaatgtccttcctatctcataccaccctcacctccagcattcaacacacacacacacacacacacacacacacacatttagactccctcatgtcttacctttccatgaaggtgatatgatctgaccactccacttactccaattaaaatagatcatatctatgcatgggtgagattatatcttgctattcaagctcactaggagctgagacttcattttgtttgttattgtagcccctgggccaggtgtatataggctatttagctatcaaaaacattaatcagcaatcaaaattaagtagtgaatatagtaggctgttctccacgaatacaatttgtaataacaaacttgaataggggagtaattcaacccagactatgccctctgctttataaaataatatcctgccaacttggcgtgacattgaatttttttttcctgacaaatactgacatatttgctcaaacaaattaatatccttcctttgattcgttttgttttggaggaaataagttcacatgtcaatgtaaaagctgatccttacaacctctcttccaaatgaatttttgtatcttcatgataacaagataattaaggaacagtaaacttttctttaactttgtctttttctttttagacataaccctggccttctgcatggagccgtcgctactgagatagaaaaacaatgatgagctgctaagtatttaacagccagatcttggggatggggagatactcgatttgtagcatttgcccatttccacggtttaaatactctcactatggccaattttaaggtatcagcatgaccttataaatggaacattaagaagagatggacaggtcgggcccagtggctcatgcctgtaatcctagcactttggggggctgaggcagaaggatcacgaggtcaggagttcaagaccagcctggccaagatggtgaaaccccatttctactaaaaatacaaaaattagcctgatgtggtggtggacgcctgtaatcctagctactcaagaggctgaggcagagaattgcttgaacccgggaggtggaggttgcagtgagccgaaatggcaccattgcactccagcccgggcgacagagcgagactccttctcaaaaaaaaaaaaaaaaaaaaaaaaaaaaaaagaagaagaagaagaagaagaagaagaagagatggacacaatatcttggagccagtgtgaatcattgtaagaaagaccacgtgatgtcaaggacagggtaggaagaaacataagtttccatttttaaaaattaaaacactagttattccctaaaatgagagtctgagtggctgttcattaccacaacttaaccatatgagtatgttcaccccaaattctgagtgaaaagaccctgaagctctaaactttttctctttcacctcccccgctccaccataaaaagaaacaacaaaaaaattgacatatatggtcatttgtcctgagttccatgagatttgcagcaaccaaggggaccataccatgatcaagctattaaaaaattggttggatgcagcggcacatttctgtaatctcagcaccttggaagaccgaggttggaggaccacttgaggccagttcaagaccagcctgggtaacatagtgggaccccatttctacaattttttttaaagttagctaggtatggtagtgtgtgcctgtagtctgtgtgaaggcaggaggattgcttgaacctgggagttcgaggctgcagtgagctatgatcaccactgcactccagcctgagtgacagagacagacttcatctctttacccaatatgtgtaatctgggaagaggagaaggctcataacactcacccttgtaaacatcagggaagagaccttgacatttggactgtgattgctgattggacgggaatgggttggcaggggaagtgggtgagatgttttaaccaggaaaaagaaaaaaacaaaaacaaaactatgaatgtgtgaaaagagacttctcaaagaaagaaaggaagagaaaagtactggtcactccccacacagacagaatgccatggagttgctctttcttgccatgagtttaatgacaagcttccttccccttcatatgccaactaagcagcagccagcaggtcattccccgtctttgctgcccagccaggcctagagtcttccccaaacacagtcacagatattcccaggcttgaatgccatccagagactagtcatctgatgcaatttcctgtggtctgacaaacgaactcccatccaaacacgttgtgcttggggagtctgactatatgatcacatctcccaggactcaggcccactctgaccacaggattcttctaaagacaccaccgacagaagtgtgtgcaattgcaccatataatttttgtctgggaagtgaaatatctctgtcgttacatcatcttccttagcatagtgatcccttaaaagaagaaagcctaaataagatcccttctcaaagccaaactattaaaacaatcctttttaaatattctttcctgtcttccatgctgtacaagtacagctttcacacaatttctcttctgatcttcaaaacaatgcacggaggggtgtattattcctgtgtcctagtccagccaggacttcctgctcccctttccccccgattcctgcaaaggtgacatggccagcccggccaattcacgtctgagagactggcttcctgtgacaaccttcacccccctcccctgacccacaggcctgacacaaagagactgccggaaactccccacaacggccaagtgggtagccacagtgtcctggaaaggaattctaagcccacaacagagcatttctcatctagctgttttttgtttttttttttttaaatgggattggggttggcgaccagccaaagacgggtggcagaatgatgaaatcatacaagcccacagcaccgattgatgtcgtagtggaaatggggacaggcttttgtgctaaccagagtgttcctacatacactctctgattaataatagtgatggcccaggaacagccgtgacagtcaaagagaaacattgctgtatttgtaacattccatttttttaaagagtgtatattcatatattctttatgaaatctaagttatcttgagaaatgaaaagaaaatggccattgctgccactttgagagccctccgactcaggggtgttgtgtgggttgggggagatttccaactccctgcttaattatctcaaaacaccccatccattcgggtcagccagcatttgactgcctgctactgcgaagctcaatactgcactctgcctaataagcacaaagcccgcgggtctctccaggaaggcaggggtggtgggtcagaaagagctggctctcaaatcgcccatgcctgtgattggatggggaggagttgagacaatagacacacagccaactaaccaaagccagagacaaaggaggtagattctagatcagtgttggcataggagttggtcctgaagaactgctgggattttgatgaggaagggaagggttggcgtgggtgggacagtctataggaggaaacatcttggaagaaaattaggatgtagatgagaagcaacttatggtcacttctaattccactcctatcccctggccacacattccattcctctaaggtgtccaatctatacacccctgccaccacccctatcccatctcagcaggagacaatatgtgaaaagaaagttcttcatttttccttcttttccatttctttcttcctgtctttctttcttttttttttttttgtaacagagtctcgctctgtcgcccaggctggagtgcagtggcgcgatctcggctcactgcaggctccaccctgggttcacgccattctcctgccttagcctcccgagtagctgggactacaggcacccgccacctcgcccggctaattttttgtagtttttagcagagacggggtttcactgtgttggccaggatggtctcaatctcctgacctcataatcaacccgcctcggcctctcaaagggctgggattacaggcatgagccaccgcgcacagccctttttttttttttttttttttgagacagagtctcgttctgttgcccaggctggagtgcagtggtgcaatctcggctcactgcaacctccacctcctgggttcaagcaattctcctgcctcagcctcctgagtagctgggattataggcaagcactaccatacccagctaatttttgtatttttagtagagacggggtttcaccatgttcgtcgggctggtctcgaactcctgacctcgtgatccgcccacctcggcctcccaaagtgctgggattacaggcatgagccaccaagccaagcccactcgtttttcattcttgatattgacagactgcccagagacagacaggagtgggtagtgagggtcagaaggattaaggagcttgcctagccgatgaggaagggaacaagataagatgcaaacctcagtctctgactctcagccaagtgctcactaccccaactagctgtcaaatgaggtggatggggccttggttaggtacatagacacctgagtcatatcaacctggtgtgaatcccagctctgatgttgagcgattggcctagcctctctctgcctccattttctcttttttcatttcatttttcttttttgaggcagagtctcactctgtcactgcctctgttttccatagcaaaatggagttaataatgcttacatgagggattaaaacgaagacaatgcctacctaatgcttagaatggtgcctggaacataggaacaatgttgaaacagtctttcattcttccctcctatcactgtgatcatcagtaccaccacacactgcttctcatttagtgcctgaattttagagcctgcctggaggctggagccctgcctggacatttcccttaatcttgttatcctcctcagagaggcggcacccaccccattggcagacgccacgggaattctctgggcctgcttgtcatcactccagatgttgtttagagttcttctgttagcacagctgtttctagggtctggaaaaactctaaggacccccaggaggatacacaccagattgggtctgggctcacaccaccctgcatccccagagcctccctggacgctgtttgcaaggtcctcaccgcctggaagtccaggagccatttttagggaacagcattcaagctcaacatggcaagttccctctttcctgcaggggaggaccagaagggagccggagatgggggagaagggtgggaggtggatggtttggaaaagggatggagacccagacggagagaagccagccagccagggtgagggaacaagctgctgtgctgcccaggagaggcctggcctcaggctgccagcctcagggaggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactggtaagaaagtgctttctccagcggcagacccgggctggcgagggagagacgtagacgacatagggctgtttctgaagggagcagaaagtggttcctgcataagaacacttaggaggacaagcagctggagaccgtgggccccaagggtaggagggtttaaacttggtaatctctgggtgggggtgggcagcattacctccacttcactgcagcccctttcccccaaatgttaggctttctgggacagttctgaagccaaatagcccggccagtggtcccaactgggctactcatacttgtgagaccttgggtcctaatttggggttctgatactatgaccttcacacccatctgtgaaagaaagtgtcccacggagattctccaggactactctcaccctccttggaaagggagccgtggggcggggcaggggggacagagcagggggctgggaccacacctctaacgggagggggggcgcggaatctgaccgatcaaaaagccccattctcaaagctccctacctgtgacagggacctgagtggaccctccccagagagctttgctccagccagacccttcaagtactctggtttctcaaccagcccaggaagagcagggggagaaggggccaggtcaggcagaggagagagagcagaggaagggaagatgatgctgcctgtgtgcccgctgcctgggcagaagaggagtgaggctttgacagtccctctcggagcacgtcccctgtgccaggaacatgggcatgtaactcttctcgtcccctgggcctttacggctacagccaccccatttcccttctcccaagctgccacaagcaagagctgatggaaatgaaaggagtcatttctttctttcttcttcttttttttttttttttaagatggagtttcgcttctttttgcccaggctggagtgcctggagtgcaatggcgcgatttcagctcactgcaaccttcatctctcgggttcaagtgattctcctgcctcagcctcccgagtagttgggattacaggcgtgcaccgccatgcccggctaattttgtattgttttagtagagatgaggtttcaccatgttggccaggctgatctctaactcctgacctcaggtgatccacccgcctcggcctcccaaagtgctgggattacaggcatgagccaccacacccagccaaaagggggcacttcttggcaaaaaggacggttagagaaaaatgccctgcccaggaagtgggaggctcagaacccttccttcactgtggtctccaggaagaacctcggagtctctgtgagttagcgcaggtgaacctgaaggcaggggagacttgggaagctctcgctttggagattttggaagttggcatggccctggcaggaagcgtgagcctagcagggctgcgttcctaacactgtggaccaaacaggggcaccagaaaacaagaaaaaagattcaagagaatttggcacttctctcaaattatttaaattgaaataatttaattatttacattatttaaaatgaaatgtttcattttaaaaacagccttatagaggtataattgacctacaataaacctcacattttaaagggtagcaattgataagttttggcctaagttatatacatccatgaaacaccatccccgtaattgagataatgaagcttcctgtcaccccaaaagctccccatgcccctttgtaattcctccctcctgctccttcccatgccctgccccagcaatgtaagagctctgtagatcatccttattcttattagatgctgcctcactgttctgacttttggacccacacagggagtgtggggcaggtggtgtcatcatcatcacatgttcagtgcttaaggcctctggagatctagccctgggtatgaaatacagctccatgttttataatatgaaaataagtctatttttctatccccacaccttgaccctgtagtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggtgaggaggcggcagggaggatggggtctgagagtcaaggtgagtgttcagtcctccctgcaggtgagatggggtctgagagttgggggacgagggtctagtcctccctgcaggtgagatggggtctgggagtcaaggcaagtgttcagtcctctctgcaggagagatggggtctgagagtcaaggcgagtgttcagtcctctctgcaggtgagatggggtctgagagtcaaggcaagtgttcagtcctctctgcaggtgagatggggtctgggagtcaaggcgagtgttcagtcctctctgcaggacagatggggtctgagagtcaaggcgagtgttcagtcctctctgcaggtgagatggggtctgggagtcaaggcgagtgttcagtcctccctgcaggtgagatggggtctgggaggggcaagtgttccatcttccctgcaggagagatggggtctgggagtcacagagtgggtccagtcctccctgcaggagagatggggtctgagagttgggggacgagggtctagtcctccctgcaggtgagatggggtctgggagtcaaggagagtgttcagtcctccctgcaggtgagatggggtctgggaggggcaagtgttccatcttccctgcaggagagatgggatctgggagtcacagagtgggtccagtcctccctgcaggagagatggggtctgagagttgggggacgagggtccagtcctccctgcaggtgagatggggtctgggaggggcaagtgttccatcctccctgcaagaaagaaggggtctgggagtcagggaatggctccagtcctccctgcaggagagatggggtccgggagttggggtgagggctggggacttaaggcaagggtccagtcccccaggcagagactcacttgagggccatgggaagtcatttagcccctccacacaaagcccatggaaaggaaatgttaatcctgcctttttcatgctaatctgagtctacctccagttttcctatttccaatcctttccctacaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggtaagagccccatgtgatttctcctttacagccaaatagaccaacctgagaaaaggagaggaaggggaaacgggaggccagtaatagagatttccacctgaccactcttttcaccccattaggcttggagagcagtggagaactagcccaccgcataacacaggttctcctgtcccccagatactgatcagaagggttttccatggtccatgagtccatcagagctcagatcccccgaaggcagtcccgcactctggcccttctcatctgctttctcgtattggccctaattccctagggagatgggcacaagtccttgatctgcctacagtcaaagaggccagtgatcggccaggcgcagtggcacacgcctgtaatcccagcactttgggaggccaaggcgggtggatcacgaggtcaggagttcgagaccagcctgaccaacatggtgaaaccccgtctctactaaaagtacaaaaattagctgggcgtggtggcacacgcctgtggtcccagccacttgggaggctgaggcaggagaattgcttgaacccgggaggcggaggttgcagtgagccaagatcaagccactgcactccagcctgggcaacacaatgagactctgtctcaaaaaaaaaaaaaaaaaaaaagggccagtgatcatgcccttcctgctgcctcccacaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggtaagcacacaaactggggtggaagagagacgttccaagggccagagcctttcctggatgggatgcaaggaagggaagctctcaacaggacggatgacaagtgtatttgctgtatagatctcaattcatctggctattctaattctaaaccatgcctcagagtggccttcctgtgtgtctgctgtggccttcaaatgactggtccagggagactaggaggccggggctagagcctagctaccacaaagttgagtaaagaggccatggagaaggctgggcggggtggctaatgcctgtaatcccagcactttgggaggctgaggcgggcagatcacctgaggttgggagttcgagaccaccttgaccaacatggagaaaccccgtctctactaaaaatacaaaattagccgggcgtggtggcggacgcctgtagtcccagctacttgggagactgaggcaggagaatcacttgaacccggtaggcggaggttgcagtgagtcgagatcgtgccattgcactccagcctgggcaacaagagcaaaactctgtctcaaaaaaaaaagggggggaccatggggagtcctaggaaacaggaggctttctttgagcacctctagcacagtcctagcctggcagagatccattgcatccttttacagatgagaaacctacacacagaataaagcagggacttgctagaggcaaaaataagactggactcccgcacttcctggcactgaatctagggctttttccattatcaacaatggccagaagggagttagcaatggctcctggcctgggggcctatgtattggctccctggtaccattttatgttcacttgaatcactcacctctttatgagggtgtatttactgtcacacaaccatcagtgtgacagatcctttggtgtctttgctagttgttttggtaacatggtaacatgggagagagcctaaaactccccagacagtaaccttctcctgataaacaatccacccaagggcaaaactggccaatggaaacctggaaattgtgagagtcatgtatatttccttcatcccagcatggctggacgtcaacagaatcaaacacagtcttcaacacaacttcagtgcaacacaacacaacacaacacaacacagcttcaacactgtcaacaaaaatgtgttcaaccaacacctggtctgatcacagagtctgaaaactggtgcaatgaaagagcacagtcagaatggagggggttggcatccgtggctacagctccattcatctccttagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggcaggtccggggggcagttcgtgctcatgagcacaggccatgtatgcagttgtgggagagctgggctagccgttgacaaggacaatcatttgtggtgttgtttctctgcttattcaggggaaagaatttcagctcctgaaagggaaatctactgtcattattgcaaccaaatgattccagaaaataagtatttccaccatatggtgagtagcacttagtaattttctaatggtgccaatagttcatccacattctgaaaagtgtgataggaaaggcagattctgggcccaattttacatagcatggatattaaagggtcccatatttattttttgctttgttccaaaagatagtttagtgacttgcttaggctaatcaagcacacaaaaattggtcttcatttgtgcccagcccttcaaaggggcttcccttgccactcccaacacccccgatcacctctgaccatctccaaacttcatggcctggacattgcaatttggtcctcagtagggcctgtcttactgttttcggtcccatgtgggagtcttctctattagactgtgagcttcctgcaaaactgcatgactttttccattttcctgacatcagagcttggtgcaaaaagaggactctgtagaggcgcagttacgtgattgactgactgactgattttgcctgggaacactcacaggttcttccctccatagcccctaagcgccgtttagtgcattgctgtgccaagttgctcccttcttttgcacagaatggagcatttcccctttgggaaacttaccaaggcttctctccaaagaactcttctccttctccttgggcagaaagttgtttacctttcttaacacttcagtgcttaaaactacagaatatcaaaactaaagaaaccatagagacgatccagcttttcgctcttttctttttctttttactattgtggtaaaccacgtataatgtaaaatttgccatcactatagagacatttggtacattcacaatgttgtgcaatctggttctagaatattttcatcattccaaaaagaaatcctatacccattagcaggtactgtacattccctcatcttcccagttcctggcaaccactaatctgctttctatctctatggatttgtctattctggacacttcacatcagtagactcatataatatgtggtcttatgtaaccatcttctttcacttaccgtaacattttcaaggtttgcccgtgttgtagttgtggcatgtgtcagcatttcattccttttaatggccttttcttttcttttatttttttgagacagggtctcactctgttgcccaggctggagtgcagtggcgtgatctcggctcactgcaacctctgcctcccgggttcaagcgattctcctgcctcagcctccggagtagctggggctacaggtgcctgccaccacgcccggctaatttttgtatttttttttagtagagacggggttttaccatgttggccaggccagtctcaaactcctgaccgcaggttatccgccttcctcggcctcccaaagttaatggcctttttacggtcatcccacattttgtttctctacttgttggtaaacattcggattgtttccacctttcagctctttgctttttgaagtgcagtctgtggaccagctgcatgagcatcacctggaatcctgttagaaatgcagaatctcaggccctccccctagaaatgctaaatcagaatatgcagggtcacatgatttcccaggcatttcaagtctgagatgcgctgccccagccacgggattctcagccttggctgtacgtggaaatcacctactgacttgttttccttagtactgatgtttattcgatcctataagtggtccatgtgttctgtttgaatgagaaaatacttggtgagcaccaaaacaagagtaaagctgactacttcccttcaaatgtccagcctggcaaccagggcacctacacacttatttgaaggctacagggaagtggggagctccaatacacatggaactggatttgtgctcagaaactctgaattttagttctgctgtgccccttactggctgtgtaacctctctgagcttctttcttcttttgaggaaaatggggataatggtttatctccttgttcaggaaaagaagacatccacaaccagccaacaccagatctatctccttggcagcatccacactcacttactttgccttcccacctcttaaccatagaggagcttcctatgtgcctctctaaagcctatcccctcctactggtataatataccctctctttttgcctacacaaggtcacacaagttttttgctacactgctccagcaattctcccctctctgtcctgcaacagagagaggttaaatgagctgtacacgcaggtaacaacaaagtctcacatctctaggttgtcctaacatttcttacaataactttttaaaggggtaccactattgaatatttatatatcaatggccttgcacgaaaagaatttttttttaattttgaaaattaaggattgaaatcatgtatactaggtggttttgtggttttcagtctttaactttttattaatatgacccaaagccagaaaaacatgaaatacttctgatcccatttcctataagctaccatcttgtttctttgttcccctccgtagaaaaacatttgagctagttgtctataagtaactgcctccatcttttcttctctcattcttattcccactccagtctggctctccattttaaccaaatctgctcttgtcaaaatcaatgacctctgcattgctaaatccaatgctcagttctcagttctcaatttatgggaagcatttactgctcatcactccctcttcctcagtggactttctcggcttccagggtaccacactttcctggttttcaaggacattggtggtctctcattctctacctccccagcctcttaattttggggggccccagggcttagtctctggtctcttctctacctatattcactgccttcattatttcatcctacctcctgatttttaaaaatgccatatgtaaggccgggtatggtggctcatgcctgtaatcccagcactttgggaggccgaggtgggaggatcacaaggtcaggagatcgagaccaacctggctaacacagtgaactctcgtctctactaaaaatacaaaaacttagccgggtgtggtggtgggtgactatagtcccagctactcgggaggctgaggcaggagaatggcgtgaacccaggaggcggagcttgcagtgagccgagatcacgccactacactgcagcctgggcgacagagcgagactccatctcaaaaaatagataaataaataaaaatttaaaaattttttaaaaagccatatgtagtcagacacttccaaatttatatctcagtctgggtttttctccccaaactctagatttgtatattactatttactgcatcttcacttgaatgcttgatagacatcttaaatgtaacacatctgaaatggaatcctctctgccacagcttggcccatctcagttgatggcaactctatctttccagttgttcaggccaaaatctcaggttcactctcgacttctctttccctccgcattgctaccctggtatgaaccatcatcttctctagcccagatgctgcagcagtctcctaaacggtcttcctacttctcaccttgccccctacagtctattctcatcacagaggtcaacgtgatcccttaaaaatacaagtcagattgtttggctcctctgttcagatctctgtactgattcttgccccattttatgcaaactcaaaactacagtggctttagagatctatgtcatctttgcctcccttcttatctcatcacctctttgatctcatgtactactcctgttcagctcactggcctcctgattgtttcttgagcataccatgccttagggccttttcactggctactgcctctggctggaagctacctcctcaccttccccaccctactccaggagctaactctctcacttctctcaagtctttgcccagatggcaccttctcaaggagatgtaccacaacaacctatttaaaattgcaactccctctccatcacatatttaccaaccccttaccttcttctattattttttccatagcatttgccaacttctaacatattatctaatttacttacttattatggcccttgttaattgtctcccacgacctcagaaaaactataagccccactggtccccttcatgctaactactccccagacacaaatactctacttttgcttttagctgtttcttctggtaatcaccttcatatgtctaaagcaccttcttatattttttccagttttagatattacttattgactcataaggatttaggaatatagatttcacttttttataccacccatcccacacacacacctccaaagttcttcatttcatccttccaatgtattgatttcactcattctggttaaataaatattcagtattacattagtataaccatgtaaacattataaatggttttccacatgaattgtgattatgtgttctttctcctacaactttttgttttacctggacttaataattgcttcggtttttcatttgcttcactttctaggtacctatcactaaatcatccctaaaattctctaccagatctgaaaattcccctgagtacaactacacacatcagatagtctgtccatttcattttgggagcatgttatgccccaggcttgatgattagctgttggtctggaatttcttccactctctccacggttggagttctgattcccaaatctcaggtctcatctttctctttcttaggttactccttgtttgatagaacatatccccaaatagtttcttgagaaagaaagcatgagaggcaaattttttaggccttatatgtctgaaaatgaaagcttgggtggctatagaatctattgaccatcttaatctgtttattaaaaatcttattacaattctgatttggccactacacactgtatacatgtattagaaaatcattctgtattctataagtatgtatcattattacttgtccactaaaaataaaagaaataaaattgattacaaaaactttcaaataaatatgacagtagaaagttaatacaataaacattcatgtatttactccccagatacaacagttgttgttctaaacaaggtgaataaaaataaatctactcttagatacattacaggtaaaaggcaaaggttgatttctttgaaatcagccgaagaagattacaagcaaaggaatggcagttaggctgaaagcaaatatatcgacagcaataatagaagtgggtatgcagtggaataatcttcaaagtgctaagagaaaatagctgttaacacgtggaaatcaaaagttttccaggcttgaactatactttgtttgttttcttttttctaaagtatgttaaagcaaatccaagatatcctgttatttcaccatcattctttaatatctcaaaaatacagtcattttcttaatcacaatgcctttatcactctcaatgatgttaacaataattttcccccatcgttttggggccttgcatttaccactcttgttcattactactgctgctgctgctgctgctgctgctgcttgcttctcccttgtattctattggattgagcaagatttctttattctctttcttctttcctactgattcgtcaattttacatttatttctatcatttcaatagttacccttaacattttaatataaatacttgacttaataaagtctaaagttagtcattatctctactttccttacaaatagtatatagatttgagaacatgttaacactgtaactatcttacatgaaaatgctgccagaattttgtttcattttgctttcatactacccctctttactgattattgttgttatttatgtaactcatgcctgtttagatatactcacatgtttttgtttttgctttttttctttctttctttctttttttttttgagacaaaagtctcactctgttgcctgggcttgagtgcagtggcacgatcttggctcactgcagccttcgcctcctgggttcaagcagttctcctgcctcagcctctcaagtagctggtactacaggtgtgtgccaccacgtctggctaatttttgtatttttagtagagatgggcttttccatgttggccaagctggtcttgaactcctgacctcacataatctgcccacctcggcctcccaaagtgctaggattacaggcatgagctactgtgcccggctggatatactcacaagtttacccttctctttactcacattcttccttggatcctaagctttccttctgggtatgatttctctcttcctgaaatacatctcagtagcttcttcaccaagaaccttgagtagtaaatctttagttgcctgaaaataagctttttgttttttgcatccatgaatgatagtttagctggatatcaaaatctagattaacagctattttctcttatcattttgaagattattccactgccatcccacttctgttattgctgttgatgtattttcttccagcctaattgccattcctttgtacgtaatctttatatttggttgatttcaagatcctctttgccttttacctgtaacgtgtttaagagtagttttatttttattcattctgttcagaacaatgtactcaaatgtgtttgcttttctcctgctcaggatttctctttccttaatataaagatttatgtcactaatcaggcctgaaaattctcatctattatctctttgaattcccaacattccccaactctcccacattctctcaactctccttctggaacataacacatgtatattaagcattctcattctagcttcatgactctcttttttttcatgactctccttttttttcatttctctcttttaatcgccttatgtctcttaacctttcatattttctctatttctatctcttatattctgggtaatttcctgaaattatctccaagttcattcattctttcttggccaaatctaattttctgtttttagcccatccatttaggttcaatacctgcatttttcatgtctagaagttcaatttatctttctttcaaatttgcctatttttgttctcactacaaaaaaaagataggtatgtgaagtgattgatatgttaattaacttgatttaatcatcccacaatgtatatatatattaaaatatcacattgtaccccataaatatataaagttattatttgttaattacaaattagaaaatttcaaatttacctgttctgtttttcatgagatgttattcttttcccagatttaatcatttttaattaatttattttacagtctctatcctatagttgcattacctgaacttcttggaggctaatctgactacttttgtgtctgtgactcttactcaaggtggattgcttccttgtgtgtttgtaattttggattgtgagtttctatctggtgggactctacctatgaggatcctctatgacctattttgaggctgttgtccctccagaggaattttgtgattgcttctgccagacatctcaatgtttatgttaattcttctgctcagggattcccagaccatgaggccaaagtaaatcctaatcccacacacaggaatggcatggacctgtgattttgagttttcaggggcataagttttcatctccacactcaaataccgacccaagaaagaaaagcttccttgccactttccttttctcattagctgatacttttcctcttacccaccataatttatcctttaaagtttccagctttatgcaggatcaatagagtcttacttccaaatccccacctgtgtggatgggactttcctgtcatccaagcccctagttacaaagttgaccctacatctcccataagcagtgtcaactcctgtgcttaaccagtccatttgtgctgctataacaggatgccacagacagagtaataataaagaacacaaatttatttcgaacagttctgaagactgggaagttcaagatcaaggcaccaccatttggtgtctggtgagggccttcttgctgcctcctagcatggtagaaagcaaaagagtagaaggctgtagccaaatacttcatgaatcctcttttataaggaccctaatctcattaaaaagggaggacctttcatgatctaatcacccccgaaggccccacctcttaataccatcacattggcagcacctgaattttggaggagacacattcaaaccatagcaaccagtcagaccttcattcctggaatgcaaaattttctttctttcctgcaaagccagctattaaattgaatgtctgtcacattttatacaccatataaaagtgtttacagtgggaatttcttgtgttatctagtctactgtattttctgaccattaaagctgaagtcattttaaaatttgatatattattcacaattgcagggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggtactcagcctctgttctctgcttacctttctgggaaccatccgcacagtgtcttaaaaaaatccaagacctgaaagatgttcacaaatgttgtggctgaaaaggccgttttctctgactcccacttctctgggtgcccaaatgcactatctcgtagcacttaccacctggtttatttgcatcacctccgagagactgagtcacctttgactcaagccaggtctttgaaggtagagccaggtccctcttctctgtgtctccagcttctaggccagggattgatttggagcaactgcttcaaaactgttgagtaaatgaatgaatcagaggatacccagtctatctctctcatggtgtagatatggcactgaggcccagagatgagatgtcttggtcaagatcctaagccagttggtggtggcttacctccagcagatcaaggtttgcttcaagaagatcagggtttgtaggcatctccctgaatatcatgatttttatgtcctaggttattttctagtaataataataactggcattagaggttgttaaccattgtgtgccagttacaatacagagctctttataatcttcatcataaacaataggcatgcattttatctccattttacagataaggtgaagtagctttccaaggagtatacaattagaaggtggcaggatccagcctgagtccacatgtatatagctccaaagtttatgctcttaagctccagattaaatgccttacttaaaaaatttattttttttcaaaatacataagtactagattttgttggagctagttgatataatatcatataaagaagtataaaagcaaagctaaccctaattccccaaccccataccctgagataccactttggacagtcttatgggcatcttttcaaagctctacctttgcatatacaagcctaaacaagcatatactgggttttacttgtttctttttccacacatattatcttactatactttttactctgccacatgcctttttcacttagtatatgatgcatgcttcttacaaaagacttagtatgccaaaacctttttttctaacttccttgtgcatctatgtatgcacataagcatataattttacaaaaatgggttcatttcatatttgctgggggtgttactagtgccatttttccttgcctcccacaatttggtatatttcctttcacagttttctccatccttatataacagagtcgccagatttagcaaataaaaatacaggacattcagtcaaatttgaatttcagagaaacaaagaattgtttttagtgtaggtatattccatgcaatgattgttttgctaaaattaaaatttaaccaggacaccctgtattttatttagcaatttcttatataaccaccatacaaacatacacatttggagtcctgttatatacattttttcacttttttttttttgaaccagtaaagctgccatctttttttttttttttttttttttgagacagagtctcgctctgtcacccaggctggaatgcagtggtgggatctcggctcactgcgatctctgcctcccgggttcaagcgattctcctgcctcagcctcctgagtagctgggagtacaggcacccgccaccacacccagctaatttttgcattttagtacagatggggtttcaccatgttgtccatgctggtcttgaaatcctgacctcaggtgatccacccgcttcagactcccaaagtgctggaattatagggcatgagccaccacgcccagcaacatttctttacatcctaatgtaaattcagcaatacccaaggaaatccctacaaacaaaacagtgtggcttatttttattaatggctgcctaagattccatggtgtgagtgttctcccatctgtccctccacccagtgatagcaacaggcccctgttaaactttgtcgcaagcctcctatacttctggctcagtgggctcctgaccttttctatgccattacactccagtctttgggcagggctcatgctctgtaacaagggacagcaatatccagagatattctaggagctagcacttcttactttaaccatatcaaactttttttatatccatttcttaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctctaaaagctgctcttccacctttctttgggttccgcactggttttccagggccaggaatggcagcagccaggaccccaggataagggcagtgcccaaggaaaggggagcagaagacattcagggagggggaaagaaatgaggctgggacagtggataagggccaggtgaaggggagaggggcggcttctgaaggctttgggcagggagagtggctgggggaagcctagtaatgcaacctatccagcggcggcttcggaaaaaacccggggctgggtcaggatgggaaaggcagcgaactgaaccgttttgagccccaagttcggggccgaatgtcttccctgtgcgcagaagcaagggcgggggcgtgccatcctcacccggagcgccggccgagcctcccgcctcccaacgcctggccagggccccgtctcgccctctgcacatgggatccactgaccaggcaactgcaggtttggggctctgcgacccgggggcaggaacagagccttgcaggcggcagcgcgtcacaaaggcggccggagcttggcatttagcttgggccagagcaaggcgcagacccggggcgcccatggagttggcgtcggagcaacagctgcgcgggcggagcaggtaggcgcgctccagtccctgcagcccgagcggggttcagcgaacgggtaacgggagaatgcgggccggagcaggctggggtggcggtgggatgccccgaggcccgcggcggggaggcgggctgctctcatcaccccctctgggaagcatctttggctgcaggagttgccaggccaactccccctcccgcggtgggtaggacatctttagatttccctccctggttggcagctgtgtgatatggtggaccaaccctgggttcgaatcctatctccccacttactacacgttctccctgggaaactttattcaccttccaacacctccgtttccgtatttgtgaaatggatgtgtttgtattcctatcttccttggcgggacgttgcagaagtacctcggcaccaactttcttattaatggcagccagctcttgtatagcgtttactacgtggcaggcactcactgttcccggtgctttccaggtatcagctcacttaatcctcccaacactaagagaaaggcactattattaccccatatacagatgtgaggattcacacataaagaaattgacttgcctaaggtcatccgactgtaatgggcatagctaggatgcagcccactaagctacactgcctctgatggggtctcggggggtaaggggaggctcccagtcattaaatagaatttggagtctccttacagcaactcttccagacacacatattcttccaaccccacccttacagcaccagtgtctgatgacttttcctgacctacaaccttgctaggccaaaaggtttcatggagcttttatttacttatttattttattatactttaagttctgggatacatgtgcagaacatgcaggtttgttacataggtatacatgtgccatggtggtttgctgcacccatcaacctgtcatctagaatttaagccccgcatgcattaggtatttgtcctaatgctctccctccccttgcccgccaccccccgacaggccccattgtgtgatgttcctctccctgtgtccatgtgttctcattgttcaactcccacttatgagtgagaacatgcagtgtttgatttcctgttcctgcgttagtttgctgagaatgatggtttccagcttcatccatgtccctgcaaaggacatgaactcattcttttttatggctgcatagtatttcatggtgtatatgtgccacattttcttaatcctgtcgatcattgatgggcatttgggttgattccaagtctttgcttcgtggagcttttaaactggtttatctcttctgcagcaccttttaggagctttgcttggtggtgagtgctgtggagatccctagccttgggcagtttgcaagtgattgaagagacctatttcttcatttgttaaatgtttaagtaccttctcaaaagcagaaggaggttgtcaaggggtgtgtgggtcccttgggagagaaaggcaaggacacagattatacaaagaggggcactggcaagaggtagcagaaggaggcaagctaaatacggacacagccatgctgggaaccactagggcgccacgtcatgggcgggacgggctgctgttcagtcctttacggaagtctgttcggatgtggcggtgggaaggccagctggagacaggggccaaatcagtgagtgggtggtgagagaaagtgatggcgtagtgaggacaaagcctggagaaggtccctagggaggcccacaactgtgcttacttgaggatgctcactgccactgtggtgttggtgggagctggaggagacttggggtccatcaaaggaaagaggatgggagacaggcaggatacctgccatgggttctattcagctgctagacgcaatgggtgaaatgtacacagagccacaggaataagtccgacaaacagtaagtacacatttggcaagcacacatacagacaaaaagacacacgtcaaacacacttgaacagttgcctatggtgggggcaacggaatgggacagagggttaaaatggaacacatgaataaataaaactagagaggggtcttgcacagacgaataatgtcagtcctgaattgggaaatgtgattcacttgcccctgcacccttgtggtccaagaggtggggacaggaaaaaaaagtacagaagaaagagtcaaaaagcccaagttccagtctggggcccgatactaacttgctgtgagactataggtgagtcccttcacctctctggccttcagtgttcatctgaaaagaaatcaattctcaggtctctttccagcaccacaattttatgagccatgatcaataatcttgggtttatctggtaaagtagtcagtgagagctttaaggagtggtagggcttgaactttgaacaatgggggtttgggaggggcaaacaacatgaggagagtttttaggcaaatgaaactttgaaagcaaaaaactgtaaaaagtttagcagatggctataaaatatctatggatgaagcaggccttcgctcagatctctgccgggactctctagttgggtcagaaaatttccagccttccccacctcttccttcaacagttaccaaatcgtgtcttctaaagaacttgcaaacacatccccattcccaccacaatgcctggactctgctcttgaccatccttcctctgtcccccaggagtgtcctttccacacctcaaaactcaccacatggcttccagacatttgaccaatcaaccttcatggctctctgtgacctcagctggggttttccaccctgttctgctgttacacctcttgaattttacacaactgtcagcaatgtagctagatacaggaaggggacaggccatgtcagaattccagaatcttggggaaaggggaagtgggactctctggcctctaggacataatctttatcacatcacgcaggaccccttgatccagcacttcccactgctcccacgtgatccagttcctccatttccagcccacttaacaagttaagtgccaggtgaccaaaccatttttagctccctgaatgggaacacatcacatacattcacagttctgtggctttgcacgtattgttccctctgcccagaatgcatcagctcctcatccactaccactaggcccacctgatctgccttgcaaatcctactcacccttcaaaacccaactcagacgtcgcttcctctgagcagccctctctacttccaaacactatatttagtcaaacagagtaagtcaccctgcatgtgtgctaccccacactatgagtctgcctgaaccttcctgctctctcacagggttataattgagtactggtctgtatccctggatagactgtgaaatccttgcaggtgtggactgtgtcatgaatgtatcattgaaccacccacacctggcacagtgcctaatgcacttgggaccacagggaaagctggttcatttgagtttaatctctgtttgacaggtaatggctcttcctttttattccccacagaaagcaagtgattgctttcctttcctcatttttggaagccctgcctaacacacagctgcactgtacatcccagttcctggatggacgaagaaagtgaactgatccagccccaagaccagagctgctgggcctttctgcccgatttgtgtctgtgccgtgttttctggtggctaggagacagggacaggtccagggctgctcttgtctgcagaaagtggaaccagatgatgtattctgctgagctctggcggtacagaaccatcaccttcagcgggagaccttccagggtacatgcatctgaagttgagtcagctgtttggtatgttaagaagtttggtcgttatctggagcacctggaggtcaaattcatgaatccttacaatgctgtcttgaccaagaagttccaggtcaccatgcggggcctcctgtcttgtctgagtaagagcaacaaccgtctgaaatctctttccatccaatacctggagctggaccgcctggtatggaggaacagcatcaggagctcattcatcagcagcttgagcttcttcttaaagaagatgggcaaacgcctggattatctcaacctaaaaggggccaggctgaccgtggagcaaggctgccaaattctcgactccctcagctacatgaggaatgagaatgtgatctcagagctcaacatcgaggactatttcagccatcaccttgctgtctacaacagcccccagttcaaaaagaccatgtccacattccacaatcttgtgtccctgaacctcaactacaactgtatctccgacgagctgcttgagaacttgtgtgagaatgccagcaccctccggaccatcaacatcaaatgccacgttcatgacccccacggacaggtcatctggggtatgtcctgggccaagctggccaggcaggccaccaatctgaaggtgaacttcttctttgaacggatcatgaagtacgaacgcttggcccgaatcctcttgcaggagatcccgatcaggagcatcagtctgagaagctgctatttcagtgacccagactgttcaatgagacccactctgatagatctcctgcccaccttccggcacactctgcaggtaggtaggacttgtgaggagtgactgctgttcaggtgactggcttccccagaagaaagcccactgctgcctgctcttggctaggctcccaaatgttcactcaatctcaaattgaagttctaggaaataccaccaactaagcctcctgccctcctcccaagaccacagtaggcaacagaagctgctactcacttcctacatgtggtacagacacaaggaattatctggttagctgtcagctagggaaaacccctaagtccccactcagagctatgaagcctgagccaggaggtgccttgcaggcgaatagcggctgggctgcctcttcctacttttccacgaggtcacagcagcatgcaggagaccctgtggctcctatggtcagatctcagtgggggatctgtctggttatagcagtgccagtgcctggtaattggggagatagaatggggaggaccaggccagacaaaaagtcaaatttgatttacacaaccgaagagctcagagtttctgggttgttccctaatctagtagctttctcacctgtaagatcaggatcattttgtctttccaaggacctcacagtggttgtgacaactgatattaacaggtttatgtatctctacaaacatggatggactccaaggtgctaatacctcattaggtacccacataaaccaaaggtggggtacggcagacatcatcatgacccttgtgtgctgcagaagaacttgaggttcaatgaccagcccacagtcacccagccagtccactgcagggctgggacgagcaccttgtatactccaagtacactgcctccaaattccaagttttgcaaccttggatgagatcaccatcattctcaaatctcttcctctaagaactacatgtccaatgtcccttatctaaaaagcccccaaattccattaacaccagacctgtcctacaagaaatgctaaagggagttcttcaatctgaaagaaaaaggcattaatgagcaataagaaatcatctgaaggtacaagacgtatacttactattacttactggtaatagtaagtacatagaaaaacacagaatattgtaacactggaattgtgtgagtaaactactcatatcttacgtagaaagacaaacatataagctgatcgaaaataataacaacaacaacttttcaagacatagacagtacagtaagatacaaacagaaataacaaaaagttaaacagtagggagacaaagttaaggtaaaaagtttttattagttttagttttgctgtttattagtttgtttatgcaatagtgttaagttgtcatcaatttaaaataatgagttacaagatattgtttgcaagcttcatgataacctcaaatctaaaaacatacaacagataaaataaaaagcaagacatgaaacatacctccagagaaaatcaccttccctaaaaggaacacaggaaggaagaaaagaaggaagagaagaccgcaaaaaaccagaaaacaaataacgaaatgtcccgagtaagtccctacttagtaataacattgaatacaaatggactaaaccctccaatcaaaagacataggtggctgaacagattaaaaagaaagactcaattatctgctgcctacaagtaacacatttcacctataaagacacacatagactgaaaataaagagatgggaaatgatatttaatgccgatggaaaccaaaaaagaggaggagtagctatacttatatcagacaaaatagatttcaagacaaaatctataaaaagagacagagtcattatataataataaaagagtcaattcagcaagaggatataacaattgtaagtatatatgcagtcaacaccagagcacccagacatataaagcaaatattattagagctaaagagagagatagacccctatataataacagctagagacttcaacaccctcctttctgtattgggtagatcttcaagacacaaaatcaacaaagaaacagcagacttaatttgcattatagaccaaaagggcctaaaggatatttacagaaaatttcatccaatggctgaagaacacacactcttctctttagcacatggatcattcacaagaataggccatatgttaggtcacaaaaaagtcttaaaacagtcaaaaaattgaaattatagcaagcatcttctctgaccacaacagaataaaactagaaattaataacgagaaactttggaaattatatgaagacatggaaattaaacaatatgctcctgaatgaccagttggtcatgaagagattaagaaggaaattgaaatatttttgaaacaaacaatatgcagacacagctaccaaaacctgtgggatacagtgagcaatactaagagggaagtttatagctataagcgcctacatcaaaaaagaagaaaaacttcaaataaacattctaatgacacactttaaaggactgaaaaaaccaagagcaaaccaatcccataattggtagaagagaagaaataataaagattggagcagaaatgagtgaaagtgaaacaaataatgcaaaagatcagtgaaataaaagctttttgaaaaataaacaaaattaacaaaccattagcaaaaataagaaaaaatgagagaagacccaaataaataaaatcaagagatgaaaaaggagacattacaaccaataccagagaaatacaaaggataattagagcctataacgagcaactatatgccaataaattggaaaacccagaagacatggataaattcctacacacgtacaaactaccaagattgaaccatgaagaaatccagaacctgaacagaccattgacaagtaacaagatagaagctgtaataaaaagtccccaagcaaagaaaagcccttgacctgatggctgtactgctgaattttatcaattttatcaaacatttacagaagaactaataccaatcctactcaaaccattccagaaaaatagaagcagagggaataattctaaactcattctacaaggctgatattaccctgataccaaagccagataaagacacatcaaaaacaagaaaactataggtgaatattcctaataaacattgatggaaaattcctcaacaaattattggcaaaccaaattcgacaacacattacaaagatcattcatcctgaccaagtgggatttatcccagggatgcaagaatggttcaaaatatgcaaataaatcagtgtgacacctcataacaacagaatgaagaacaaaaagcatatgattattttaattaatgctgtaaaagcatttgataaaattcaacattccttcatgattaaaactctcaaaaaactgggtatagaaggagcatacctcaatacaataaaagccatatatgacagacccacaactagtatcatattgaatggagaaaaactgaaagccttttctttaagatccagaacagagcaaggatgccactgttaccactgccattcaacatagtactggaagtcctagctagagcaatcagatgagagaaataaagggcacccaaatagaaaatgaagtcaaataattcttgtttgaagatgatatgatcttatatttggaaaaacctaaagactccaccaaaaacaaaaacaaaaaaaactatcagctaaacaaattcagtaaagttgcaggatacaaaatcaacatataaaaatcagtagcatttctatatgccaacagtgaacaatctgaaaaagaaatcaagaaagtaatcctgtttataatagctacaaataaaattaaatacctaggaattaaccgaaggaatgaaagatctctacaatgaaaattataaaatattgatgcaagaaattgaaaaggacacaaaaaaatggaaagatattctatgttcatgagttggaagaatcaatgttgtcaaaatgtttatactatcgaaagccatctacagattcagtgcaatcctatccaaataccaatgacattcttcacagaaatagaacaaagaatcttaaatttatatatatatatgtgtgtgtgtgtgtgtgtgtgtgtatatatatatatggaaccacaaaagatgcagaatagctaaagctgtcctgaccaaaaagaacaaaactgtagaaaccacattacctgacttcaaattatattacagagctatagtcactaaaacagcatgagactgacataaaaacagattttaagccccttatatattctggttatttattaatcccataaagaccaatggaacagaatagagaacccagaaacaaattcattcatctgtagtgaactcatgtttgacaaagatgccaaaaccatacattgggaaaaggacgatctcctcttcagtaaatggtgctaggaaaactggatagccatatgcagaagaatgaaactagaccactatctcttgccatatatgaaaatcaaatcaaaatggactaaagacttcaatctaagacctcaaactatgaaactgctacaagaaaacattggggaaactctccagggcattgaactgggcaaagacttcttgagcaatacccacaagcacaggcaatctaagcaaacatagacaaatgggatcacatcaagttaaaaagtttctgtacaatgaaggaaacaatcaacaaagtgaagagacaacccacaggaagaatgggagaaaatatctgtaagctacccatatcacaagggattaataaataaacagaatatacagagctcaaacaactctataggaaaaaaaaatagtaatccaattaaaaaataggcaaaagacttgaacagatatttctcaaaagaagacatataaatggcaaaataagtatattaaaaggtgctcaacatcactgatcatcagagaaatgcaaatcaaaaccacaatgagatattatctcaccccagttaaaacgatttttattcaaaagacaggcaatagcaaatgctggaaaggatgtagagaaaaggaaattctcatacacagttggtgggaatttaaagtagtacagccactgtagagaacagtttggaggttcctcaaaaaactaaaaatagagcttacatatgatccagcaatcccactgctaggtgtataccccaaagaaagaaagtcaatatatcaaagagatgtctgcactctcatgtttattgcagcactgttcacaatagccaatatttggaagcaacctaagtgtccatcaatggataaagaaaatgtggtacatgtacacaatggagtactattcagtcacaaaaaagaatgagattctgttgtttgcaataacatagatgcaactgaggttgttatgttaagtgaaatatgctaggcaccgaaggacaaactttgcatgttctcacttatttgtgggagctaaaaattaaaacaattcaactcatggagatagagagtagaaggacgcttaccagaggctgggaagggtagtagggggtgcagagggaagtggggatggctaatgggtacaaaaaaagttagaaagaatgaacaagatctagtatttgatagcacgacagggtgtctatagtcaatcatcatttaattgtacattttttaaaaactaaaagagtataattggattgtttgtaacacaaaggataaatgcttgaagtcatggatactctatttaccccattgtgattattacacattgtatgcctacatcaaaatatcccatataccccataaatatatgtacctatgtaccacaaaaattaaaaattaaagttaaaaacccccaaatcatcatggctatcaggcccagagccaggtcgtggaaatgttacagaacaactcagccaggctcagcatctctgcccacacacatcttcccttttggtgctcttccagaaattaacttgtgaattcaacaacaaccatgagtcactcgacgaggagctgcacctcctcatcatatcctgcaggaagttgttttacttcaaaatctgggctttccttgatgttagttttgtggagcggatcctgaagagtcagaaagaacggcagtgtgccctgcgtgtattcaaggtaagaggtccccaggctggttccacggcgtagagtgggggcatccaggaatggtgcttctgctctggaacgaagggctgaataaggcagtgggggacaatcatctgttcattgaaaatcagcagtttcaaagaagggaatctggagctctcttttctagtagttgggtttggtctttttctgattctgccaacatattttcctgattcaacaactgtatgtgtagatcatttaagttgctgtcaagccctgaaaagtgtagtcaccgtgtgtgtgtgtgtatgtgtgtgtgtgtgtgcgtgtgtgcgtgctcatatgtggatgtatttctctgttggcacaggcgagaatttatacaaacagatatgagacgaatgaagaggacaagaccctgcaggaaatttacaggaagtacagaaagctgatcgaatcagagcttagctattttgtcatcgtttactctgtgatgtaatgagcactctacagatgaagaaagctgggagcactttgaacttgaaaatcatttctcttagaactacacttgggcactgccggcccttttgctcctctctctcccctccactttttttttttgtcagctccatgacaacatgaccagctcagcaaaggctgagactgcccatgacctgaaggctccaggtggctttaaagcgctatgtttaccaactatcccggtgtcatttctctttttgtcagttttgctttttgacaccctcactcgtccacagagctaaaaacccaaagccactcagagtagcttcctttttttttttttgagatgtgttgacgaaaagagtcaaactctgtaaaatatttttagagatttattctgagccaaatatgagtgaccatggcctgtgatacagccctcaggaggtcctgagaacatgtgcccaaggtgattggggtacagcttgcttttatatattttaggaggcaagagacatcaatcaaatagatttaagaaatatattggtttgattcagaaaggcggggcaacaaagcaggggcttccagggtataggtaaatttaaacattttctggttgacaattggttgagtttatctgaagacctgggatcaacagaaaagaaatgtttgggatgagataaaggattgtggagaccaagttttactgcgcaaaggaagctctcagatagcagacttcagagagagcaggttgtaaaatgtttcttattggaattagaacggtccctggctcttagttgattatctcctggaaccagaaaggaaggaaggaaaacaaaggggagaggagattctctacagaatatggatttttcccacaagagactttgcagggcaatttcaaagtatggcaagaaaatatattttgggataaaacattttgattttcttccttgttatgccagagtcagattggaaagtcactatatacagggttaactaaaacccatctaattagaatttatggcttgtagggcatgattcctcagaccccttagataggaatttgggcaagatttaaaaaaaaaaaaaatcagagcttagtcctcagacagagtctcattctgttgcccaggctagagtgcagtggtgcaatctcggctcactgcaacttctgcctctcaggttcaagcaattctcctgcctcagcctccaagtagctgggattacaggcatgcaccaccatgcccagataattttcgtattttttgtggagataaggtttcaccacgttggccaggctggtctccacctcctggcctcaaatgatccacctgccttagcctctcaaagtgctgggattacaggcgtgagccaccgcacccagccccagaatagactcttactagaggaccctgactcttgctaacctgtgcacctgaaagggtgtgtgtaaccattaagcaaatagaatcacattttctactgaccgacattatcagtttagaaatcctttgtatccactgaccttcattggggagtctgctgacattgacattgtcattgtctgggcccaatctcagatgcatagaaatctccagcctgcccttgggtgaagcaggaaaagccccacttttaggaggagtctgctcagagctggaactccctcccacagaaggaactcagcccctgacttaatggcatcgtggactcgaatctccttcctccgtttttcctgtgtctcctttatttttccacaaatatgctgagaccgggtctgtgatgttgaacatagatgtgaatggccaagtttgatggccccaaacctggcttttggagccaggtgtctggatgagtactggcctgccatgaacttgtcttgtgccttggggcaagaatttaacctccttgagtttcagcttctctgtgtgtaaacgaagaaaaaattaattacatgcattgcaacacacacacctggcccgtgttggcttttatcttgtttgatatatgaaggaacaggctctaaggaagttaacttaccccgagtcatacagccagtttgtggcagaactaataccaaagtctccagatttagaacccaagactctttcttcctcccaaacaacaaaatgagaagaacccattccctctcccttcctccacccagcttgtctcgacagttattaaagtgatcactggttgagtgtttacatgctagacataaattcacctagtttcatttaatcctcacacagctctagaaagcagagactactattatccctcttttacagggatcctgaaggattggcaagtctaacctgccctggtcacacatttaggaagttctggaagtgagtgtcaaacccaatctaattccagagctctgctcttaattcctacgtattatccccacagcaagaggatttggggtctgttgtaccgtaattctattaagtgaagagcatggttggaagagaggatcgatgataataataaattcctgagcccatgccatagacattgtattacttctggtcctttgggggttttgtgcatgcagtggcatagagttctgtttttcaatagatataaattaacaaaatctcagaacacttttaacaagtgacatttcagattttgtttgtcttgcctcttgtgtgctgtgcccatatttttgcttagctgaggttttcagaagtgagaagtgttggtgacattgtcagacaaaggatttgcagctgttatagactcaccatccaccacatggcactcacaggtagcatttattcacaaacagacctcaaggactccaaaatactgaagatttcccatggtatccagagatgatgagggaacaagggtctgtgccagcttgagcaacaggcacccgtcagtatggcttgttactgacacattaatctccatggcaacagaaagctatcctttccttaattgtaaccatcccaacaaatttgagaaatgctaactccctccaataaagagtttgtgaacctaactgaaattgtccttttaaatgccatttatgatatatggcaggcaatgggaagtattttataaatcacttgtcttctttaaggattttaaggaatatatgccggggctgacagccacagctcacacaagcctcaaaccaagctacgctgtgctccataatgactttattatgtaattggtatgaaggtaaacacagaaagaaaaagctggctcaggctttttaggtattaatgagacttcagtgtttggggtacaactaggtcaatagcattctgctacttccatttctgggctcaactagatacttttcaaagtctccattcacagctttaaggtttgtgtcttcaagacacacttattttttagggctgtaggccaaattgaaagaagccaacctggcatcttataatggtgactgtaggtttgcatgtagtaaacagggagatgtttcactatttcttctctgtcctatcagcttttctcagcccttgaggcaatgtatgtaccagaagacagcagaggttagtcaatttcttttcaaagtccagccaaagataagcatctttttttttctgcatcaatcatctggtcattttttttattatactttaagttctagggtacatgtgcacaatgtgcaggtttgttacatatgtatacatgtgccatgttggtgtgctgcacccattaactcatcatttaggatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacagaacgggagaaaatttttgcaatctactcatctgacaaaggactaatatccagaatctacaaagaactcaaacaaatttacaagaaaaaaacaaacaaccccaccaaaaagtgggtgaaggatatgaaaagattagcatctttaagcctctgtcacaccactgcactccagcctgagcaacagagcgagaccccatctctactacaaataaacaataggtaaaacaaaaataagcctctacacttcttgacttcttcctccaatactcttttggaattgcttttggcaaagtgtcattgggggctgcctaattgccaaatctacaggatgcttttcctttcttagctgactttctggagccttcgacctgctgacccagtgccttaaaaagtggcacccgtgacagccatgctgtcctggcttcctccagcccctgggatgtctcgctcaacctgagagtgttggtgcttctcagggctcagcccctccatggcttctaccaccacctgtctgcagatgtctcccagccctcttgctatagccagacctctctccacccacgggctcctcataattagcgagagagcttgcctccttagctctcccaccctcacccttattttattttattattattttttaagacaagagtcttgctctattgcccaggctggagtgcagtggcactatctcagctcactgcaacctctacctcccagcttcaagcgattctcttgcctcagcctcctgagtagctgagatcaaggcacccgccaccatgtccggctaatttttgtatttttagtagagatggggtttcaccatgttagccaggctggtctcgaactgatctcaagtgatccatccacttcagcctcccaaagtgctaggattacaggtgtgagccaccatgcccggccttcaccctcattttagaagccctccttctcctacattccctctcagcattccactcaccctgctactcaaggcagaaacctgggagccaccctagatccctccctgtccctcaccctgtataacaaatcagtctccaagccacttagcccctagacgtttctggactctgtcccttcttcactatttctatattcatgtcttaactcagtctctcttatgtctacctggattgctgggcctcctacattgccttcaggcctccaggtccaatctctgcccagcctccagccctcagccccatctacacttgcctaaaagcaccctgctctttcaagcatcggtttcttccttcccatcttcctggaatgtccttcctacctttttcctcagctactgaatttctgctcatgttccatagcaggtgctcaccaattggtaatggctgtttcagacaggctcattgtcatccttcctgtctcagtttaggcggctcctcttccaggaagttgttcctgatccccaaggctgttctcacagctatcatggttattgtcgcttcacctccctccccactacacctgctacatgataggtgctcaataaatgtgggatatattattttgaaatttgtacttttctgtggtcccagctactcaggaggctgaggaaggaggatcacctgagcctggggaggtcgagcctgcagtgagtcctgatcatgcttctgaactccagattgggtgacagagcaagattctgtcaaaagagaaagaaaaagaaagaaagaaaggaaagagaaagaaagaaagaaagaaagaaagagagagagagagagagagaaagaaagaaagaaagaaagaaagaaagaaagaaagaaagaaaaagaagaaggaaggaagggagggagggaaagaaagaagaaaaagaaagaaagagagagagaaagaaagaaagaaagaagaaaggaaggaaagaaaaagaaagaaagaaagaaaggaaagaaagagaaagaaaaagaaagaaagagggagaaaggtaatttgtactttttatttttatttttttctttttttgagacagtttcactctgctagaacgcagtggcgtgatctcagctcactgcaacctctgcctcctgggttcaagtgattctcttgcttcagcctagcgagtagctgggattacaggagccaccaccacgcctggctaatttttgtaattttagcagaaacggggtttcaccatgttgtccaggctggtctcaaactcctgacatcaggtggtccacccacctcagcctcccaaagtgctgagattgcaggcatgagccaccgtgcctggacaaatttggactttttaaagccctggtactacttttcaatatttactcttagttcaaagagttagttctcaaaatattggaaactaactcatttaagaagaaactgggtaccatttaatgggaacccactacatcaggcactgtacataccataactcattttatcttcacaacatcctggcaagaagaatgttcttcatctgatttacagaccaagaaaaggaagatcagataaataacttccctgaagcctcacagccactttgtgcagagcaggaatttgaatctcaccctctcctttcactgccccacactctctgctgttgcagaggtggtatcctggcaagacgctgactcagcctttctaggaaatggtgatttggaacttgacaatgatctttcaaaaacttcagtcttaaattaggcagttacctgctgatctgatacgtagaaacccctgcctagaaaggtgcccttgggatgtatctacacttgctaagaggaagaaatttccctgacatgcattggtcaattggaaaccccaagaatctcactagcctcctctatcccagggcctgggatggcaaagtgctacaccagaaaagggctatgtggatcacaaggacagtgtaggcctcatgactctgagataacagaacagaggcacagagaggctaagcaacttaccttaggtcacacagtaagaggaagagtgagccaggatttgaaccctcgtgtatctgacataaaggccagcatcccatctataaaatggggctagtaatcataccagcctcttcaggtttttgtaaagatttgatgagaaaatatacgagaagtcactttatgaactgtggatcacagctgagtgtgacacgtcatcactattgtcgcccatcagtcaattatctgggatagcctgaggttgtgtcatacctacataagccacagaaaaatagactcatgaaagaatcagggctgggcatgaatgaacgagaaactacatttaaatggagcccagactgcacgggaaccaaagtggggttctaataccattgggttgattacctatggcagaaacagcccaagcaaatatgtgaccaaatgctaacatcacacctaaatgtctaagctgttctgtaattttgaacattaatctgttttcaggggatgatccagggaaaagaatgaatcaagccattgctgtggtatttggaccagtggccacttgccattgacttggtgagaacgaggatgcagatttacttttcatgctcttaggagtataagtctaggatctgggtccactctgaggaatctttcctctccactcccactggctattaggaatcttaggaaccaataagctagaaacttgactgtttatactttcctcatttgtttcagtggattaaggtacctaattgttccataacaccctacggtttctaactggctttcatttaacattgacaccgttaatgccaccacgcaagaatgaactgtttacttgcctgagaaattgcatgtgggatttaaaactttttctaagattcattttttcaactgatgatctctcaggagtattttctggtggtgtttgagacagtgactgatgttggcattttcccagggtgtggaagcccccaagtttaaagcccagctgactccgtgtgccagatcttcacacaagaaggaccagtgatataaggggttctccaattataaaattaacaactgggagggataaaaaaatcgcaccactaactttggagaattagctgagaaaaattttacgtagaggaaaaaagacttggaaaattgtcttctgaattaaacatattagtcttcttcaggtagcagcaaatagaacaattgattgtgaccgagtgcctttctttctttctttctttcttttttttttttttttttttttttttgagatggaggtttgctctttgttgcccaggctggaatgcagtggtatgatctcagctcactgaaacctctgcctcctgggttcaagcgattctcctgtctcagcctcccaagtagctgggattacaggcacccaccaccacacccggataatttttgtatttttttttttagtagagatggtgtttcaccatgttggccaggctggtctcgaattcctgaccttggtgatccacccatcgtgggctcccaaagtgctgggattacaggcatgagccaccacaccaggcctccaagtacctttcttatggaccaagttcatttccaatattttagcagtggcgttaggtagactgtatatgatgattctcctaaataaggttattctctttctgttaaatatggttttcattgatttatggatgtatctggaactattattttggcaggttttacaaggcctcagaatcggttcggatgcaggaactgtgtttgacgtttatgtcgaagttctcatcaaagcctggaaaatgtggagcctcttttgcaagagtggagattgttgcctttaagccagatcttaaacactgttagctcattgtgaaaaacacaagtgccagtgattaacaaagaatgtttacttaatttacttcagatctggtctcagttaaaggttagctcatccttatcaggtggtcacagaaactagatcccagtagcagagtgacctttggaagctagaattgtagtcaatggacttaaagtgagatcgtgggagccagttcttcacttaattaagcagagttgaaagactttcttctttccagctccctattttccttccttgggctattttctgtaagtcagacttggtttgcctcaatactacatatgccctgtaaaaataaattaactacaagagactgttgactgtatggccaccagccctgccctggtgtgtgtcctttgcaacactagtgtctgaggtggagccctccattcctcgtgtttttcatccactccccctttccttcctctcccccgccagtagaggactgtttgcgcaagagaccaatggattagccagcaggtctaagcagctgcaaggataggtctctcttttgcccgggggagagagataccagcttgactcgtgatcaggtactttattccttatgatagggagctcagaatccagcatcagtgttcctattaatttcttgttagttttgtagctttgggtatctgcacttgtcaacagtaggctgtaagaatatttattggaaaccacaaaaatctcactagcctcctctatcccggagcctgggatggcaaagtgctacaccagaaaagggctatgtggatcacaaggacagtgtaggcctcatgactctgagataacagaacagaggcacagagaggctaagcaacttaccctaggtcacacagtaagaggaagagtgagccaggatttgaaccttggtgtgtctgacataaaggccagcatcccatctataaaatggagctagtaatcataccagcctcttcaggtttttgtaaagatttgatgagaaaatatacaagaagtcactttatgaactgtggatcacagccaagtgtgacaggtcatcactattgttgcccatcagtcaattatctgggatggcctgaggttgtgtcatacctacataagccacagaaaaattgactcatgaaagaatcagggctgggcatgaatgaatgagaaactacgtttaaatggagcccagactgaacgggaaccaaatgtgggttctaatgccattactcattactgttacccaaatatgatcctgctcccctgggagggtggctctgaccttgtcactcccaagcctggcacccccagagcatgctagagtggtggtggagggcaaagatgacaagacatggactctctgggttagggtgagtggcaggcaacagaatccacagaatagagaagtacctagattgggtactctgggagaaaaacaaccttccggagattttcccagtgtgccaaatcctgtgctacccgagagaattcccactcatcactgccaaatgaaccacggaagagacagaaactttgctcctgtgtttcttttaattatgtggattacagacacgttcaactttggttctatgttaagaaaattcaagtttaaatgactcccaatttaagtgatggtatttaaaaataaattttgtgttatctaagacaaaaattgtactttgtcttaaaaagatatctggcttggatgggtcagaggggtacggaacagggtggccttcatcagtagctacaaaggcttttgcaaccgtgggctaattgcaaatgtccttcatgaaacacaggctaagaccagatttcatttgtgaaacacattgatacccaataagacctaggaattgcatgagcagatttactaacaaaacattgctttattgaaatcttagatgtttccgcattttatgtctacatgttgagaaatggcctcaaccataatcaaaatcacatttcccttaaaagcagcatgttccagacactgtgttgagagtcttccacacgttatctcgccaatctaggctttattagtcttatttacagattaggcaactgaagctcggggaagttgagtaacttggcggggatcacatcacaggtagagcgtggagctgatccaccagctgatctgaatcacatctccctgcagagcctgggatctgaatccaccactgaggctggctgcctctgagagctgtattcacaaggaaggattttgcccagtgtcttcacaccctgccagccacatcctctgggacagacctcaaaaccctgctaagttagcagaaactctgaggtctgcccagtgagctgggaaggcttatttggactcttccgagccagagcagaaaagcacccagaggcttcccagtgagcagagaggggcctccctccttgattgaggcatgggaagggctgtgtatttgctgagcactctgagaggagacgttcagcactggggtggcatagatcagaattaacagaattaagccagtgcttttggcctcaaagggggtttctccatcccagattgggaacatccctttctgatggcaaagagtctctggaccaaggagcacctagattgcaaagctcccaggaattaggcccacactctgcattatcattgtgccctatgacaccgtatgtgcagctagacagccagattcagggaacagcaaggacaggaagagttccagacgatatagtcctttccttactttacaggtggtcctaaagaaggagagaaactttcctggcagtgttgcaactagaagctaggtctcctgagccccacaccgtcagctgtccatgagcaccggggaaccaaatgttagcagagtgtagcagcagcttcacacatgggagggtgctgagatggtaagcctcgtccatggaaagtgttccttcaatgttagcggaataaggaacaaatgagcagtttcccacagcaaatgtcttcctttgacagtcacccacatagatctctgacctgctgcagctcagcggaaggcagcctcccacaagttgaactctttttggaaaagaaacagtaagtatataaaacagtcttgctgaaaacttgtaaagaggtacgtaaccattaaaataattataaagacaatttagcaacatgaacaaaggcttgcaataattagcagtgaaggaaaaaaataatcctgaaattgagtttatgccatgagtacaattgtgcagaaattatgttggtatagggtgggactgctcacaatggctcacattcattaaacactcactgccccatgatacaggctcagtatgaagccctttacggaggtgatctcattcaacgcccctatagccctgtgagtggggactattggaggtcctatactcagatggcagactccggaacctacagtcttaaccattgacttgaacccattgacttgaatgaatggaattttgttctttttctttatgttatttgagtatttaagagaaaaaaaacacattattttctagagaaaagaaattttgagagccaagagaaaggttagcatcccatctcatgagcaagaggggcatggtctacacaggtgatccagcccaactactttattgaattgaatctgaactgaaatgtcttgaaaccctgtcctggggccccaagtcctgtgatattgtaagagtggcctgtgctaaaatatggagttgaattgttaggcaaacaccacaccagcataagagaagaaactcgccccaaaatcagccccctgagcaggcttggaatgccagccaagaggttgcagcaggctggctagaggccccgccagcctgaaatgagagctctgtactactgtaactactgtttacaatgtggtttaatgagaattggaactagccctactattagcagacagcatcagggcggaggcccccagcccagaccccatggtcttccccatcccgaagtgggatggatttcctcatctgcatacacagcacttcgtcgatataaatggtgttctctttgacctggatctcctcctgcagggcaagctgtctgcgatgcagccctttcagctctgcctgagcttgggctaaagtttccttcaatctaggagaaagggaagaagagaagagaataatttctctctatgcattgctttttcaagggaaagaatgttccccagtgttcagtgcaggagccaaattgatatgtgctcttccccttcctctctcctcatgaagacagagatctcactaattttagaataaaatgcatactgaaaaggccatgaaaaaaagaaaaagacagagatttcaatttggcggccacaggccagattcatgacgtagacaccttatgaaatgctgatgtttaaaactgcagatttgacctaaacatctggatttgggcttctttagaatcactcaatattgggatccattttctccaaggcaacaattttggcgggaggtggtggagacttccctctagggggcattcctcaagcattccagagcaggctggcttcattcacgctgctggtcactatctagcctctgcttgatatccaggttgggattgagacccgaaggccctctgcccactggctgctagcctaccttgcgacattgtgggtgatctcttgaacctccttcattagcctatattgtgcgacatcacgacacagctccacgttcggccggtgtgtcctggtctccaagcgcgtatgagccaccttggctggcccttcttggtcaaggatggccttttcaagagctgtaatatttttctcctgggaagcaatctcttccatgaccttacaaaaaggattagagtaggtgaggccaagctgtgctcctcaaaactcaacagctgacagcagatgggttgtgatcatgtaagttaggaagagggaacctcagatttcttcttaagcagcatgccagagtctgatctctcttccctaaagcagtgattgctggtgggcaaggtcacataagacttaaaaccttatggactcaagggacaggacgggccattgtcacctcatctacccacaggagatgccctcagcaaaggcctggccagagtggggatctcactactgctcaaagctgcctgctcaccttggtacagggtacctttgtatcatgagcagaaagctgcctatttcctcaccactcctatcctgctagcaccagctctgtcctctggaagcctgaggaaagaaggagcagttgggtctgagtttggttgttatttttgtgagtgactttatgcacagaaaaagactacttttaggccagatgtggtggctcacagctgtaatcacagcactttgggaggctgaggagggaagatcacgaggttaggagttcgagaccagcctgccaacacggtgaaacccccaactctactaaaaatacaaaaattagccgggtgttgtggcacacacctgtaatcccagatactcaggaggctgaggcaggagaattgcttgaacccaggaggcggaggttgcagtgagccaagatcgtgccactgcactccagcttgggggacagagtgagactccgcctcagaaaaaaaagaaaagaaaagaaaaagactacttttaagttacttggttttaacaaaattaatatttaactggtttaaaatatatttcttcattaagcattttttttaaaacttgtacatctacttttgcaatatacacaaaagtagatagactaaggaacctcgcatagtcatcagcagtttcagcaatgagcagtatgtggccagtcttgcttcatctatactcctgtccatcagcttagttattttaaaactaatcccagatattatgtccttttagttaaatatttcacttaaatatttgagtgtgtatttctaagcataggattctttattttcttttgacaaaaccacaatacctttatcacaccaaaaaagagacaaaagacttattctttaacattataataatatttagtgatcacatttcaccaattgttccatatattttggtagagttggtttgtccaaattacatcccaatgaggtccagaaattgcacttggctttcttaagcttctatttaaacacttcttaaggttttcataagtccggttcacagatatactatttttaaatttagcagatattagcaattactttaagctgctttcgactaataattgctcctacttcaaacttacttaaagtcctttgaatatttatttaaagcagcatttataaatttgatacataactttttaaaatatttgaattatcttttttttttggcctggaattttatttatttatttttttaaggtgaattttatttttttatttttttattatactttaagttttagggtacatgtgcacaacgtgcaggtttgttacatatgtatacatgtgccatgttggtgtgctgcacccattaactcatcatttagcattagttatatctcctaatgctatccctcccccctcccccaaccccacaacaggccctggtgtgtgatgttccccttcctgtgtccatgtgttctcattgttcagttcccacctatgagtgagaacatgcggtgtttggttttttgtctttgcgatagtttgctgagaatgatggtttagaacttcatccatgtccctgcaatggctgcatagtattccatggtgtatatgtgccacattttcttaatccattctatcgttgttggacatttgggttggttccaagtctttgctattgtgaatagtgccacaataaacatacgtgtgcatgtgtccttatagcagcattatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtctctcactgtggttttgatttgcatttctctgatggccagtgatgacgagcattttttcgtgtgtcttttggctgcataaatatcttcttttgagaagtgtctgttcatatcctttgcccactttttaatggggttgtttgtttttttcttgtaaatttgttggagttcattctagattctggatattagccctttgtcagatgagtagactgcaaaaattttcttccattctgcaggttgcctgtttactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccactttgaattgatttttgtataaggtgtaaggaagggatccagtttcagctttctacatatggctagccagttttcccagcaccatttattaaatagggaatcctttccccatttcttgtttttgtcaggtttgtcaaagatcagatggttgtagatatgcggcagtatttctgagggctctgttctgttccattggtctacatctctgttttggtacaagtaccatgctgttttggttactggagccttgtagtatagtttgaagtcaggtagcgtgatgcctccagctttgttcttttggcttaggattgacttggcaatgccagcccttttttggttccatatggactttaaagtagttttttccaattcagtgaagaaagtcattggtagcttgatggggatggcattgaatctataaattaccttgggcagtatggccattttcataatattgattcttcctacccatgagcatggaatgttcttccatttgtttgtatcctcttttatttcattgagcagtggtttgtagttctccttgaagaggtccttcacatcccttgtaaattggattcctaggtattttattctctttgaagcaattgtgaatgggagttcactcatgatttggctctctgtttgtctgttattggtgtatacgaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgtttccagtgtttgcccattcagtatgatattggctgtgggtttcttatagatagctcttattattttgagatatgtcccatcaatacctaatttattgagagtttttagcatgaagcgttgttgaattttgtcaaaggccttttctgcatctattgagataatcatatggtttttgtcattggttctgtttatatgctggattatgtttattgatttgcatatgttgaaccagccttgcatcccagggatgaagcccacttgatcatggtggataagctttttgatgtgctgctggattcagtttgccagtattttattgaggatttttgcatcaatgttcatcagggatattggtctaaaattctctctttttttgttgtgtctctgcctggctttggtatcaggatggtgctggcctcataaaatgagttagggaggattccatctttttctattgattggaatagtttcagaaggaatgataccagctcctccttgtacctctggtagaattcggctgggaatccgtatggtcctggaattttttttggttggtaagctattaactattgcctcaatttcagagcctgttattggtctattcagagattcaacttcttcctggtttagtcttgggagggtttatgtgtcgaggagtttatccatgtcttctagattttctagtttatttgtgtagaggtgtttatagtattctctgctggtaatttgtatttctgtgggatcggtggtgatatcccccttatcattttttattgcttctatttgattcttctctcttttcttctttattcatcttgctagcggtctatcaattttgttgatcttttcaaaaaaccagctcctggattcattgattttttttgaagggttttttgtgtctctatttccttcagttctgctctgatcttagttatttcttgccttctgctagcttttgaatgtgtttgctcttgcttctctagttcttctaattgtgatgttagggtgtaaattttagatctttcctgctttctcttgtgggcatttagtgctataaaattccctctacacactgcttcgaatgtgtcccagagattctggtatgttgtgtctttgttctcattggtttcaaagaacatctttatttctgtcttcattttgttatgtacccagtagtcattcaggagcaggttgttcagtttccatgtagttgagtggttttgagtgagtttcttaatcctgagttctagtttgattgcactgtggtctgagagacagtttgttatgatgtcctttcttttacatttgctgaggagtgctttacttccaactttgtggtcaattttggaataagtgcggtgtggtgctgagaagaatgtatattctgttgatttggggtggagagttctgtagatgtctattaggtctgcttggtgcagagctgagttcaattcctggatatccttgttaactttctgtctcgttgatctgtctaatgttgacagtggggtggtaaagtctcccattattattgtgtgggagtctaagtctctttgtaggtctctaaggacttgctttatgaatctgggtgctcctgtattgactgcatatatatttaggatagttagctcttcttgttgaattgatccctttaccattatgtaatgccctcctttgtctcttttgatctttgttggtttaaagtctgttttatcagagactaggattgcaacccctgcctttttttgttttccatttgcttggtagatcttcttccatccctttattttgagcctatgtgtgtctctgcacatgagatgggtttcctgaatacagcacactgatgggtcttgactctttatccaatttgccagtctgagtcttttaattggagcatttagcccatttacatttaaggttaatattgttatgtgtgaatttgatcctgtcattatgatgttagctgattattttgctcatgagttgatgcagtttcttcctagcgtcgatggtctttacaatttggcatgtttttgcagcggctggtaccagttgttcctttccatgtttagtgcttccttcaggagctcttgcaaggcaggcctgatggtgacaaaatctctcagcatttgcttgtctgtaaaggattttatttttccttcacttataatgcttagtttggctggatatgaaattctgggttgaaatttcttttctttaagaatgttgaatatcggcccccactctcttctggcttgtagagtttctgctgagagatcagctgttagtctgatgggcttccctttgtgggtaacccaacctttctctctggctgcccttaacattttttccttcatttcaactttggtgaatctgacaattatgtgtcttggagttgctcttctcaaggagtatctttgtggcattctctgtatttcctgaatttgaatgttggcctgccttgctagattggggaagttctcctggataatatactgcagagtgttttccaacttggttccattctccccatcactttcaggtacaccaatcagatgtagatttggtcttttcacatagtcccatatttcttggaggctttgttcgtttcttttcattcttttttctctaaacttctcttctcacttaatttcattcatttgatcttccatcactgataccctttcttccagttgatcgaattggctactgaggcttgtgcattcgtcacgtagttctcgtgccttggttttcagctccatcaggtcctttaaggacttctctgcattggttattctagttagccattcatctaattttttttcaaggtttttaacttctttgccatgggttcgaacttcctcctttagctcagagtagtttgatcatctgaagccttcttctctcaacttgtcaaagtcattctccattaagctttgttccattgctggtgaggagctgcattcctttggaggaggagaggcactctgatttttagagtttccagttttactgctctgttttttccccatctttgtggttttatctacctttggtctttgatgatggtgacgtacagatagggttttggtgtggatgtcctttctgtttgttagtttttcttctaacagtcaggaccctcagctgcagttctgttggagtttgctggaggtccactccaaaccctgtttgcctgggtatcagctgcggaggctgcagaacagcggatattggtgaacggcaaatgttgctgcctgattgttcctctggaagttttgtttcagaggagtacccagccgtgtgaggtgtcagtctgcccctactggggggtgcctcccagttaggctactcgggggtcagggacccacttgaggaggcagtctgtccgttctcagatctccagctgcatgctgggagaaccactactctcttcaaagctgtcggacagggacatttaagtctgcagaggattctgctgccttttgtttggcagtaccctcccccagaggtggagtctacagaggcaggcaggcctccttgagctgcagtgggctccacccagttcgagcttcagggctgctttgtttacctactcaagcctcagcaatgacaggcacctctccgccagcctggctgccaccttgcaatttgatctcagactgctgtgctagcagtgagcgaggctccgtgggtgtaggaccctccaagccatgtgcgggatataatctcctggtgtgccgtttgctaagaccgttgggaaagcgcagtattagggtggaagtgacctgattttccaggtgccatctgtcacccctttctttgactaggaaagggaattccctgaccccttgcacttcccgggtgaggcaatgcctcaccgtgcttcggcttatgcttggtgcgctgcacccactgtcctgcacccactttccgacactccccagtgagatgaacctggtacctcagttggaaacgcagaaatcacccatcttctgcgtcgctcacgctgggagctgtaggctggagctgttcctatttgaccatcttggctccacccctatttaaattatcttaacaaataagaccttctggagttcttaaatagatttgtcaatctaacaaattagtaaaaaaagatgatgctttaaattttcttaaatattcgaatgctatcttcaaatttaaagtttcaactaaaatcataaggctaaaacaattatttaattatatattttaaagaaatttttaaaaaacaggccaaatctcttaaattttacaaataccttaaccatccaaaatacatagatagcaatacacttataataaaactactactgctatgagtgagatcaagaatcagcaaactatggcctataaactaaatccagtctgcaacctgtttttgtacagactgtgaaataagattttttttaagtaataatcttcaatttctttagagctgttttaagtttaaagaaaaattgagcagaaagtagaattcccatatgctttctccccccatccaggttttccttattattagcatcttccattagtgtggtacacttgttattaatacaattgatgagccaatattgatatattattattaactaaagtccacaatttacattagggttcactctttgtgttgtacaatctatgagttttgtttgtttgtttgcttttgttttttatggagtcttactctgtcacccaggctggatagcaatggcatgatctcagctcactgcaacctctgcctcctaggttcaagcaattctcctgcctcagcctcccaaatagctgggattacaggcaggcgccaccacagccagctaatttttgtatttttagtagagacagggtttcgctgtgttggccaagctggtcttgaacctctgacctcaggtgatccacccgcctcagcctcccaaagtgctaggattacaggcatgagccaccgcgcccagccgattctatgggttttgacagatgtataactacatgtatccactttacaatatcatacagaatatgttttgctgccctagaacacccctgggctgcttccattgatccttccttccttcttccacccacccaaacccctgacaaccgctgatctttttcatctccatagttttgtcttttctagaatgtcatatagttggacttatgattcatatcatacagtatgagtttcaaatcagcttctttaacttagcaatacgcatttaaagttcctctatgtcttttcatggcttgatagctcacgcctttttagtgctgaataatatttcattgtctggatgtaccacagtttatccatccattcacctatcttagctgtttgcaagttttggcaatcatgaataaagctgctatagacattcatacacaggtttttgtatgaacataagttttcagcccatctgggcaaataccaaggaaggagattgctgaatcctaagagtatatgtttagccttgtaagaaactgccaccctctcttccaaaggggctgtaccattttgcattctcatcatcaatgaatgagagttcctgttgctccacatcctcaccagcatttgggggtgtcagtgctttggattttctgtaggtgccgaggtgttgttgttttaatttgcaattccctaatgacataggatgttgagcatcttttcgtatgcttacttgccctctgtatatctgtattggtgaggtgtctgtttagagcttttgttcatttttgtagttggtctgttttcccattgttgaattttaagagttctttgtacgttttggataacaattctttatcagatatgtattttgcaagtattttatcccagtgtgtggtttgtcttttcattgtcttagggatttttaaattttaaatggttggggagaaaaataaaagcagaatatcgtcatgtgaaaattacataaaattatatttttaatgcccataaataaagctgtattgaaacacagccatgcttattcatttattattgcttctgaactaccatggcagaattaagtcatggtgacacactgtatgtgatgttctcacggctttgcactgttgcccagagcactataaatcacagtgacatgtatataacttgacagttttccaaccatgtatcaccatacagtgacatcttactattttatttttatgcattttttttgagatggagtttcgctcttattgcccaggctggagcacaatggcacaatctcggctcactgcaacctctgtctcccaggttcaagcgattctcctgcctcagcctcccgagtagctgtgattacaggcgcctgccaccacaccaggctaattttttgtatttttagtagagacagggtttcaccctgttgcccaggctagtcgtgaactcctgacctctcaggtgatccacccaccttggcctcccaaagtgctgggattacaggcgtgagccaccacgcccggccgtgacatcttattttattgttttattaccagtatgtctttgtttctgctccttagcctcttctcttcctctcttctcttctcagtgctctcccatcctcccttctgtcctatctcagatccatctttcaaggcctatactaagttcttattccaccaggaagtctctggattattccttggctatcatcatcatcatcatcatcatcaatcaactatttttattatttatatgtatgatattatatgttaatcatatatgcaaaatgtgtgtgtgtgtgtgtgtgtgtgtgtgaaatgtatacatgccaggcactgttctaaatattttatatgagttgtctaacttaaccctggctggggaagactattgtttctccccattttatcaaggaggaaactaaggaacaggggagttcagggtctccctaaggtcacacagcaagtgttgaagccacagttcaaacccaagatgtctggctctgacgtctacccatttccactaggctcgtctacctctcggtttgctgaatattgcagtttcaccctcgatgatactctggtttctccagcacatcacagaaataaatcttgtccacaactggactctgagctctgggagggagtgttcaggatgtggcaacaggacagggattcaggggctgagaaggcctgggctccactcccaccgtgccgccttggggcccttcccctctctgtttcagcttcaccagcagtaaagcgtagggtgggctgacagtggcctgctgaaatgtgtagcttgaaatccaccaatgtgggagtatttgtactacagacatcgacaaattctacaggaaggaccctaatctgtagaatttgccgatatctgtggtacaaatgctcccactttgtatttgcagtacaaatactaaccccctctgatatggtttggctctgtgtccccacccaaatctcatcttgcattgtaatccccacatgttgagggaggaatctggtgggaggtaattggatcatgggggcagcttcccccatgctgttctcatgatagtgagagagttctcatgagatctgatggttttaaaagtggcagtttcccctgcactctttctgtctcctgctgccttgtgaagaaggtgctggcttctccttcaccttctgccacgactgtaagtttcctgaggcctccccagccatgtggaactgtaagtcaattaaacctctttcctttataaattacccagtcttgggtagctctttacggtggtgtgaaagtgactaaaacaccctctgagagccagtttaccagcgcaacactgtataaccaggagaaacgaccagctagagtcctaaagctccaaccgggtttggaaaaactggctgcatcaactcctgtaacttcagagtcctaaagggcacgtgagagcatgtagtccatttccgtacttcacatacggaggagtggcaactggagtgggaagacagccaggcacaaagctgcaaccagcccctaagcctcccgtctcctgcctcagggttctgttctctgcatttctgttctctgcagcagtgagtgacaatggaggcccagagtggggcaaagtcccgctccagtccccaaaaatgcaaagcctgctgctaagcttgagagatatgaatgacccttacccacgagttaacccaatatcccaagcccagaagtctagcggtctggcccagggggcattcttgttttccatggtgaaagctcctgaatctgctcttcttccatgctccctcaagggacctcaccttggccagatgatcagccagcttgtccctggcatcctttgtatccttcagcccattcttgaatgccgtgtccaccacatcacactgcttgcgcagatcattggctgtctgggacaggattcgatccaccagggctttcagcatcagggagttgttccgctgcttgtcagccttctccacattggtgctggagaagtccaaccagtcttccagactcacggagctgaaacagacctcacgctttcattcacagcatatttggggtggggaagggggttgggagagagggacgagctacaccttcccctcataagaaccacctagaatgttaccctatctctaggcagagcaaatagtggtctgtcagtatcaatagctgtcactttgggcaacctccctactctggcattgggctggcaccttatagacattatctcatttaatcctcatgatggccaagtgagctaacttttctaatccccattttacagatgagggaaactgagctcagaaaaatgaagtaacttgggtgagattgctcagctagagataatttgagcatcaaaataatactaatgtaatagattacactgaataaaatagaaaccatccatctatacagatttaaataaaaaagtgaataaattactcgtttgaagaggaactatcttctggaacgacactgatgaacttcaaaataatgttaattggaagaaaccagacacacacacacacacacacacacacacacacacacacacatatctagtatataatgctgtttaatgaaaagcaggcaaaaccaacctattacaagtcaggaaagttattaccttcaggatggagggagggactattgattggaagaggacaggatgatagggatggtgataatgttttctttcttgacctggtggtgatatgaggctttgttcagtttgtgattagaagcagcctctgagatggcacttagtgatcccccctcctggtattcatgcctttgtgtaatcccctcgccttgagtatgggatgaatttattgacttccttctcacaaatagaaggatgtcacttctgggattaggatataaaaaagactgtggcttctgtcatccgttctctctctctctctctctctctctctctctcggatcactcattatgggagaaaccagttgccatgtcatgggacatccccatggtgaaattcacaaggcaaggaaccaaggcccaccatcacccacaatcagcttggaattggaccccacccgggtcaagccttcagatggattgcaaccccagcagctggcttgactacagcctcagaagacatcaagcctggggcacccagttgaacagggcctggtttccccacccaaggaaccatgagataatacatgtttattgtcttaagctgcaaagttttgggataatttagtatacagcaaaagataactaacacaatgagaatgcttcaaacttgtgcacttttctatatgtatgttttatttcaaaaagaaggttttaaaaattaaagtgagttaggctgtgatataatgttaaccgaaaaatgcaaattagatgtcacagaaaaggtacatagtataatctcatttttataaactaaacaaagtttaccgtatgtgtgtgagtgcacatgtacatatgtttgtatgaacatgcagctaacaccagttatctcagtggatgtaaaaacagaaaggggaggccaggggcggtggctcacgcctgtaatcccagcactttgggaggccgaggcgggcagatcacgaggtcaggagattgagaccatcctggctaacttggtgaaaccccatctctactaaaaatacaaaaaattagccaggcatggtggcgggcgcctgtagtcccagctacttgggaggctgagacaggagaatggcgtgaacccgggagacggagcttgcagtgaggtgagatcgcgccactgcactccagcctaagtgacagagcaagactctgtctcaaaaaaaaaagggggggggaaattcacttgctcttcctacatttttagattattttacttgttaaaaacatgtatagatgaaggaataaaatgttttattctttaaaggtttaaaggttttatgtcagactttcttagttagtgagcctaacctggagaatcaggagcctctgggcccaatgtcaaggtcaccattcaatgctgcctttgccccaagcccaccacttccaagctctcagccagctgcaaggacgagccgctaggtcttgcctatctgagaagcactgggtcacccgcgaggaggaagacggcaaggcccactcactttggctcaatcctcacggcgttctcagaatatctgatgtttggtgagttgttgttgagcgagaagcagatatcatctatggtcagggccacaaacttgtccttcaaatccttctcaagattgtacttggcagagcggttcatcctgaagggagaaagtaaactgggtttctgcctctggagtgcccaggtggcacccacgtcctcagagaggtcctggaaagtgaagctgcagctaggtctggtgcaggatgatggtactgccccccacccatcaccccaacactcatgcgtataccatttgatgcccggtgacaaatcaacgtaaccaaatgtggacttggagattctcccttctactgttacattttccagtgtcaccattgcagcctactatgtgtgaggggtcagcctcaccagtgggttccagcgtcctccagtttataaccagggtgaaatccagctccagccccacccttaccagagggcggctgccatgtatgagggatgtggccagctcttaccctgagtgctggggcaatctggggacacaaagtgggagcgggaatgttgaacccctttctttctgtgccatggagcccagcttttgtggacactgccttttctcaaaattcccagtggagatttggagggcaggccgaagagtcataccgaatctgctcggaagcctcctccaaggtacgggtcagcagagccataatgccctggatgatctcagcctcctttatcagctcatgctccactgtgtcgtgcaccaggtcaatgccaatgcgcttctccctggcagggggaaaggcagccagtcagccaacacgtgcaacatgaggtgactcaacattggctaatggctgcacactcagaactatctgcacgactgatttgagtgtcacccgatccatccgatgacacagtgggtgacagatattagttggtgtctatgtgacttcaaaatatccaaacacaatgaagaaaaattgattgatgactggtcacttggtctgaaacatgccaaatggacttttttttctctctctctttttcttttctttgtattttttttaaattatactttaagttctagggtacatgtgcacaacgtgcaggtttgatacataggtatacatgtgccacattggtttgctgcacccatcaactcatcatttatattatgtatttctcctaatgctatccctcccccagccccccacaccctgacaggccccggtgtgtgatgttccctgccctttgtctaagtgttctcattgttcaattcccacctatgagtgagaacatgcagtgtttggttttctgtccttgtgatagtttgcgcagaatgatggtctccagctgcatccatgtccctgcaaaggacatgaactcttccttttttatggctgcatagtattccatggtgtatatgtgccacattttcttaatctagtctattactgatggacatttgggttggttccaagtctttgctattgtgaatagtgccacaataaacaaacgtgtgcatatgtctttatagtagcatgatttataatcctttgggtatatacccagtaatgggattgctgggtcaaatggtaattctagttctagatccttgaggaatcaccacactgtcttccacaatggttgcactaatttaccctcccaccaacagtgtaaaagcattcctatttctccacatcctctccagcatctgttgtttcctgactttttaatggttgccattctaactagcatgagatggtatctcattgtggttttgatttgcagccagatggactttttttcccaagaagaggaaagttttaaataataataataaattcaaagacttgtttccttccttgatcctcattcagtgtttagacaaacaattgaacatagaaagatgttttagggtgggcgcagtgactcacgcctgtaatcccagcattttgggaggctgaggcaggtggatcgcctgaggtcgggagttggagaccagcctggccaacatggagaaaccccgtctctactaaaaacacaaaattagccaagagtggtggtgcatgcctgtaatcctagctactcaggaggctgaggcaggagaatcatttgaacccgggaggtggaggtttcggtgggccgagattgcaccattccactccagcctgggcaacaagagcgaaactccatctcaaaaaaaattttaaaagatgtttatagtaataataactattaataataataacaccaatagtaatattgcctctgccagtgagcacttactccatgacaggcattgtgctgagctttattaatatataaacattctttcttagccctttcaagtacagatggggaaactgagtttcagagagactaagtgatctacccagtgtcacagaactgtgtgccacatgtgcttctagccaagatgccatcctcctcccaaactgaccctgctacacaacgttttgctctttttcaacctgcatgatagtgcttggaaaggaggttcccctactcactagctgggtgcccttagccactatataacctacctgtgccttggtttccttttctgtaaaatgggggtaattattagtacttcataggattgtggcacactacaaatgagctataaaagcataagctacagtacctggcacatagtacatgctcagtaaacttagcagcctctacgttatcattatcctcaggcttagacttgagccaactgggtgttgagctctttgatgagctgctatttctctttgcttcatagatttctaaatctggctggggagactgctgcctggttcctgcaacgggtcctgtttaagcttatggaaggaacagggctttccaggaagacaggggcatggtgcatttgagaaactgcaagtagctccacacacctaagcacatcccactactggggacaagatatggatccagagaggtcactgggggccctatcatgatgaaccttggtttgctaagctaagaagcttaaaatttatcttgaagccattggggtttgaaggattctaagcatggcggtgaccgggaaaaatctgcatttggaaaagttcactcaacagccagtgtgcagggtgcactagattataggggactatgctaacagcaagaagacctgttagggcactccagctaggtctgcggcagaacccaggtctggaaaccagcatcaccccagagtagaaaggatcattctattcactggatttataggagggaaataataataaaaagcactatgttcctatagtgctgtctggattacaaagtgcttccgtgtggctctgcatgggagagacatactgtcccctgggagctgtagtgtctgttctcaccttcttccttggcaacagaacccctggttttttggctgagcacctggctgcccaaagtaaaaccaatcatttcccagcatctgttggtgtggccatgtgattaagttctgtcaataggatgcaaatagaaatgatgaatgccagaccccacttactcctacttgctggaatgtagacataatggctggagctccagctgccaacttaaaccacaaggtaacattaggagtgaaagccatgtgcagtagaacaagaagatagaaaaagcctggaaccctaaaactgtggcccaccattccaaccctggactgactatctctagactctttgaatgtaagagagaaagaaatcgttttctttaaattcaatattattttaaagttttctgctacccacagccaaacctagtcctaacatatttgagttgagttagtcaagagcagagttgaggcatgaaccaagtccagtgccccttgcactgcccagcaccaggggcatgctgggataacttcaggctctaaaagaacacctgctcaagtgctgtgttctaactcaccatcgcacacagccggcatttactacccagcatctcatttgtcacaacacatgaatcatttgagggaccttcgctcctacctgtatgccaggcatgtctcagtgatgtgcaagggctctttcaaggtctccagggctttttccaatctgatcttatatatgagtagatcatcagttacattcacaagctgctcaagtttgtcatctaactccttcttccagaactggacttcctcgagtctctgttctgaagcacacggggaagttacaccagggctaatctatcccaaggtagccaacatttgaattagaaacttgaagactgttgtaaaaccacctgtgacatgctcttttcctcttagtgctgtgctatttggggcatcttttcatctttttaaatgtttatttgcaggaaggaaggaagatatattttcttacagtccacatcagatttatcattctacacccactagttcttcagtgcccactgtttttaataacttttaattttatcaaagatataaatgtgtgttgttagaaaagtcaaatagtatcacaaagaattaaaactctctgacctgtccccatccatttgagacggagtctcactgtgtcacccaggctggagtgcagtggtgcaatctctgctcactgcaagctctgcctcccaggttcatgccattctcctgtctcaacctcccgagtagctgtgactacaggcatccgccaccacacccggctaattttttgtattttttagtagagactgggtttcaccatgttagccaggatggtctcgatctcctgacctcgtgatccgcctgcctcggcctcccaaagtgctgggattacaggtgtcagccactgcgccaggccccttatcacttctgacatttgcttatactgctattcactcattatcagttttgatattatatgttgatttcctgtgatgaaagataatgatttgctcttaaccaactcacacaacatacttccgtctcccaatatagttgtatcaccattttgttaaacaataaataagtaaacttactatttatttacattttgtaaatatataaatgttatttacacctgagccctatcatacactgtaataaatttcttttcttacaaaattttctgttttggggaggagttaaaatggcatttttgcttcactttcttttttaaatgataattaaaggcagatttattagtcaccatgagtaaaaaatgactgattatactaggaaaacaattaaatatatatatatttaattgataatgagtagttcagcatttgaatcttaaagtcataatgtactggttgtagtgtcagtttccacttctgtaagctgactctgttttaaaaaaaaatgttattgtatatatttgaggtttacaacatgacattatgagatagtaaaatgggtagcatagtgattccttcagtttctttatattattaattttttctcaatatgccctcaatatattccaacccatcaagtaagctatcaattttctttcctccttggagatgtctctcctagagcatcttctcctcctgctggatgagttgctctctagtttgctgtgtagctgtcatcctatgactttgcttccaggaatccccttcactcttctcctgttgctgtcccgtttcctggattgtatttcttcctcttccttgatttactctttcagtatgctgaagcatatccttcagtaacttcctaagaaatggatgcatgtgaggtaaagtttttgaaaacctgcaagtctgcaaatgtctttattctaccctcgacatttcattctatttggctgtgccctgagttacagtttgtaactcttttttatttggaattgtgattgtgtccctccatttccttctaatttccagagtttctgttgaaaagtctgatgccactctgattcctgattctttgtatatgacctgttttttccactctgaaaaattttagtaatctattttcctagggtcctgaaatttcacactggtgtcaaacttatttaattgttgtgtcacatgccagatataccctttgatatggtttggctctgtgtccccacccaaatctcatctccagctgttatcctcacctgttgagggaaggacttggtgggagataattggatcattgaggcagtttcccccatgctgctctcctgatagtgagtgagctctcttgagatctgatagttttataagggtctcttcccccttcattttctcttctctctcctgccaccatgtgaagaaggtccttgttttctcttagccttccaccatgattataagtttcctgaggtctccctagccatgtggaactgtgggtcgattaaacctctttcctttataaattatccagtctcaggtatttctttatagcagtgtgaaaattgactgatacagagaattagtactggaagtgaggcactgctataaagataacctggaaatgtggtagtgactttggagctgggttaacaggcagaggttgggacagtgtggagggctcagaagaagacagaaagttttgggaaagtttggaacttcctagagacttgttgaatggtttcgatcaaaatgttgacagtgatatggacaatgaagtcctgctgaggtagtctcagatggagataaggaacttattgggaactgaagcaaagttcactcttcttatgctttagcaaagagactggcagcattttgcccctgccctagagatctgtggaactttgaatttgagagagattatctgaaattggaacttatgtttaaaagggatgctctgcttcccccattttgggggaaggaattcaagccagctacagaaatttgcataagtaacaagaagccgaatgctaattgccaagacaatggggaaaatgtctccagggcatgtcagagatcttcacagcagcccctctcatcacagaccaagaggcctaggagaaaaaaatgcttcctgggccaggcctagggccctgcttcctcatcttcttctttttagagacaggatctcactctgtcacccaggctggagtgcagtggcacaaccatagctcactgtaactttgaactcctgggctcaggagatcctcccacctcagcctcctgggtagctgagactacaggtacacaccaccacacccacctaattttcttatttttgtagaggcaagggtctctctgtgttgccaaggctggtctcaaactcctggtctcaactgatcttcctattttggcttcccaaagtgctgggattccaggtgtgagccaccataacttctccattttctctatgctctttctgaaactcctattagttattgagcctcccagactgatcctctaattttcttgtcttttctttgctgttattttgttgtccttttttcccactttctggatattctcaacacttcttttgatttttaagatttttctgctcttatattcttaatttctaagaacgcttgttctccaaatgttctcttttttaaagactcctctgcatgttccaaggatgcaatctcttctctaaattcttgatggatttgatagtgtatgtcttctttttctctatgcactatctgtctcctgagtttctgtgtctttgattatttgttttggtgtctgccatgttattggctttcctcaattatttggtgatcatctgatttagactgagatgctaaagtgctacctggaaatgctgtctagagggacagtgcttgtcaaccagaatgctttatcatacagagtgatcagttgagaccctggcatctcacaggagaatcctcaaatgttaatatttatggatctttcctttcggggccagttactttctactttctccacagaaaagtcctccagtctcctgtctgagggtagaagcctggctaccagtgtcttaggaaacagctggaagaattactatgtagacatagaaatgaatgaatcaccaagtagacattcattgaaccttttaacctttaaccttctgctggggtgagggagagccagagtgaagaggaagctctttataaagactttcaaccaatcttgtttctggttctatcctgaccctccagcttcagaagtaactggatgcatccagttttgagcattacaagatttctgcagcatgaatcagctggcttcttattgttctctacccagcctgattttctgcagtccctaggtttgttaccagctgacctttgctttctaaaatcttgatttcattatttgtctactgttgcttcctctctaactctctgtgtgtgtgtatgtgtgcacacgcatgtgcttgcctgtgtatgcatctcaatctctctcatgcttggggcatagctttattattattttgttagctttactgttattaattctttactgctattttgttggaattctaaaaggaagagaagacaaatgcatgtgcttaatccaccatgtagatgggcatcttcccattgacaccttgtaactgattttcacctctactgtgtaccctccactatcctactggacatctcttatctcaaaggtcaccaataatctttaagtcactagtccaaatttattttggctcagctctcagtctcttagacatttagacaaccactgatacaatagaagacttcctcgcctgtgaaacctcatcctttttttttttttttttttttttttgagacagagtctcactctttcacccaggccggactgcagtggcgctatctcggctcactgcaagctccgcctcccaggttcacaccattctcctgcctcagcctcccaagtagctgggactacaggtgcccaccaccatgcctggctaattttttgtatttttagtagagacgaggtctcaccgtgttagccaggatggtcttgatctcctgatctcgtgatctgcccacatcggcctcccaaagtgctgggattacaggcgtgagccactgcgcccagccaaaacctcatcttttggctttcataaccttggtctcatctgtttattcttccacctgaacttatgttcctcagctcttctcttggtcctcttcaactcatgtgcccttttcttctcttttgatacattctttgggtagtctaatctacccttatggctccccttacccatctttatgtgatttctggcgttacttcttaaattctaacaggctacccaatgaactgaacattccaaaatcaaggtcttcctcaggcttggccctgcttcatctccctctcatcttcatcatgctgctcttcctcacgtactctacacattaacttggacctctctactcattccccataaatgtcccactcatcctgcctttattattttgtccaagctatctccttgacttttgttgttaaaattcattcataaatccaacatacatattatcgagcaccttttctctccatctttactgccattgccttcatctaggccagcaacttacaataattttagttacttgcctttttacttgtgttgtgtctcttttacatagtagaatgtatcagtctttttcaattttatactcctaagcatctagcacagggtcagacctatttgaagagtgaatgaattaatgaatgaacgagctctgatcccattaaccaggatagggaactacagaagcagaagcaagttttgaaggacaatgatgagttcatcttgggacatacttattttgaggtgcctgaaggaatctaggtggcaatatatagcaagtagttctctattttcccaaagagttctcatgagaaattagagctgaagatttctatttgcaaaccaataacacaaagaaaatagtgataaaatttctaatgaggtcatcaagaaagattgcttagagagaagagaagaaaaagctaagaagatgaagaacaaaacgctaaagaacaccaataggaaatgaatggggaaagaagcatccataatagagaagaggaagaaatggccagagagaaaggaaattttaatcaggaaaaatttgtgccatagaattctaaaagtaactggacacatccagttttgagcatccagtattgtagagagatcaagttggatgaagactaagtgatcattagattggaaaattgagtagtcattggatgtgaccaattggaagtgatgtgccctctcctccaatctgacggtgctttattggtgcctcttatgggatgaagcacaccgtatcctgggtatcctgtactggactcatctctactttcagactgcaagctccccaagggcaaacaccagtctggtgtgtctatatcatcagcaccagcacaggtacttgcaagttatttttaactttttattgaaatatcaaaaacctatagaagagtacacatatcataaaattcaatgtattttcatagtgaacacacacatataagacccagctcaagaaacagaatataactggcatcccaggaggtctctcatgaccccttccagttctatcattccacacaccaaggtatagattcatttttcattttatttggtttgttttactttacataaatagaataatatggcatgtactcatctgtgtgtcatttattgtactcagcatcttactaagtttgtaagattcatcagtagtgttgtatatagctgtaggccactcattctctttgctgtgaggtatagcatatttatccatcctactgttgataagcatgtgggtagtttccagttggggccattacaaatggccctcctttggccattgcagcatatatctttggtaaacatatattcccgtatgataaaactctaaaggtagaataaccaggtgaaaagtatgcatgtcttcaactgtagtcaatactgccaaagctttccaaagtgattacagcaatttgtatttccaccagcagaatatgacagtaacagttgctccacatcctctttcctctcctttcttcttgttctcttccttctttttaattgtagccattccatggctgtataatggcatctcaacttgattttaatttgtatgtccctgatgactcataaaattagagcacctctttacatgttcgtcggctgtttgaatgtcctcgcttgtaaggtgtctgtcaagatttgtccatttgtttattgagttatctgcctttttcttttgtattcttaaaagttatttatatattttggatatggatttgtcagatatatatattgcaaatatcttttcctactctttagattgctgttcagccttttgatgaggtatttttgttaaacaaaagttcttcattttaatatagtctaatttattgtttttcttttctatgaatgcttcttttcaggcctgcttaagaataagaaatctttgccttcgacaagtcataaagatcataaatatattctcccataagtgtcattgtttcacctttcccatttagatatgcactccacttagatttgcagatagatagatagatagatagatagatagatagatagatagatagatagataatacgaggtaggggttgggattattattattttttttttttttgcgacggagtcttgctctgtcacccaggctggagtgcagtggcactatctcacgtcactgcaagttccgcctcctgagttcacgccattctcctgcctcagcctcccgagtagctgggactacaggcacccgccaccacgcccagctaatttttagtgtttttagtagagatggagtttcaccatgctagccaggatggtctcgctgtcctgacctcgtgatctgcccgccttggcctcccaaagtgctgtgattacaggtgtaagccacggcgcctggccaagatatcattttttatatgaatatctaattgggcaattcattgaaaaggctttcttttgcccattacactgtagtgttgctttgtcatactcagatgaatgaatgtatgtgggtttgtttctggactctgccatgtttcattggtcaacaggtctatcctcacttatactttgctgtctcaattaccatagctttgtcacagctctcagtacctacggtagaagtcttccaactgtgttcttctttaagatagttgtgccaatttttttttttttttttttttgagatggagtctcgctcttgtcgcccgggctggagtgcagtggcgtgatctcggctcactgcaacctccgcctcccgggttcaagcgattctcctacctcagcctcctgagtagctgggattacaggcacccaccaccatgcccagctaatttttttgtacttttagtagagacagggtttcaccatgttggccaggctggtcttgaactcctgacctcaggtgatccacccacctcggcctcccaaagtgctgggagccaggcatgagccaccacactcagcctcgtgcctattcttgaccttttgcatttccatatgaattttagaagcagtttgccaatttcaccataaaacctgctgagattttcattggcattgcattgaatatatagattaatttttgaagggaatcaacacttttaaatactaggttttccaatccattaactcataaatccctgcatttactaagaatttctttaatttcttgaaaaaatgatttttcagtgcaaaacacttgcacatcttttgctagatttattcctacatatttgatgcttttaatgcctaatggctaattttaaaatgattccatgaatcaatgaaggttcactttttccccgtatctactgaaacagagtattgtgaaaatgaataatgatttctcttcttttttttgttttgagacagagtctcaccctgtcacccaggctggagtgcagtggcacgatctcggctcactgcaacctccacctccttggttcaagcgattctcctgcctcagcctcctgagtaaccgggactacagatgcatgccaccatgccccactaattttttgtatttttagtaaagacagggtttcaccatgttagccaggatggtctcaatctcctgaccttgtgatccgcccacgttggcctcccaaagtgctggaatcacaggcgtgagccaccatgcccgggcgccttctcatttttaacacctacctatttgcacaattatttagaacaggcctatctacagggtggtatcaatgtaagggtcaacctattaggagagcctaacatctaacattgctgacctgaatgaaggtttcatttactggaaattagaaaactacagtcctcagaccaggtttgatccataaacgtgtttgttcagctggcccagtgttataaataaattaagtcagttaccaacatttaaaacgtgaataaattcctgctttccagattttcttgaaaaaatcggacaatcaggcaacactgggctcatgttctttcttggaagcaatgggttgaaactgagtagcagcttcctccttagatggggcacacgttctccaggtccccacagtccctactaaaccctaatgccttacattcaatccctatgctacctgcttggtccctatagatagtcgagttggttacccctggttaatccctttttggcatttagccgacgttggttgtttgttttgttttatgtttatttttgttttgattatttaaggatactatctttttttttaaatgtgctttcctgagatctttgctaaagaacgctaccttttaaatactgttttaggcagggtgcggtggctcgtgcctgtaatcccagactttgggaggctgaggcgggcggaccacctgaggtcaggagttcaagaccagcctggccaacatgatgaaaccccgtctctaccaaaaatacaaaaattagccgggtgtgatggtgcacgcctgtaatcccagctactcaggaggctgaggcaggagaagcgctcgaacctggaaggcagagattgcagtgagctgagattgtgccactgtactctggcctgtgtgatggagcgagactctgtctcaagaaatttaagtaaatactgttttaagtaaggaattgtcaagagaaaatgactccttttaagactcaagtaaatgttcttctctagaaaaacttttccaatttttcacatctactccgccccgtctttgttcccctaccccagcacctatctggttatacacctgtcccttggtatcctcagaggatttgttccagagtccctgacagacaccaaaatccatggatgctcaagtcttttatacaaaatggtgtagtgttttcatataacctatgcacatcttcccatatactttccttttctctttcttttctttctctttctttctttctttctctctttcattcttcctttctttttctttcttttttttttttttatgaaacagggtcttggtatatcacccagggtggtctctaactcctgggcttacaggatcctactgcctcagccctccaagtagctgggactaacagcacatgctaccacacccagccagtatactttaaatcatcttcagattacttataatacctaatacaatgcaaatactatgtaaatagctgttgaactgtattgtttttatttgtattctttaattgttgtaatcttttattgtttttttttcctaagtattttggacctacaactggctgaacccatggatacaaagggctgactgtattctgatgattaatttttgtatctttatcctcttcaagttagaagcccctaaaaagcagagattctgatcattccctgtgatatgcctagtgtgtagtacatagatgcccatagatgctcaataactgtgcatcaaatcaacaaataaatgaatgatgggtggctgaaaatcaggctgggttaccttgtgtctatcttagggcagtgaacttaaacatagaacctggagaatacacatgattttctctaatattcaaaaataatatgttgccacatctgaacatgacactatagctaaactcaacagcctcatcctagcatgttcacgaatatgccaagcatgttgtcttacctagtttcttgttcacatcgctttgagattttcttgtggtcttttcaatttcatccacaagcctctggctttctgcgaccaggcgttctgatcgggacctttgagcgtctgctctgtggtactggttcttgttagcaatgtgccactctgagggcaggaacttgggtggaggttgtaatagtttagccatttgaggtttccaaattcctgatcaaaagcagactcttttagattaaatgaaagcaatttgtccttttttatgataatttttattcaaggatgacatatatacggaaaattgcataaatcataatctgtacacaaaataaatctatctgtgtagccggcacccaaaccaagaaacaagcattaccagcatctctaacctcctcccagttactccacctcaagcccctcagggtaaccagtatcctgacttttaacactacaaattcgttttgctgtttttgaatttaacataaatggaataatacagtatgtattattctgtctctgacttctttagctcaacattatgtttgtaaaattcatccatattgtctatatgattgcagtttgttcgttctcgttgctgtgtaggtgccgttatatgaataaaatctagctgtcttttctactgtttatggatatttgggttgtttacactccagggccataatgagaatgctattaatagtctcatacatgtcttttggtgaacacgtgtatgcatttttataactcattagaattgttgggtcatggagtaatgttctgccaaacagatgagcccagagatgttttcttaaaaaaagaagaagaaaaagaagaggaagaagaaggaggaggaggaggaggaggaggaggaaatgtaacatgtgtaaactgacaactgggtattgaacttgttcaacacataaaagaatctgaaaacttccaggacaaagaaaaggagagaacaggaaggggaacaacacaggggaagccagctggcagaggctgtcggcagtggaaacgctaaaattacccatttcatcttcatacaactctgatggaccatgagaactgccttcctcagacagggctgaaatctgcccccactcccatctctaccctaaggtctgagtccctgctcttaggggcctctggatctctgaagccttcacatatataaggatgaaactagagtcagatcttgactaggctgagaacctcagcccacccagccccctcagacaacatggagtttctccgtttcttcctagcccagtcccttttatggcttctaccgaatttatctgagtgtggagcccagcatttaacccaaggctcctggataagtctgaatagcccccagagaggtggggacctaaattagggctcatcccaacgtcataaggatttggttaggcggggagggttgcgggtaggggtcggtggggtggggtcatggtttacttacctcagcgccacacagaaccactacgcaagctcgggatgggagcctccttaccccaactggagcttccagctcttgcagaacagagaggtaaacaacgcggtctccatgacaacaagtgacgcgttgccagggcaaagagggctggttccgccactgagcagcctggccaaaggcttagcgcaggcgcaaattctgcggaccccagagccagagacccaggagtgtggcgtgtgggaagggtagggccagatgctccggccacctcaacctaccgcgaagacgcggggcaccaagcagaagacagcggccaaagccccgagctgggagtcaggagacctgcgtctagtccgagccctcccgcgggcgggatcatctcgggtcgcgctgtaccccggctctcagacttcccggctgtacagtggggttgggctgggcgatgcctccaggacctcgcagtcgcaggcgaaattgagggttaaaaatcaggaagccaagttgattgtttctgtaagctacaatgagtttcctccagagtttgtataggtctgttaccacaactggcttatttctgcgtggggcgcccgatggggcactctgtgagggcaggtgtgtgagtagaacgccttcaggcaaacactccagaagtcactctgcatccactaggagatggaaaatatgggagaaaaattaaatctgaggggatagctccagaagatttaatatttgtcaagtaggacttccagaaggaaagaaaaaaagagagagaatggcaaaacaattgtgaaagtgagagagagataacttgagccaaagactcaagtctttagattaacgacccacctgaaattaacacacacccccattccttacatatagtcctccctgtggattatgcatataatccatagagtgattagctccaggatccccctcagatactgaaatctgcagattctcaagtctcatataaagtggtgtagcatttgtatataacctacgcacatccctagataggcatactttacgtcatctctagattgctacaatacctaatacaatgcctaatacaatacctaatatagtgcctaatacagtgcctaatgcaatacataatacaatacataatacaacacctaatacctaatataatacctaatacaatgcctaatacaatacctaatacaatgtctaaccatgcctactcatcgcttcattcgcatggattcaacatagcactcagggtgcaacaaattcaagttttgctttttggagctttgtggaatttttttcctgaatattttttatttgtgtgtcatcgcatccaaggatgtagaatccacggataggaagggccaactttatacctattctggtggaatttcttaattcaaagaataagaagaaaaagaaagaataggtatcaagtgtttcgtctctaacacaggtggctagaaatgatggttgctagaaatgatgctaggataatgccttcaaattctatagaaaattatttcaaatctgggattctacaaccagtcaaagcatttcatgtatgagagcaaaataaaagatttctttggacatgccagtactcaaaacggtgagcgtacattctttatggaaaaaaataatagagcaaaagtgaaaaatccagaaagaagaagatactggacataagacatagtggaaccaacccagctgtgtgatgaaaagaaagctcggtgtaatagctaccgaactaaaaagcaatgagtccaaattacaactaaaagtcaaaagaagttttgaacaatatctttaagaagagttatacaaactatgattcataacccagaagtataaccacatggtgagttgaaattatgtctcttctgagcaataaaaagtagataaatgatgacagtctccgtgatgcatgcctgaggtgccatcacttggaatgcctgggaggtatggcttgagctcaggagtttgagactgcagtgagctatgatcacaccattgcactccaacctgggtgacacagacccctattaaaatattttttaatttttataagttaaaaatagacaaatacaaattctgagaaaagttaaaagctgcacaagggctgggcatggtggctcacacctgtaatcttggcactttgggaggccaaggcgggaggattgcttgagctcagaagttcaagaccagattgggcaacatggtgagaccgtgtatctaaaaaaataaaaataaataaaaaacctacagaagaaagttataagtatgaagaaaattaaattttgatgtcattttcagagtagtatatgaaatacaagagatggtgccaaaagtcaccaccccctcatgatcatccctgctgaactcattcattctctgaactcattcattctctgaactcattcattctctgaactcattcattgatttgttcaacaaagatttgttgaccactctctgaactcattctctgaattcactcattcattaatttgtccacatacctattgaacatctatgaagtatcaagacctgtgctagacaccaaggatagatgaagataaaacacagtctctgccttctgtggagattacagatgcacagctattgacacagcaattcaattccacatctagggatttatcctacagatacatctgcacatgtgcaaaatgatgtaactgtgtgtaaaaagttattcattgcaaaattgttcttaatagaaaaaaatttacatatcccaaatgtccaccaagaggagactgattaaataaattatgaaacagtcatagagtattttttactgtaaaatatataattagaaatcttttttacatctctttgatatggagtgaccaacgagatatattaaatgaaaaaagcaaggttcagaagaattacatatatagtattttaccattgttatgatagaaaatggtaaaatgtaattgtttgtgtacccctagaatttctccagacagatacataagaaactggtaacactggttgcctctggaaagagaactggatggctggggtgtggagggtaaaggaggcttcactgaataatcttttgccttttgagagttgtacaattattatctcttttaaaagaatataaaaatgcagaaactctttataataaatgatttcagtaaatgaatgacacaaatacggcagccgatagaagagcaggaggtgtgaaagcgttgagacagagctaactagttattttgaaaccagaagaattcagagggagatgaacagaggcagtatgtctaggagacgacacacttagccaggggcctgaagactggcttccagcctggatctcaccacggacaagcctcaggtttcccatcctcgataaatctgtcatgctatcctgagtattttatggatgcaaaagtgctacccaaacatcagatcttattcacttcttatttaactgtcatacagtggccactgtgacccttgacctctgttttggtagcattgccagtagtattgggatctgtgtcaacttccccactgaactgcacctagattggggggaaaagactcccttcatataatggtattggtaagatgtgaattgttttccatcttaggtttcactgtggagcagtgagttcattgataagaaaccactagccctttattcttgctattccttataataagtatcaatatcacaggccattgtgcgaagctgggcattcaagaccctagtgttctgcgtctgtagcggggacttagtcccctgttgtatgacgctaaccccaaattagcaattaacaaacatgataacttaaaagcttttcattggaattttaacctaccaaataactgtgatgtgcttttaagaggcccttaggggaataaaaggatataaagcatgtgcttcccctttgaaataacagattttcactgccagtaaggatgaagagatgttctccaccatctttctttcaggtgttcacagcaaatcaacaaggaataaaaaaatgggaaagattcataagacactgatcaattacaggactgtatggcacacaccaggatgtcccggcacagttcacaagcaaggctccattcagggtccccatttctcatttctagaaggtggcttttctctgtaattgacaccacagtacaaaataaatcaaaatcctgaggctagaaacaagatagtcaagaatatgtgcaacatgtattgatttctagaagtcgtcacgatattttaaagtagcttcttgtatagaattaagtggtgaaatgcttcctgtttctcgaatgatcaccacaaccaccatttatcaagcatgtattatgtgccaggcactgtgcttgggagatattatcccatttaatctacacacagccctttaggagagctatgattaatgacccaattttttagaagacaggaggcacaaagaagttacttacagctactaaatggttaaaaaaaaggagggggcggattttaattacctgaccctagagcctgcaatgctaaccactatacccattgtcggagcactatattgactcacacgctcctaagagacaggttagtccttttcaaggtagtgcataatgatcttttcaatgtgtaacgttggaggcttgactagacctttcttaagtcttgttcctatttgcctccaggagtttgagcaaagtggccatttcctgcccttcatcacttgctgtatggttctccttaaagaaaaaccagccatgtgggtgatcctttgagcaccccatctgcctccacgggctctcctgtaagcttcttcacccagccaacaaggtcctgagcagaagccttgtttccaggctgtctcctacgtctggaagtctgggctcttgaatcacaacaggatcttgactgctttggcaatttgaatttgaggatgatgagcagtgcctcatctcaaaaaattactggagtaacttttatgaaactattttgttttcagggtctaaggtttttgctttggagacactcagggaatatgtatctactcgttcaggcttagaaggcttgctcttggctgctttgtaggcaaccaaaccaaatgttgaacatattcagggttttaccaagtactccaaaaacaagaccaaatataatcaaaagtaagcaagaaagaaatggtgagatggctttaaaatgacacctgcatgcacaatgttattcatttcagcatcgctggtaataggaaaagactagaagcaacttacatgcccatcagtaggtgtcttgctaaacaaattatggcacatccttaccattggaaaccatgaagctacaaaagaatgaggaaggaccttttgtagccaaacgaaatgacctctaaaggataattttcagtgaaaaacaataaaaaatcaatgtgatcctcctgcctcagcctcctgagtagctgaagcagaaaggttgatattatctattttgtcctcaaaaatatttctataaataagaggggaggaagaaaacatatatacatatttgcttgtaaatgcataaatatttctggaaggatacacaagaaactggtgaccttggctgactgtgaagcaaactaggtgtccagggagagtggtagaaggagacttttcactgaatacccttttgtgtcttttacactttgaaccatacacatgtatgtactacctttgcaaaaataataattgaattttattttattattattaaaattagttctagaccagtattgataagtaggaacaagatagaaagtcttataacaaataagacaaagggctagaatatttcagttacagtgataggctatgaaccgggtcaggactagccagttaaaagagtcactacatttggtcatttgctgtaaagaaagccgaaatcaaatcggtgctttggtaaagccattacataacctacatttggattaattccagttcctaaccattgtttcttcttgcagtgaggccccagaagtaattcaggcagaataatgaatagaaatttcgtagttttcctgaataatagtagttgagtgcctatatatcagaaagtgtttgcattatttatccatcatttaacaagtcccttcttaagctctgctccctgcatctcacagtgctaggtgctttggggtaggtagcatgggatcagcctctggtatcagacccaagttcaagtccagttcaggcttatactacttgcaggatttgtttcccttgttttttgtttgtttgtccatttgtttgggggatgtttagttttatttatttatttgccagggtcttgctctgttgttgcccaggctgaatgcagtggcagcaatcgtggctcactgcagcctccaactcctgggctcaagtgatcttcccacctctgcctcttgagtagctgggactacaggcacatggccacctgccaccatgcctggctctttctttcttttctttctttcttttttttgtagagtcacagtctcctatgttgtccacactggtgtcaaactcctggtctcaagcgatcctctggcttcagtctcccaaagtgctaggattacaggtatgaacaactatgcccagccccagctgtgtgatgttgggcaaactgcttgtctctctgcatctcagtttcctcatctgtgacaaatgaacacaatatctaccacatagggcactataaagattaaatgaaatcatgtatgtgtattagtccagtttcatactgctataaagaactgcccgagactgggtaatttacgaaggaaagaggtttaatcgactcacggttcagcatggctagggaggcctcaggaaacttacagccatggcagaaggcaagaaggaagctagacaccttcacaaggcagcaggaagaagaagtgcagagagaaggaagagcctctaataaaaccatcagatcttggccgagcacggtggctcacgcctgtaatcccagcactttgggaggccaaggcgggtggatcacctgaggtcaggagtttgagaccaggctgaccaacatggtgaaacaccgtctctactaaaaatacaaaaattagccgggcatagtggtagacacctgtaatcccagctactcaggaggctgaagtaggagaatcacttgaacctgggaggtggaggttgcagtgagccgagattgcaccaccgcactccagcctgggtgacagagcaagactccgtctcaaaaacaaaaaaaaaaaaatcagatcttgtgagaactcactcgctatcactcacaatcactatcagaacaacatggggaaacgatccccaagattcaattacctccaccatattgatactaaccatatcagtaggcaaattgcaacagatgctcaatacgtattttctgtccttcctttctctttaaggttcttggtgtcttaacatactcagggatatttatttacaaggcagcatattataacaaataagtgataaaaacagcgtatatcacaggattgtagttcctaactagcagttcatatcaatagcaaacaaaaaccttcttataaagttcttcttagacctgctcactcagtcattgaaggtagggctagggcataaaaattcaatatgtatctatttcctgttaaatcagtaatacacactgagaattaaaattttaaatataaaagggaatacagtgagaagtaaatctccttcccattcctattcctctggctcctttttccctccaaaaggcattcattttgtccaaagatatgtctcattattttttttctaatctttgttctatgtgttcttcaaattggataagttctatgtttctgtcttcaagcttgctgacttcttttggtcgttttcatcctgctataagcccatccagtgaatttaatattttagatatcatatgtttttagttctagaatgcaaccatttggttgtgttttggtagtttctatttctctgatgaaatttcctatttttcattcctcctgaacatatttccatttatatccagttcttatctcatgagctatttcccctaatcacagactaaaaatatatattttttcccttccatttaattcttagatggattccctgtctagagaatgaagaatttagattcagtgatcatcacagaaataaaattgttacaatcttttaaaatccttttattcaccttgaaagcaatttgggattttggactttaaaaataatatttcacttgaaaactgtctcaagcatctaatgtaaatgaaaacagcaggaattctgctaagtgatttgaagaaagacatcaaaacacactgacttttgcacatatatttttaattgagacagagtcttcctctgttgcctaggctgagcgcagcagtgaaaacatggctcactgcagccttgacctcctggctcaagcaattctcccacctcagcctcttgagtagctgggaccacaggcacatgacaccacatcttgctaatttttaaattttttatagggacagtgttccactatgttgcccagcctggtcttgaaatcctgggttcaagtgatcctcctgccttagcctcccaaagtgctgggattccatgcatgagccacctcacctagcttgcctatttttaattgggaatttttgggctctctctccagtgcctcattatgtaaggtatataacttgcagggcatgacctcagggaactttctagttgcctgaactttctaatggcgacaactaggacaccagaacacttttgccacctgtcctactgttgctagaataatgttggcccttgagttcatagacaaagagaaagcagttctctcctggccactcaggggcagaaaaagcatccccactcctctgcattaggagaaaacacattttctatgcatgaaagaaaaggaagcagaacttctgttaaaatgatgcccaggaaaaaactttttttttttttgaaattaactattctatcttatattagtcaataaggaagtgtataatatataatcaatatatattatattcactgaaaattgctttaaagatggtgctaagccaatactgagaagagtgcctgtaacaaaataggcactcagtaatcttttttaaaattcacaagcaaaaaaaatatacatatatatatatggttaaactggatttcatttcccatacaaataccagaagcttccaagaaaagtatattttgagagttttttttttcttgaagggcattatttttcatataaagtttgtgttgaacaaactttgttacaaagaacaattctatgctatggcagagtatgtttgcacattgcagttgtcttttttctttatgatgaaattatcaaacacattaataagatctgaaggtccagttttcaagaaaggaagatagtcatggatgctggtgtaagccttctagaaaattttcaggcctttagaaaaatttgaacaactgcctgatcccttgagtcgtgaaaggtattttaaaattagtattacggccaggtgcagtggctcacgcctgtaatcccagcactttgggaggccgaagtgggcggatcactaggtcaggagatcaagaccaatctggctaacatggtgaaaccccgtctctactaaaaataaaaaaaattagccgcgcctggtggcagacgcctgtagtcccagctactcgggaggatgaggcaggagaatgtcgtgaacccggaggcggagcttgcagtgagccgagatcgcgccactgaactccagcctgggtgacagagcaagactctgtcccaaaaacacaactaaaaaataaaaataaaaataaaattagtattacatagtaaaaattatgtgttaattattgttaatagtcttcagtgttaattatggacttactaattgcataaatcatgactattccttaatgttttatttcaaagtagagtttaggatgctaaacatatgtttattgtttgcaaatacctatgtgctggcatttatgtgagccaagcaaagtctgattgggccaaaccctgggaaatgtaaatatatttattcttattttactatttggcaaagtctcctgataattgtaataatgtctgctattgaatcgtggcagacaccatccagtgtttctcggaatacaggcagccctcctacactctgcatcagagcccctcccgcaggcgatgcttgttaaaggatggattcgcaggacccgccgctgaatcagaacttaagtttaaaaaaggctgcaccttcacgggtgctcgctctgtcctaccagtgagcttccctttagtttcgcgtttccacaggaaacaggacatagatctaaaattgcctttgcacttggactggtttcctttgctgacctaatacagaatagctttttgtgctgtgactgcgagtgtgttgaacagatcctctgtattttaggagaagaaatttggtgcctcgttgctcaccatcaccactggccctggtagctctgcggataaaccagcttggatttcacccttgaggattaacattgcaacactgcataggcacataaagccacctgaaagtcaagatgaggcaggtaatgtgcactgggatctcatgtggttggtgtcttgtcttttgccatttgtcaagcacagcagctgaggttgctgaagcaggtgactttcaagagccgaacccactgcaagaagctctcctggaaaggggcatcaaggctgctgaccctcctcctgcccctccgctgaccaactccacacctgggattagaggggaggaaacctttatcccatactctcttatgttctattcctggggacctgcaaattaagctgataaaacacagattaacaaaggaaaaataatacaattttaattgatattaatatttttatgtgcacaggagcttcacaaagagaagtagaaactcaaatacgtggttagatgtgagaaattatatactactttcacaaagggtgataaattatggataagtgactggacaaaggaaagaatgtttgggcttctggggttataaattgtgagaaagtgcttaggaatatatgggagaaaataatagaagattaaagttatctccataaggttggtttatgcagattcttctgaatgcaactcccatcaccagtgataagagtcactctttttcttccgggtatagaggggcatcttcctcaaagcaaaatttaggtcctgcatttaggcagataagggaaggcagagaacttttactgcatttgttgtttcttccttgcctatagctcaaaatattcttctgccaaggtagcatattttgggggtggcatattctgatcctctttaggatcatcagcacctccagctggggtgaggctggatgggggctggcacaaaggaggctttcaggcagtttccttgagttctaaccgcaacccctgcagaacaattggcctgtggcctgtggcctgctctccccactatgcctgaattgctgtggactagtttatgaatagccctctgaacccagaggaagctcgaggaacagaattgacatacccatcagctagaatcgctgtaggaagacagaatcagtgaacataaagtatccaagttcaaacaattgaaaatgaaataataattaatttttaaaagagctttgtgaaatatgtggataaagcatactttccgatgagcctaatactatgaatgataaattataaacgggagtcctattttaaatctaagcaaggattttaactcaaggaaatcaatatgttccacaagagggcagtatggtaactcgtttataaaacagtaggctcagaagagccaaggacgtttgtgatcagtttttaaatttgtgataagaactgctttgagcagaaacaaaaatcaaacaccatttttaccgtaaagagtttttctacatgacatgaaagctactcaaaaagattggggagttttttaagtgtgaatgacatacttttgaaaaagtaagctcctggacttggaactatacagaattgctttcattagttgctatgttgctcggttgctatgtggtctagtaaaagctacagacaaaatcaaggaaatcacatttcctctgattcctcacctcaagttgtgcctgacaaagtttgtgggagagtctaaattgggaaagatagtgatccttacagctagctttatctgaactctgagtagcaggctgggcgctttacgtggattatttctttcagccccatcgtagctctatgagttaggaactattattatcttcatttgatagacgaggaaaccaaggcccatagaggactgaatgcttgcccatgggacatggctcatgcagagttgggattcaaatcgggcacatcaaatctagatcccaagtttgagctatttctaggcaattagtagcaaagacagaactagaacccatatctctttgttacgaattaaagggtgactttaatgttgaaaacgatgtgtatggcgggactgagtagaagaaacctttggaggagggctgatgggccagacaaaaagtgactgtgtttgcaaaaagacaggttcatgccaagaaacgagaacattcctgtctgagctgggatcccccatttatgccgattatgcagtgtcagggttgtcaagagcagagggatttccccattctcttctcaaactccaaagagctctgagatccacaggctggtggggttcccaggagaagcctgcagaaggtgcttcctccttcagggcacagaagaggacgaagagaagttcacctaaatccccagagcccttagtcaagttcatcccaaaactatccgaataatcatgactgctatcccttgagaactcaaatgccaggccctgtgctaagcattttacttgtgttagctcatttagtcctcatagcaattcaatgaggtggggcttatgttcaccatctgggaatttcacaggctggcccctctcacaggagtttcatcatgtaaggcctgcgtacatatatgcatgagaaagcatgtcttgtacacaaattggttttcctaaaccctccctcatctttgagcaatgcagccgattttgtttttaaaatgcagcccacttctgagtaagcatggcagattgctcacttcccccttccaaaactccactgaaatggcaataaaggaatcaagaatatataaactcataaggtgataaaatgagggaagagatgaacatggatgagagagtcccacaaatatctggaagagggagaggagcaggagctgacttggcagagctggggatcactacctggctccctgcagatgaggaaactaataagcagaagcgaggtggtcttatagaactctaggtgctgaggacggggagatccaaatctacagaaggtgggcataaggcatgggactaaaaacaggggggctaagtggcctgtatagggggaggatggacccccttcctcctcctacagcaggcgcaccccagctgtctccacccacccattgcacgcctccccaccctcactgccagcaggaggtttgacacattctctctggataactgaatggctcctgagaaaagacccccacattctgacatcttggagtcccgccccagtttaaaagccagtttgctgtccagcgaccttgttgtaagtccttctgtggacaagcctcacctactccctcagagttctcattcatctttttagtgagtcacacttagacagaaacaggcagcccaggatctccaaatgtttaaagacagcctccaacttggaagaaagaaatccaaacaaataggaaaaaggaacttggagaaagcagaaatgatggaagacgtagaaaaaaatgtgaaaataaaaatttgataagcaatttcttcagaaaaataaaataaggtgttatatccattaatcaagagttagattctttttttatgtactttaagttctggggtacatgtgcaggtttgttacataggtatacacgtgccatgaagttttgctgcacccaccaacccatcatctactttaggtatttgtcctaatgctctccctccccttgcgccccatcccctgacaggccccagtgtgtgatgttcttcctccctgtgtctgtccatgtgttctcattgttcaactcccacttatgagtgagaacatgcggtgtttggttttctgttcctgtgttagtttgctgagaatgatggtttccagcttcatccatgtccctgcaaagtacatgaactcattctttttatggctgcacagtatttcatggtgtatatgtgccacattttctttatccagtctatcattgataggcatttgggttggttccaagtctttggtattgtgactagtgctgcaataaacatatacgtgcatgtgtctttatagtagaatgatttataatcctttgggtatatacccagtaatgggattgctgggtcaaatggtatttttggatctagatccttgaggaatcgccacactgtcttccacagtggttgaactagtttacactcccactaacagtgtaaaatgttcctatttctccacatcctctccagcatctgttgtttcctggcttttcaatgatcgccattctaactgacgtgagatggtatctcattgtggttttgacttgcatttctctaacgaccagtgatgatgagctttttttcgtgtttgttggctgcataaatattttctcttgagaagcgtctgttcatatccttcacccactttttgatagggttgtttttttcttgtaaatttgtttaagttccttgtagattctggatattagccctttgtcagatgggtagcttgcaaaaattttctcccattctgtaggttgtctgttcattctgatcatagtttctcttgctgggcagaagctctttagtttaattagatcccatttgtcaattttggcttgcgttgccattttttttggtgttttagtcatgaagtctttgcccatgcctatgtcctgaatggtattgcctaggttttcttctagggtttgtatggttttaggtcttccgttaaagtctttaatccatcttgagttaatttttgtataacatgtaaggaaggtgtccagtttcagttttccacatatagctagccagttttcccaacaccatttattaaataggaaatcctttccccactgcttgtttttgtcaggtttgtcaaagatcagatggttgtagatgtgtggtgttatttctgaggcctctgttctgttccattggcctgtaatcccagcactctgggcggccgaggtgggcggatcacgaggtcaggatatcgacatcatcctggctaacatagtgaaaccccatctctactaaaaatacaaaaaattatccaggcatcgtggcaggtgctactcgggaagctgaggcaggagaatggcgtgaacccaggaggtggagcttgcagtgagccgagatcgcaccactgcactccagcctgggctacagagcgagactccgtctcaaaaaaaaaaaaattgttatgtgtgaatttgatcctctcattatgatgctaactggttattttgcccgttagttgatgcaatttcttcatagtgtcgatggtctttacaatttggtatgtttttgcagttgctgctactggttgttcctttccatgtttagtgcttccttcaggagctcttgtaaggcaggcctggtggtgacataatttctcagcatttgcttgtctgtaaaggattttatttctcctttgcttatgaagcttagtttggctggatatgaaattctgggttgaaaattcttctctttaagaatgttgaatattggcacccactctcttctgacttgtagggtttctctagagagatccgctgttagtctgatgggcttacctttgtgggtaactggacatttctctctggctgcccttaacatttttcctttatctcaaccttggtgaatctgatgattatgtgtcttggagttgctcttcttgaggagtatctttgtggtgttctctgtatttcctgtatttgaatgtggcctgtcttgctagtttggggaagttctcttggataatatcctgaagagtattttccaatttggttccattctcccttcactttcaggtacaccagtcaaatgtaagtttggtcttttcacatagtcccatatttcttgaaggctttgttcgttccttttcattcttttttctctaatcttgtcttcacgttttatttcattaagttgatcttcaatctctgatatcctttcttccacttgattgattcggctattgatacttgtgtatgcttcacgaagttctcatgctgtgtttctcagctccattgggtcacttatgttcttctctaaactggttattccacttagcaattcatctaaccttttttcaagattcttagcttccttgcattggattagaacatgctcctttagcttggaggagtttgttattacccaccttctgaagcctatttctgtcaatttgtcaaactcattctccatccagttttgttcccttgctggcaaggagttgtgatcctttggaggagaagaggcgttctggcctttgcaatttttagcctttttgcactggcttctccccatcttcatggattgatctacctttggtctttgatgttggtgacttttggatggggttttggtgtggacgtcctttttgttgatgtttatactattcctttctgtttgtttgttttccttctgacagtcagggccctcttctacaggtctgctggagtttgctggaggtccactccagaccctgtttgcctgggtatcaccagcagaggctgcagaacagcaaagattgctgcctgctccttcctctggaagcttaatcccagagggaaacctgccagatgccagccggagctcccctgtatgaggtgtctgtcaacccctgctgggagatgtctcccagtcaggaggcatgggggtcagggacccacttgaagaggcagtctgtcccttagcagagctctagtgctgtgctgggagattcactggtctcttcagagccggcaggcaggaacatttaagtctgctaaagctgtgcccacagctgccccttccccaaggtgctctgtcccagggagatgggagttttatctataagcccctgactggagctgctgcctttctttcagtgatgccctgcccagagaggaggaaactagagaggcagtctggctacagcggctttgttgcactgtggcgggctctgcccagtccaaacttcctggtggctttgtttacactgtgaggggaaaaccgcctactcaagcctcagtaatggcagatgcccctccccataccaagctcgagcatctcaggttgacttcagactgctgtgctggcagcaagagtttcaagccagtggatcttagcttgctggtctccaggggggtgggactcgctgagcaagaccaccttggctcccttgcttcagccccctttccaggggagtgaaaggttctgtctcactggggttccaggtgccactggggtacaacaacaacaacaaaaaactcctgcagctagctcagtgtctgcccaaatggccacccacttttatgcttgaaacccagggcccttgtggtgtaggcacctgagagaatctcctggtctgctggttgcaaaaaccgtgggaaaagcatagtatctgggctgaatagtacagtccttcatggcacagtccctcatggcttcccttggctacgggagggagttcctgaccccttgcacttcccaggtgagacgacgccccaccctgcttctgctcacccttcgtgagctgcacccactgtctaaccagtcccaatgagatgaactgggtacctcagttggaaatgcaaaaatcacccatcttcctcataggtctcgctgggagccgcagaccggagctgttcctatttggctatcttgccaagttccccctcattttcttgaattacagcttttagtattctttctgatcctttgctttggtttttgttcatctttccgttgtgcttttgttttgtgtaatgatattattttgccctttattgtctcttttcttatagtaactttgtatgggatttgacttcactacttttctactgccatttttatgtgaattttgttttccatgttaataaaaagaagcttgttcagataacacatctaacttcttggatccccatccatttttgttcttgtaatgttcaaaaacatgatggcctgcttttggagatttcctggctttgtttccccaccctgtgcttttctggatcttttctttcatttatttcagttgagtttttccaagggtttctctgaagtgttccgctccatcctggaagacagccttggctgaccagtttcaggagttcccgtaggtccttagatcttatcaactgtgcctggcacctacttgctattacagtggtgataggctttggatctgtgtcccctctaaatatcatatcaaactataatccctattgttggaggtagggcctggtgggaggtgactggattgtcgaggagatttctcatgaatggtttatcaccatctccttggtgctgttctcgcgctagtgggtgacttctcctgacatctggtcgtttaaaagtatgcgacactgttttagtctgttcttgcattgctataaagaaatacctgagactgggtaatttataaagaaaaaatatttaattggctcatggttccacaggctgaacaggaagtatgatgctggcatctacttggcttctgggaggcctcaggaaacaaaatcatgatggaaggtggagggagagccacatggctggagccagaggaagagagagagaggggagaggtgccacacactttaaagcaaccagatctcatgagaactctatcataagaacagtaccaacggatagtgctaaaccattcacgaaggatccacccgcatgagccaatcacctccaaccaggtcccatttctgacatttgaaaattacaacttgacacaagatttaggtggggacacagatccgaaccatatcaggcaccttctccccctcttccttgctcctgccttcaggatatgatgtgcctgctccccctttgcctttttccatgattggaagcttcctgaggccttcccagaggcagaagccactatgtttcctgtacagccggtagaaccatgagccaattaaacctcttttcttgtaaatgagccagtctcaggtatttctttacagcagtgcgagaatggcctaaaacaaatgggcatgttccctcctagttccagctgttgttcccaaattggcctactacaattttaccattttcaggtttgtcatatgtcctgttgttttcttccaagttctcttgcacaggtgagatgtggataacacataggtcttatggctgttggtggtttgtcctgttttggagtttgcagggattacttgtctagctttttgtaaatgtgattcatgagtatttgattttgctatctagttctgtctgtttttatgtggatatccaggaagatccaaattctatgctgcctccactgaaactgtcttcccagaaatgtattactttttgtcattaaaaaggaggtataggaagattaatctatgcactgcatttggaaaggtgtttgtttgtttgttgtttatttttaggttgcagtgatggcagggagccaatgttgatttctgatatgggaggatgatgatcagagctggtcatctgaaagattaacttggcagaagtttgaagattgaagaaaagtagtggagtgagaaggccaattctgacagtacatcagcagtccaaataggagatgataatgagggaaaggtgagtgggaagggcaaggaaaagacagctgtggggaattcaataaacgctgaatcagtggcttggtggtgagggaaggatgaagaagagttagaagaatcagaattgactgaaaatttgtaggatgaatgtctaggggaataatattacccaaaacaccagtgtagatgaggaaaatgatatggtgacagtaataatgaggggtcagagggagagcagtgactaattttttttttttaatttgcatttcactagctggaggtacctcaagaaaaagatgttgtgtgtgaatgtgcagggctgagggaaaggtccatgctagacacacagatttgagagtcatctgcaaagtatactccaggaaagatagaacaaatggcactatatatccacagaaaacttagaaacactattcctgaaataaagattgcctttgctcattgaaaatgttcacagtgtttcaagttaacaactagtaaaggaccaagagcaagaactatcctcaggaaaatactggctataaaaagaaagacctgaagctctatgtgtacaagtggtgcttgtaaatttttctgagtagtctggtggtgattattggggcatccccagatattgatatttggagatattttctctggggcaattcagaatttttttttttttttttttcgagttggagtctcgatctgtcgcccaggctggagtgcagctgcgagatctctactcaccacaagctccgcctcccgggttcacgccattctcctgcctcagcctcccaggtggctgggattacaggcgcgcccgccaccacgcccggctaatttttttgtatttttagtagaggcggggtttcaccatgttagccgggatggtctcgatctcctgaccttgtgatccgcccacctcagcctcccaaagtgctgggattacgccaccatgcccggcccagaatttttttttaatagattattcttccaattgcctgaattcagaacaacacctggctcctgatgttctaggggcagggagcgggaaaaaggatggggcttcactgttcattttgcagactttgacgttatccccattttacgttatcccccaatcgaactgatctctgtacctaatgctctaagttcagaccctcttcatttcagtttctccagagaataaaactctagggtcttgacaaaggtgtatcttccgtgcaaggtggggtatgtgggttgggcattgttccatatatagacttttagccagtcctggtatttctcactttcatgtattctaggaaacgggtaactccaaggcttggatctttggggggttctctgagagctctttgtcttggtacttactggtattccccctcaacgcattttagggtatagcttctaataagtaaagctggaatccatttctccatctgtgttagtctgttttgcattactattaatataaaggaatacctgaggctgggtaatttataaagaaaagaggggcctcccactttgggaggctgaggcgggcggatcatgaggtcaagagactgagaccatcctggccaacatggtgaaactcgtctctactaaaaataaaaaaattagctgggcgtggtggcacgtgcctgtagtcccagctactccggaggccgaggcaggagaatcacttggacctgggaggcggaggttgcagtgagcccagatcgcatcactgcactgcagcctggctaccgagcgagactccatctcaaaaaaaaaaagaaaaaaagaagagaggtttgtttggctcatgattctgcagactgtacaagaagcatgtcactagtatctatgtctgataggggactcaggaaggttctactcatgttgaagggtgaaggggaagcaggcatgtcacacggtgagaaagtgagctagagagatgccaggctcttttaaacaaccagcccagctctcacgtgacgtaatagaacaagaactcactaattaccaacgggaaggcaccaaaccattgaggagggatttgtcctcattacccaaacacttcccaccgggcctcaccttgaacgctggagatcaaattttaacatggtatttggtggggacaaaccctatcagcagctgcttttaatatttaaaaaaatattttgagagagggcccacagaccctctgaaagaagcagactgctcctgcaggacccgggggacaccccaaatactgtgagtgccccaactgcggaagtgggaaagggagaccctcctttccggaacacacaccccctactggagaagctgaaggtctgcttccgggagatgctcccgacttcacctggagctgagtcaagttagagaaccggaccaagcgaaatacaggggcagaggaggcagcagggaggccctgggagctctttgaatccccaggtagcctattcctgcctggcaccactgggattcatcaggagggaggccagaggagcaggaggtaaaaccctaccgggagaaggacttccctagctgaattttgtaacaatttgagtggggcgagaagcctcctggccggaacttgggggaggatgcggatctggcttgcagacttcacaggtgggggaagaactaaagcccttttctttcacaggtgggaggcggaaagcctcgggcaagttttcaagcccgtcctctgtctggaaacagactcagaggtgttgcaggggacacggtgggagtgagaccagcccttcggtgtgcgtgggatctgggggaggcctgtgactgccggctttcccctgcttctctgacaacctgcatgactcagcagaggcagccataatcctggagagccccggtttaagatctccaggtgaagtagatttttattgtaagtaactcctgtactttttaagttgtgagacatgcattcaaggttgaattctgaaatcatgtctgaattaacttcactggagtcttctgttgcccttatagagtagggaattctcatagttctgctagtaattgttttttgagggggcaggtgtggtctaacaaggaaaggctagagagcaattaggaccaagggaaagaccttgggccatggaaggttgagttctctgaaagttttaaaaatataaatatgtatttttactctagagatgcggtctcactaagttgtccaggctggtctcaagtaatcctcctgccttagcctcccaaagttctgggattacaggaatgagccaccacacctggcctcacctcagaacgttttgaaaattttagttttgtctgtttgcttgttcaatcattctgcatgactggatatggtgaggatcatgtaatttgggggacagaggaagaactcttggatttttttggatgactttactggtgcgatgagttccctggtcacttgacagggcaagtagaattcctcaggaggggaaaatttgttctaagagaacaaacagttgcagctgtgggcttcttacgtggaaaagcttctagtcaataagtgaacataaaaacaatggccagggcatattaataacactgacttaggaagttgaataaaatatctttgccaatagagaaagagtcctgctagaggtggctctcttcctcgttctacctttataacttttccaggattctgttgttggcagatattccaagtaaggagtgaagtttccccacaaatgatgatgaaggcattgagtcagtattttcccatgatgaaaaattttgtgaagactgaacttcaggtcagggacgaaggagagcccaagtagccttctcagtgtcttcaaagcctatctttggactttttggtgggtaaaacatccaccttgttttcaattagccttttcatcttcaggggcctttaactgagatattttaatgtcctcaaatagaggataaattggcaaactgagtaggtttaatatctggtctgattacagtgggactgggacagatttataaactgctacttagcatacttatcagctgagcttccccttgccttaggggtctattgcccatataagcttctatcttgagtatggccagctcttgtaataataaggcctctaggaggttacccacatttcccattttaaactagtagtcacaaattccctggctttccacaacaggtcaaagtcatgtaataccctaaaaacatatctgttatctgtgttgatgttaactctttgattcttagctaaagtgtaggttcttgtgagagccacaaattattctatctgatataatttgcactgggtaaagcctcatatgttatgggactgtggatatatgcaatggcatattcagcctggaaacctctttctgaagtcagaggtatgaactatcaacaaagaaaatgagatctggatctataagaggtacttcagaaagatcaggacggggaaaggttagagcttaggtggctgaaatacagtcatggtggttgtacttcagttgggagagaaatggtaacaaggttaagattttggtaatggtgaatagtaatgtgagaaggagcaaacaaaaggatctcataagaggtaaggttagaggttgaaaaacgttgggggttcgcagtcaggacaaagatgtgaaccacttgggcacagaagtgtgcgaagtatgacctagcacaaaatcaactgtggcttgaatcaaatttgctgttgccatgacaactcagaagcaaggaaggaaggcttgagctatagggcctagcaagaaggtaaaatatccaatgggcctcaggctccttttgtatttctgagacaggacatctaaagtatgttctctctcatgaatgaataggcagaagggcaaggagtagttggggagtcccaagctgggggaagaggaaagggaggtttttaaaaggatccaatactgttatagaggttaattctcgttctaggggttcagacaaggaatccacattctacaatagccaaccagtctgagaaagtccaggagttgtctcattgttttagataaagtgtaattaaggatgcttttcatacatctggagacaaagtttttcccttacaggagatgtcatgttttagagagtgaaactgaaaataggaaaactaaggatagtgaaattatattttgtctcttgaaaacaatgtcccttttaagtcagatcatccaaaaggtatcgagtatctgccaataaattatcaaatgtactggagcaaagaaggtggacatctacgtattgcatgacgatgcaattacaaaggaaaaccaaatcctttaaatttgcatttttaaaaatattaaacatttaggttcaggggtacatatgcaggtttgttacgtaggtaaattttgtgtcatagaggtttggtgtacagattattttgtcacccaggtgataagcaggtttcttgataggtagtttgttttgatccccactctcctcccaccctccaccctcaagtacgcctcagtgtctgttgttcccttccttgtgtccagttataagttaaaacacgtagtctttagttttctgttcctgcattagttcgcttaggataatggcctccagccccatccatgttgctgcaaaggacatgaccttttttttaatggctatgtagtattccatgatgtatacgtaccacattttctttatccagtctaccattgatggacatttaggttgattccatgtctttactgttacgaatagtgctaggtgaacatatgtgtccacgtgtctttggggcaaaacaatttatgttcctttgggtatatacccaataatgggatttctgggctaaatggtagtcctgttttaagtactttgagaaaatgccaaactgttttccctagtggctgaactaatttacgctcccaccagcagtatataagcatttccttttctgtgcaacttctccagcggctgttattttttgcggttttattaatagccgttctgactggtatgagatggtacctcagtgtggttttgatttgcatttgtctgatgattagtgatgttgaactttttttcatacgccttttggccctatgtatgtcttcttttgaaaagtgtctgctcatgtcctttgtccactttttaatggagttgttttttgcgtgttaatttgtttaagttctttatagagtctggatattagacttttgccagatgcatagtttgctaggccgtatgtttactgggttaatagtttgtggggtttttttctgtatagaagcgctttagtttaattaggtcagtttgttaatttttgtttttgttgcaattgcttttggtttcttcatcatgaaatctctgccaggtcgtatgtccagaatggtattttttaggttattttccaggatttttatggttttaggttttacatttaagtatttaatccatcttgagttgatttttgtatatgatgaaaggaaggagtccagtttcagtcttctgcatatggctagccagttatctcagcaccatttattgaatatggaatcctttcctcactgcttttgttgactttgtcaaaggtcagatggtgttggtgtgtgactttatttcttggctctctattctgttccattggtctgtgtgtctgtttttgtaccagaatcatgttgttttggttactgtagactcataatatagtttgaaattaagtaatgtgatgtctccagctttgtacttttcgattagggttactttggctattcgggctatttttttgtttcatatgaattttagaatagttttttgtaattatgtgaaaaatttcattggtagttagataggaatagcattaaatctgtaaattgctttggggaatatggtcattttagcaatattgatttttcctatccgtgagcatggaatgtttttccatttgtgtcatcttgaatttctttcagtagcgtttgtaattctcattatagagatgtctcactgccctggttaagtatattcctatgtatttattttttgtgtgaggctgttgtgagtgggattacattcttgatttgactctcagcttgaatgttgttggtgtataaaaatgcttctgattttcatacattgattttgtattctgaaactttgctaaagttgtttatcagatctaggagccttgaggcagagactattgggctttctaggtatagaatcatattatctgcaaacagggatagtttgacttcctgtcttcttatttgcatgtcttttattttttttctgttgcctgattgctctggctaggactaccagaagtatgttgaataggagtagcgagagagggcatccttatctttttctggttctcaaaaggaatgcttccaacttttacccattcagtatgatgttggctgtaggtttgcatagatggctcttattattttgtgttacgttccttcagtgcctagttggttgaggtttttaacatgaagggatgttgaattttattgaagagccttttctgcatctattgagataatcgtgtggtttttgtctttagttccgtttatgtgatgaatcacatttattgatttgcatatattgaaccaaccttgcatcccatggataaagcctacttgattgtggtgggttagctttttgatgtgatgatgaatttggattgccagtaatctgttgaaaatttttggatctgtgttcatcaaggatgttggtctgaagttttccttttttgtgtgtctctgccaggttttggtatcagaatgagtctgccttcaaacaataagtgagggaagagtccctccttctcaactttttggaaaagtttcagtaggtaccagatcttctttagacatctggtagaatttggctgtgaatccatctggtccagagcttttcctggtaggtagggatttttttttaattattactaattcaattttgggacaaggatttcaatttcttactggttcaatattgggaggttgtatgtttctagaaattttatccatttcttgtaggtttcttagtttgtgtgcactggtgcttataatagtccgtgagggttctttttcctttgtatttctttggagtcagtggtaaagtcatttctgacatttctgattgtgtttacttagatctctcttcttctttattcgtctagttagtggtctaccaatcttatttattttttcaaggaaacaatttatgattttgttcttttgtatggtttcccaagtctcaactcagttcatctctgattttggttatttcttatcttctgctagctttgggattggtttgctcttgtttttctaattcctctaggtgtgatattaggtggttaatttgagatctttctagctttttgatgtgaggatttaactttctgcttaatactgctttgggtatgtttcagagattctgataagttctttgtttttattagttttgaagaatttcttgatacctgccttaatttccttgtttacccagaagtcattcaggagcaggttgtttaatttccatataattgtatggttttgtgcaatcttctttgtattgatttctatttttattgccctcttgtcctggagtgtgattggtaagattcagtttttctgaatttgctgaaaaccatttttatggccgattatgtagccaattttagagtgtgtgccatgtacagataagaagaatgtatattctattgttttggggtggagagttctggagatgttgttaagtccatttggtcaagtgttgagttcaggtcccaaatatcattcttagttttctgcctcagtgatctgtctaacactgtcagtggaggtatcgaagtcttcccctattattgtgtggttttctaagtctctttgtagctctctaagaacttgttttatgaatctaggtattcctatgttgggtgcatatgtatttaggatagttaattcttctcgttaaattaaatcttttaccttctttgtcatttttgacttgttggtttaaagtccattttgtctgaaattagaatagcaaccctgccttttttgttttacatttgcttggtagatttttctccatccctttactttgaacctgtgggtgtcactgcatgtgagatgggtctcttgaagacagcaaatagttgggtctagttttttaactcgctactctgtgtcttttaagtggggcattttgcacctttatattcaaggttaatattgatatgtgcagtttgatactgttattgtgatatcagccggttactatgcagacttgattgtgtagttgctttatggtgtcaatggtctatgtacttaatgtgtttttttgtggtggctggcaacagtcttttgtttccatagttagcactcccttgaggacctcttgtaaggcaggtctggtggtaatgaattcccttggcatttgctgtctgaaaaggatcttatttctcctttgcttatgaagcttagtttggctggatatgaaatttctcggttggaatgtcttttcattaagaatgctgaatatatgccccctgtgccttctggcttgtagggtttctgctggaaggactgctgttaagctgatgtggttccctttgtaggtgacttgctccttctctctagctgcctttaatattttttctctcatgttgaccttgaaaaatctgatgactatgtgtcttggggatggttgtcctgtacagtatctcacaggggttctctgtattttctgaatttgaatgtcagtctctctaccatggttggggaaattctcatggacaataccctcaaatatgtttaccaagttgcttgctttctctacctctctttcagggacaccagtaagtcatagattttgtctctttacatactcctatattgctcagaggtttaaaattttttttatttaataaaatagagatggggtctcgctatgttgcctaggctggccttgaactcctgggctcaagtgatccttctaccttggcctcccaacgtgctgggattacaggtgtgagccaccatgcccagccttcttggagatcttgtttattcttttttattcttttttttatttttgtctgactgagttgattcaaagaactggtcttcaagccctgagattctttcctccacttggtttattctgctgtaaatacttgaaattgcattatgcaattcttatacagagttttcagctttatcagctcattttggttctttttttaaatggttatttcatctttcatctcttgtatcattttattggattccttaaattcaattgattgggttttttgtttggtggtggtggtggtggttgttgttgtttttggagacagaatcttgctctgtcacccaggctggagtgcagtggtgcaatctcggctcactgcaacctccgcctcccacattcaagcaattctctgcctcagcctcccaagtagctgggattacaggcatctgccaccattcctggtgtgtgtgtgtgtgtgtgtgtgtgtgtgtgtgtgtgtgtagtagagacagggtttcactatcttggccaggctggtcttgtgaccttgtgatccaccaacctcagcctcccaaagtgctgggattacaggcctgagctaccgtgcctgggcttgattgggttttgactttctaatgaatctcaatgatcttcattcctatccagactctgaattctgtatctttcatttcagtcatttcagcctagttaagaacccttgccaaagaactagtgtggtcatttgaaggtgagaagacattttggctttttgagttgccaaagttcttgagctggttgattctcatttgtgtgggctgatgttcctttgatctttgaagttgctttcctttgcatggggttttttgagtttatattcttcgatgcccttgagggtttgagtgtggtacaacatgggttcagtcaactgtctttgtttaaagtatttcagggggccaagcctcagtttatcactcctggtctgcatgttctaaccctggggggctagtattgggctctagctttgttctctggcccttcgaggttagaaacttgctgcaataagaggggctaaggtgttcctggctcactggccataacactctgctggttgggtgctggccaaagtgctttgttgtggcagtggcagtgggatccgtgcttacatgtgtgtgccagcagccacagcagcacagtagggtgcctgcacatcagcagtggcagggcaccagtgggggtggggtggcagcattcatgcatgcactagcgctggtggtgatggcatggtgggatatgcatgcgtcagtgggaaccaggcactagtgggggtggggtggtggtgtctatatgcgtgcttgtgctggtggtgatggggtagcagggtgtgcacacatgtgctggcaggggaggggaggtgagatctgcccacactcatactgacaaagctgtgagcatgggctgtgggtgactgtgtgctggaaaagtggtgggaggaggctgcagtggggagaggctgcaaggtggttgattgcacaacagtggaaactggcctgctggagccagagttaggcatggtgagcaggtgaaggaattattatgacggcccttggaagcaccctggtttggcatctgagtctgtgctgcaagcagatgcagcagggctggagccccaggagaggctggtaaacaggggcacactcagatcaaactggtcccattccatgggcaagacctcccttctctgtctaggtctggcagccaccaaaggccaaagccacctagaggagctttcttccagcttcagttcagggtctgcgtcttccctctgtccactctcaatgccttccctctgaaggtctgcttggagtatggcagtcttccctatggtctggtgtctcagtgagtgatgctcttcctggctgcatctagtcagccatcattggctcctctctaaatttgcatttaatgtctgggaaaaaataggctgttaatctttgaggcataatagtccaagtgtaccgctaatttccccaggtgtgaaaatgaataaatttaaaagctgttggaaccccaaagaacacttttaagccttgatagagatgtgactgtgatctgagttatgtatggtctcagcttctgttctcagattataatcataggttaactcgttttcttatttttcttgatctgttcaatgactagagagaattaaatgatggcagggacaaaagcttcctgccttcttaattaatgactgttgttgtagattaactcccctttattgtcctgatttgcttagacaagatgacagaaaacccacgattattacagcctttgcaaaaaaaaatgttaaatgtactcttactcataagaaacactgcatataactaatcagatttctgtgactatctatgtgcaaaccctgtatgaataatgcaaccctgctaaaaactcctctgtctctgcctatctaaacgaaatcttaacttccctgcttcggattgctgactctattcctttggagttgggatttctgggtgggccatcctcacattctgtgtgtgaatgaactctctttaaactagactctgactcttttaattattttaggttgacatttgataacctgcagatgggacctgaagtaagccttctgcaatcttcactgctttgctgacatctggagctttggtacagcacaagtggcttttacttctttgacttcattggacctggagagggtctctggcctggcttctctcagattttgaatctctctggttttggctgagattcagactttattgaagcatcctgattccacgctcaagaaaactgaaattgaagctttacttttaaaagtaggagtttcatttgttatttctctagagattctgtggtttgcagatttgtgctttcacattcctttgaggataaggttttgttttattcccaaaacttttcagccttttcccttgttcaactttggtgaaggagaaagtgtttctctttgaaaagaggaagcaaatctttgtggctcaaattaaatttgtgattttatattttctaggttctgaagcttggttcagctgacatagctaaactcttcttgagtgaccagaatttccatttccacggtcttcggtcacttaagagaactcaaattatggactattgtccctccaaaatcaagtctttctccctaaggagagatccacctttagaaactccagctgcactcatgtatgaaacttatggtgccacttcttgtcattatttagaaaatggttgcacataactcatgaaaaactaaaattgcaatggccaaagtgggatacctcaactaatttacctgtgtgctcaataagaaaaagctggttctaggataaaacagaatagttaggagagttcttttcaatggtatttaaaacatccaaaagagattttaatagagttacttctttacaaaaggagaataaaaagttacctaaaacaatttccaaatttaaaaagacagctgaaatttctcctcctcctccctcacctcctccttctctttgtcctttattacctgggctactttacctagaacgacctcttctttctcctccccctgcttctgctctggttccatccctggaacagccagtgtctggtagggattaacctgccctagtgtatcagtcacggtagaacttaaaggtagaattaaggaatttcctgatcctcactaggaccctgtgagtcctagtcttctggttttgccagaaaaatcgcaattaaatatttgagcttatgaccctggctctattttaagatgaataaaaattactttaaatggagaactaacacaaactcttattaacagacctggaatcaccttatctgtaataaagtccaccttattacaaggtcccattccttgaagtaaacaaacaattcaatctgtagttgtcacaaatactctaagagacttcttagaattatttaatacctacatttctttctccccaagaggaaaatgtatttagaattagatgataaaactgaattattggacatacttttgtcaacaatccatattgacatggaagacactaaattattgagtagtaaaaaattataaaacccactaaatgtagtacctaatcaatcatggttaaagtcttccactgattttggaaaatttatcttgcctaccccaatcaaagttcaatagattcatcaaaaccccttccaaaccttaaacaataccctctaagaactgaagccctaaaaggtataaagcctatagtttcagattatttaagaataggacttgattattccctgtaacagccaatgtaatactccagtccttcctgtaaggaaatcaaacgatagaggatggaggtttgtacagaatctgacagcaattaaaaacatagtcactctttgacatccagaagggccaaacttccatatgttgttgactgacatcccaactgaacctgagttcttttctttttactttgagacagggccttactctgttgcccaggctggagtgcagtgtgattatagctcactgaggcctcaatctcctgggctcaagcagttctcccgcctcggcctcctgtatagctgggactacaggtgcgcaccacaacacttggctactttttgtatattttgtagagatggggttatcccccttgttacccaggctggtcttgaactcctgggctcaagccatccacctgcctcggcttcccaaattgctgggactacaggcatgagccacctcgccggctgaagctgagttctttactgtaatagacttatgtagtacattctttaatatttctgtagataaaaataatcaatttctcttcaccttcacttgggaaggaagacaatacacatgaatagtcatgcctcagggatgaactgagagcccagcttacttttcacaaatattaaaagcagatctcccagatattgacttcttgaaaattcattttaataaaatacacaggcaatttactcctctgctcagaggataagcaattatttcttaaaaatgggattcacttgttacaacaattagactcaaagggacacaaagcttctaaagaaaaacaccgcctgtaatcccagcactttgggaggccgaggcgggtggatcatgaggtcaggagatcgagaccatcctggctaacaaggtgaaaccccgtctctactaaaaatacaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaaaagaaaaacaccaatcctgtcaaaaacaagtgacgtgcttaggccacctaatatttaaggaaggactttctattagtccataccgactgaaaggagttttagctcttctgccatgaagaaccaagaaacagctgggagagttctgggggctggcaagacatttaaaaacttggatcccaaacttttctttaaaagcctgccccttggccggacacagtggctcaggcatgaggcctgtaatcccagcactttgggaggctgaggcaggtggatcacctgaggtcgggagttcgagaccagcctggccaacatggtgaaaccctgcctctactaaaaatacaaaaaaaatagctgagtgtggtggcgggagcctgtaatcccagctacttgggaggctggggcaggagaatcgcttgaacccgggaggcagaggttgcagtgagccaaggtcgcgccagtgcactcaagcctgggcaaaaagaataagactccatctaaatgaatgaatgaatgaatgcctggcccttacatgcttcttttaaacaggacattccagaccctcttgtttggacagaagaaaatcaagaaatgtcagaaatgatcaaaaatgactttactaatgcccaagctttggtgcatgcagattataatcttctattttcagtatttgtacatgaaagtgatggaaagattttaagggtcctgactaaaaaacatggagcccaaagagacctgtggggtattgtagccaacagttagactctgtaataagaggatttccatcttccatgagagccgtaaagcccctgctttgttagttgaagcaactgacgaaattctcatggtgacagcccttagtggttttgtttctcattcttgtgaaagcatttgctaaactcgcgtcatactcaatattattcagttagtagactagtctcatacgaagttttctttctttcagcttctcatatcaacatctctagatgtaataacctaaatcctacaactcttctgtctccatttccagataaaacactgcactattgcataaccctaactgatcactgatcaacttctttctcccaggactgacctcaaagagaccccccttactactgccaatggtgtttggtttacaaatggatcttacttaaaggataaatctgggacttaccactcaggttatacaatagtatctttaactggggggaaaaaaagaaggaggagaagaagaagaggaaagtgttaagcttctaggcaccacctgagctcaacaaacagaattaattacattagtcaggacttgtcaattggcaagaggaataactgctaatattaatatagagagtagatatgtttttagagtagctcatgattttgaaacactatggaaacacaggatttttaacttcttctggtcagtccttaaaaagtggccacctcatttcatgatttttgaaagctatattattaccacagtcactgtttataattaaaattccaggccatttcaaatcagatatcccagaaagcaaagaaaattagctagctgataaggtagcaaaaagagtggctctaaacaaaaacactctgtattaactcttaaacacctgaatttgatataaaattagctcaatccagagctccaaaatcagaatacaaaatcacactttgtgcttgaataaactccctttaaattagactctgattcttttgattattttaggttgacgcaggtgaaggcaaatagatgctgtgattcagggcagaggaatttactggagaaggtggaaacatgagtcaaccgtgaagtaattggtgtcagggagtattgaaatgaggatggttttagggttagaaactaaagggaatccaggcttcattagtttgtttatggcttgcaggtattggactatttaatattcttcccattaagcttttgaataggctttatttatttttctgagacggagtctcgctctgtcgcccaggctggaatgcagtggcacaatcttagctcactgcagcctccacctgctgggttcaagtgattctcctacctcagcctcccgagtagctgggactacaggcgcacaccaccatgcccagctaatttttgtatttttagtagagacagggtttcaccatgttggccaggatggtctcgatctcttgactttgtgatctgcctgcctcggcctcccaaagtgctggaattacaggtgtgagccacggtgcccggccaataggctttattttttagaacagcatttgatttacagaaaaattgagtatatagcacagagaattcccacatatccctgttcctctttacacagtttcgcctattattagcatcttgctttagtgttgttacagttcatatactttacattgttaaatatagtctatttaaagactatagtttatattagttcactcttggtattgtatggttctaagggttttgacaaactcataatgatttctccgttacaagatcatgcagaatagttttacctcctaacactgtctatgttctacctattcattcctctccagctctctccaagcctctgccaactgctgatctttttactgtctctatagttttgtcttgtctagaatgccatcagtgtgaagttcctccatgtcttacttttttcttaaactcagtggcaagaagctccatgtcttttaattgtgtgatagctcattttaaaagttgctgaatcgtattccatcgaatgactgtactacagtttattcactcacctattgaaggatatcttggttgcttccagttgttgacaattttgaataaaaccgctataaacatttatgtgcaggtttttgtgctgaaataagtagttaaatatctaggagtacaactgctggatcagatggtaaagctatatatttagtttgtgggaaacttccaaattttccaaagccactctgccatcgtgcattcccaccagcaataaatgaaagttcctattgctcttcatccttgtcagcatttggtattgacactggtatctattgtagtttgtttatttatttaatttttagtgtttgagacagggtcttgctctgttgctcaggctggagtgcagtggcacaatcatggctcactgcagcttccacctcctgggctcaagcaatcctcctgcctcaacctccagagtagctggacctacagacacatgacaacacacatggaaaatttttaaatttgttttgcagagatggggtcttgttgcccgggcttcttgacctcctggtctcaagtaatcctcccacctcggcctcccaaagtgttgtgactacaggcatgagcttctgcacctggcttcactgtagttttaatttgcaatttcctaatggcatatgacttgagcatcttttcctatactcatttgccgtatgtctaccttctttcatgagatatctgttcagatcttttgcccttttttttttggttttttgttttgagacagagtctcgctctgtcgccgaggctggagtgcagtggcactgtgtcagctcactgcaacctgcgtctcctgggttcaagcaattctcctgcctcagcctcctgaatagctgggattacaggtgcccatcaccatgcccagctagtttttatatttttagtagagacggggtttcaccatgttggccaggctggtcttgaactcctgacctcaggtgatccgcccgccttggcctcccaaagtgctgggattacaggcgtgagccaccgtgcacggcctcttttgcccatttttaagtttttattcttaattgtgacaaaatatacataaaatttaccatcttaatcatttgtaagtgtacagctcagtagtgttaaatacattcacattgttggcagtcattctccagaactcttcgtcttgcaaaactgaaactattcccattaaacaactccctattctgcaacttgccctcctccccctagttcccagcaaccaccatttgttatgggaaaaagccagaacagtatagaagcaagttcccccatactgggaaggagccaagacaccaaagaatgacttagataagttcagtttgaggagtagatgagtttattgggacttacctacagggtactcctgggcagcagcaaggcagcaggacaacatggaggtctgctctgccacctgtctgcttttcatttatgatctatttatttttactttaaaataattttatttttttgagacggagtctcgctctgtagcccaggctggagtatggtggcactatctcggctcactgcaagctccgcctcccaggttcatgccattctcctgcctcagcctccccagtagctgggattacaggcgcctgccaccacacctggctaattttttttgtatttttagtagagacggggtttcaccgtgttagccaggatggtctcgatctcctgaccttgtgatcgacccgccttggcctcccaaagtgctgggactacaggcgtgagccaccacgcctggccaactttaaaataattttgtattaattttcgtgggtgcgtagtagatatatacctactcatatacctcatagtaggtgtatggggtatatgagatgttttgatattggcatgtaatacataataaacacatcatggaaaatgaggtattcatcccctcaagcatttattctttgtgttataaacaatccagttatgctcttagttattttaaatttatttatatatatttatacatttatttaatgtgtaaatattattgactatagtcacctttctaagctgcttttttttttttttttttttttttttttgggagacggagtctcctcgctctgtcgcccaggctggagtacagtggcccgatctcggctcactgcaagctccgcctcccaggttcacgccattctcctgcctcagcctcccgagtagctgggactacaggcacccgccacctcgcccagctaattttttgtatttttagtagagacggggtttcaccgtattagccaggatggtctggatctcctgacctcgtgatccgcccaccttggcctcccaaagtgctgggattacaggcatgagccaccgcgcccggcctctaagctgcttttaggctaattttctggctcttttcctactgtgtgtgcgcaatgggactgttttccttggtatgctctcagatatactctgggatgtttcggttctcagggatacctgctccttgggtgggccactgactcactgcctagctttcagggttcaggcagcagacatagatccttaagtaatctggtgggtgactcatcacactacactcagccatttcattttcttatagcagtgtctaatcttaggtgttgtacatggaaaacaaaggcgttacaggaactgcaaatagggatgcggaaccttttgtcaaggaatccttgaataataaacagatctgagaccttcacttgcttcagattttgaaggaaactgggatagtccatggagggggaatggtggagtctatttctacttttaagggccctacttccccaatatgtctgttgatcctgtagccaaagaaactgatggatgtgagtgagcatgttctgagtgagggatgccaagggcttggggaattatggggggagcaaggaaacgggtgatctatcagagctgttggaggataaaggccagggggaaggagttccagaacttcaggaattagtacgtcggataaacaaaaatattaacattccaaatagaaagtaaatccctgctaatagattaacagggattgtgaaatttaacaaaaagctgtgttgggcatgatggagtccaagagacaccaaaaggggcttagaaagaggcaaatcatccacccccactactgaggcattatggtaaggaattgtgagggttaagggtagagtaggtggttctagtatctattagaaaggtcatagggtgctcactgactgggattattatttctccctgtgtgttcaagggtatcagggggtgcacaagagcagattcctcaaaggggagtcactgggatgctgacgtttttctttttggaccttgagataattacaggtgctccagactactcatgatcgtagggatgtcgaggtgacttcaaggccttggggtgattccccatgagttgtttcagttggagatccatgagtttgcatttttcagattatttagatgcctgtacatcttttgggtttctgctaaaacatggatcttaaagagaggggcattttggcagtggtacctttggccagttacttaagtggaatttcattctctcttggcttccttcacagatgatgtatgaaagcatgaaattcaaagagacaaagggaaattgtgtaaaaagcagatcagccctctgctttactcttaccttctaggtccacaaataggtataacttgaattaggacaggtggagaggagcatataattaatacgatgttaattagtatgagtaaactctctgagtttagtatggagctcattaacaaaactggtaactaaagcagatgccgtttagagttaaacctgggtaatctttccagttgttttctaagtggtattcatagacagagactaattcatctctttgttgtcggtactcttaagtctttgatgagttgattttagttgagaaggctgtggaaatagaatctgaaagcttttctctgatttctccatctgtgatagcccctaggtgttttgagatttaactgtaggtcttcattaattttggtactctcaaaccctagggaggcatctctaggtcctataagaagtttgaataattagtaaagatcttaaagctctagagaagatgcccctaagattgactaacttgtgtaaaaaatttctcccttcatggccgggcacagtggctcatgcctgtaatcccagcactttggaaggccgaggtgggtggatcacttggggtcaggagtttgagaccagcctggccaacctggtgaaaccctgtctctactaaaaatataaaaattagccaggcatggtggcatgtacctgaaatcccagctactcaggaggctgaggcacgagaattgcttgaacctgggaggcagagtttgcagtgagccgaggtcatgccactacactccagcctgggcaacagagcaagactccatctccaaaaaaaaaaaaaaaaaaaaaaaaaaaaaaaaaaaaaaaaaaacaagaaagaaaatttctcccttcattgtatgtagtttcattttcaaaactacagtttcaaaaggccacaacatgacaaccattacaattgatgaccccgaggtggtccattttgtgcactggtcttcttcatctttagttacaagctcagcttcctctctaagtcttgaggtatccttgtatgtaatgatgatatcatttgtcgaatgcttattaaattgtatagactgtgttaagagcaagtttgcacagtaacccttttaatcctcaagtatctctatgatgtaggttttagtattttgattttatagataaggacatagaggctgtatcctcagtaatatgtcatgggtcacacagcaagttaggggcatggccagaatgtgactgaagtgtgttcagctcaaaaccctatggccttaactactacaccagtctttctccattatctcatcctctgagatgcttcccatgaggcagtctcaaactcttaagtccaactcaaagaaaatggcttatctgaatatggtttaatactgttttgatttagaggattttcctattgcctaaaggctttgcagtggtgagaatgggatgggaattcccaaagtcacctggacaagtttaatattaatttttgtgggtacatagtagatatatatacttatgggttacatgagatattttgataaagcatgcaatgcgtaataatcacatcagaatggagtatccatctttgctaaaggataaagcatttatcctttatgttacaaaaaatccaattatactcttttagttattttaaaatgtataattaaattattttttactatagtcaccctgttgtgctagcaaataataggtcttactcattctttcttgccaagaccagctcggtcggggagaccctaacccagtggcactagaggaattaaagacacacacacagaaatatagaggtgtggagtgggaaatcaggggtctcacagccttcagagctgagagcccccgaacagagatttacccacgtatttattaacagcaaaccagtcattagcattgtttctatagatgttaaattaactaaaagtatcccttatgggaaacgaagggatgggccggattaaaggaataggttgggttagttaactgcagcaggagcatgtccctaaggcacagattgctcatgctattgtgtgtggcttaagaatgcctttaagtggttttccatcctgggcgggccaggtgttccttgccctcattccaataaacccacaaccttccagcttgggtgttaagggccattatgaacatgttacagtgctgcagagattttgtttatggccagttttggggacagtttatggccagattttgggggggcctgctcccaacatgtctcccttctttgatttgcaaagagataaaagcaaaggcagctttgtcacagtgagctacttctcacaggagtcaggatccacatctgcacactatacaaagacaaacaacatggattaaaagcacaatcatcattgaaatacagagcttccaagtgtttttatccattctaatgggttactagctgctaatttgtctgcagctcctttaaggactccagttcctggcattaaggtcaggtgtgcctgggatgctttaaatatttgttcttttaattttgccatatccaaaaacaagtttgtagagtgtccttctagatgcctttttattctttcccaaattttgatcttattaagaacatctaatagtttccacaaatccttatgttaagcttctagagcaggccatatcatttgaggttgaggtgccactataccgccacggttccagataataggaacttttgccatacttcttatcatttctaccatctgaccgttttgttcagatcatctgaacatagtgtggccatggcacgcagactgagaggtgcaattcaagctaaacatccccttagggtaccaattaataatgattccataggaatcattgtgcagcacctctgtctgttctgcaaagcaatcttcctaaacaagtacgttcatctttttctaactgggtccaatcctgtttacaaaaaggtttttgaggatggtatgcctcaattatatgagcagatttattatggtaaatactgagatcagaaagcatgtgtaactgtgtcagagtgattgcatccaggcattattgccggccaagattgataaatatgcccaataagtataactgttctctgtgtcagcccctgttgaaggaatactcatggcagtggtgataaccgctatcatagctaccattaaattattcattgtgactggttgtcccgctttcctcaggttttcttccgccatctgtgacagcttcttgatctgtccccaggtgggtggctgtgtttgacgggtgttgctcgtgacaattggggtcctcctcagcatcagtcttgacatggctgcaactggggggtcctcgggatcctcctgtaatctggcttatgctaaggtttcaggtgtattgatggtatccagatcagctgttgattttggcctggagaaacacaagcataacctctaccccaggttatcttcttttcaggtaatgctgtatctgcgtttgagaccagaggcattaacatgggttaaattgtgagtgtctagcattagatattgcattagcaactaggcgatcagccatttgattcccttcagtcaaagatcctggaagaggtatatgagccctaatgtgagtgatgtaaaaagggtgcattctacgtctaactgctgtttgcaattgggtaaataaagtcatcagttgtgtatctgtatgaaatcataactgagcatttttaattaactctgttggaatgaaccacatatgaagaatcagaaatcacattaataggcacatcaaaagcagtcaatacctcaattaccactacaagctctgctttttgagctgaagtataggacgtctggaaaactttactttttgagccaaaataagaagctttaccattactagacccatctgtaaaaacattctcagccccttcaattgatttaaacttagttattttggggagaatccaattagttaatttcaaaaactgaaacagcttcattttaggaaaatgattattgagaatacccacaaagtcagctaaatgggtttgccaagtaagactttttataaaagcttgctgtatttgtgccttcgtgagagggacaataatttttctaggatcatatccatgtaatttaacaatctgagttctcctactccctatagtagtgatttgatctaaataaggagttagagtccatgaattagtatgtggaagaaaaagccattttactaagtcctgttcttggacaataacaccagtgggtgaatgctgagttgaaaaaattagcaaatctagagtcttctctggatctattctatttatttgagctttatggacttgcttctcaatcagttgtaactctgcctctgcctcgtttgttaattgccaagggctagtgagactaggatttcctctaaggatagaaaacagattactcatggcataggtaggaatgcctagagcaggtcgtatccaattaatatcccctggtaatttttgaaaatcatttaatgtttttaatttatccctaagtatggttactttctgtggcacaatggtagtgtcatttactaaggtccccaagtaagaataaggagtagtagtctgaattttgtcaggagctataattaaactaacgcaagaaatcgaattttgcaagtgatcataacattggagtaatatttctcgagtggggcagcacaaagtatatcatccatatagtgaataatgtaacactgtaaaaactttttacgagtaggttcaattgcttgccccacatatgtcaggcaaattgtggggctatttaacatgcccctttccaatgaatacgctttccaatgaatacgcttagcaggctgcaggttgtttactgcaggaattgtaaatgcaaactgttcacagtcttgctcagctaaagggatagtaaagaaacagtcttttaaatctttgactatcaaaggccaattttttggaattatagcaggagaaggcaatcctggctgtaatgctctcataagttgtgtaactgaattgatgtctcttaagtcagttaacattctgcatttacctgattttttcttaattacgaaaactggagaattccaaggggaaaatgttggagctatgtgcccattttctaattgttcagtaactaatttatctaaagcctccagtttctctttacttagcgtccattgttctatccaaattggcttatctgttaaccattttaaaggtataggttctggaggcttaacaatggccgccatcaaacattatttcctaatttttggcgagaactttgtttttccacttgaagcagttctttcaaaccttgcaaatttttttctagtcccataccagggacataccccatttcatgcattgtatgttgactttgagggctatataattgttctggaattagaacttgtgctccccattgttgtaataaatctcttccctataaatttacaggtacagaagttataattggttgaatagtcccaggttgtccatcaggcccttcacagtgcaaaatataactactttgatatacttcaggggctttaccaactccagctatgttaaattgagcaggttgaattggccatgcagatggccagcgctgtagagaaatgattgaaatgtctgctcctgtatctaccaaacctttaaatttctttccctgaatagttatttcacaggtaggacgtttatcagtaatttgatttacccaataagctgctttgccttgtttatttgtgcttccaaatcctcctattcgtttaatttcactttttcccattcccacatacggcaaaatcaggagctgtgctatgcgctctcctggctctgctctccaaggaacagaagtagatgtaacaatttgaatttccccattataatctgaatcaatgactcctgtatgtatttgtatgccttttaaacttacactagaccttcctaaaagtaatcctatcgtccctgctggcaagagtccacagactcctgctgggaccttttgcgggggttccccaggcagaaagctcacagcttttgtgcagcataaatctactgtggcactaccagctgtggcgggggacagacattgtacagcagtgagggaaaggcctgagctggaaatgccccggtttagaatggggcccgggatgggcccctcatggcatttcccgaaattgggttcccttctttatcaaacttagagtgacactgattagcccaatgttttccttttttacattttggacatatttcaggatcagcagttttcttttttcccctaactgacggcctgactcactgattttttctacattctatttagtatgaccatgcttcccacagttaaaacaagttccaggaaacagagtatttcctttatccactctcagtcctgctattgcctgtgctagcagagtagctttatgcagattacctccaataccatcacaggccttgatataatcaactaaatgtgctttccctctgataggtcgcagagcagcctggcaattgggattagcattgtcaaaagctaataactgcaacactatgtcctgagcagccgaatctgcaatcatctttttaagagacttctgtaaccgagctataaaatcaatgtatggttctcttggtccctgttttatagcactaaaggaagggtattgttccccacctgaagtgattttttcccaagctctaatgcacactcctctaagctgttctaaggcatcatcctgcatgaccagttgtgcatcaaaaccagcccaaccaccaacccccaaaagttggtgtgcagttatattaatttgaggttgggcctgggcattgtgagaagccgaatggaagcttcgtctgcccaccaagttttaaattgtaagaactgagcaggggttagacaagctcgagtaagagcatcccagtcagtaggaatcatctgactggaaacagcaacattctttaacagtcccattacaaaaggagaacctggtccatactgatttatagcttgtttaaattatttgagtaatttaaaaggaaaaggctcaaatgtggctataatatttcccttttgattgggggtgggaggggtgtattctaacagggaactgccaagcctctaaatcaccctctcatctagcttgctgaattcctacctgaatagaactaaaagcagtcgcttgaggcgctgctcaaatagtcacaggggcaactacttttcgccccgtgtcctccggaaaagaaagatctggagggtctttttcttcaaaataataatgagggggtgcagaagggtagggatgaacctctccttcctttgctgctttagctggtaaatgaacatgctctgtaacctcttctgttacttcactatactctccttcctcctcatgatcagtgtgaaaaagttccaagatggaatgaaccagaccccacacttgtcccattgttacccttccaagctccccttcttactcaccacggggattgctttaagagtactcctgtgtcctccagctggttttccattccaactgttgctctggcgacccttcgacctggatttgagcccccacgaatggacaccacttgccgagaccagctcagtcggggagaccctaacccagcagcgctagaggaattaaagacacacacacagaactacagaggtgtgaagtaggaaatcaggggtctcacagccttcagagctgagaaccccgaacagagatttacccacgtatttattaatggcaaaccagtcattagcattgtctctatagatattaaattaactaaaagtatcccttatgggaaaagggatgggctgaattaaaggaataggttggactagttaactgcagcaggagcatgtccttaaggcacagatcactcatgctattgtttgtggcttaagaacgcctttaagcagttttccgtcctgggcgggccaggtgttccttgccctcattcccataaacccacaaccttccagcttgggcgttagggccattatgaacatgttacagtgctgcagagattttgtttatggtcaattttagggacagtttatggccagattttggggggcctgctcccaacactttctaatttttttgtacccattgaccatctccattccccacgccctacccactccccccaccacattatgcttcccagcctctggtaagcatccttctactctctacgtctatgagttcaattgttttaattgttggctcccacaaataagtgagagcatttagtctgtctttctgtgcctgactgatttcacttaacataatgacctccagttccatccatgttgttgcaaatgacggaatcttatttttttatggctgaatagcactccattatgtaattgtactatattttctttattgattcagctgttgatgaacatttagtttgcttccaaatcttggctattgtgaatagtgctgcaagaaacatgagagtacagatacatcttcgatattctgatttcctttctttcgagtatatacctagcaatgggattgctcaatcatatggtagctctacttttagtgttttgatgaacctccatagtggttgtattaatttacaatcccaccaacagtgtacaagggttcccttttctccacatcctcaccagcatttgttattgcctgtcttttggatataagccatttttaacctgtggtaagatgatttctcattgtagttttgatttgcatttctctgatcagtgatgttgagcaccttttcatttacctatttgacatttggatatcttcttttgagaaatgtctattcagatattttgtctgttttaatcagattattaggttattttcctatagagttgtctgagctccttatgtattcttgttattaatcccttgtcaaatgggtagtttgcaaatattttcacccattatgtgggttgtctcttcactttgttgattgcatcctttgctatacagaagtttgtttttttttttaacttgatgtgatctcttttgttgatttttgcttcaattgcctgtgcttgtggggtattactcaagaaatttttgcccagaccaatatcctggagatttccccctatgttttcttgtagtagtttcatagtttgagaacatagatttaaatctttagacttaagtctttaatgcatttgatttgatttttgtatgtggcaagagataggagtgtagtttcattcttctgcatatggatatccagttttcccagcaccatttattgaagagactgtcctttccctgatgtatgttcttaacatctttgtcaaaaatgagttcactgtagatgtgtggatttatttctgggttctctattctgttccacttgtctatgtgtctgtttttgtaactctaccatgctgttttggctactatagctctgtagtataatttgaagtaaggcaatgtgattcctccagttttgttctttttgctcaggatagctttggctattctgggcttgtgtgtgtctgtgtgtgtgtgtgtgtgtgtgtgtgtgtgtgtgtgtgtgtgttcccatataaactttaggattgttttttctatttctgtgaaaaatgtcattgatattttgatagggattgcattgcatctgtagattgctttgggtagtatggacatttaacaatattgattcgtctaatccataaacatggaatatctttccatttttttgtatcctttaaaatttttttttagggccccataactttgagtatagttttattctgaataaagtgaatatattcttttcgtgtgtttatatgtttatacaaaagtagatgaacagatgtaggcacaattgaaataaaaggaaattctttaaaatattaatattgtattattaattgatgagattataggttatttgaaacgtcttttttatagtttttgttatctttttttattatactttaagttttagggtacatgtacacaacgtgcaggtttgttacatatgtatgcatgtgccatgttggtgcactgcacccattaactcatttaacattaagtatatctcctaatgctatccctcccccctcccccaccccacaacaggccccagtgtgtgatgttccccttcctgtgtccatgtgttctcattgttcagttcccacctacgagtgagaacatgtggtgtttggttttttgtccttgagatagtttgctgagaatgatggtttccagcttcatccatgtccctacaaagaacatgaactcatcattttttatggctgcatagtattccatggtatatatatgccatattttcttaatccagtctatcattgttggacatttgggttggttccaactctttgctgttgtgaatagtgccgccataaacatacgtgtgcatgtgtctttatagcatcatgatttctaatcctttggctatgtacccagtaatgggatggctgggtcaaatggtatttctagttctagatccttgaggaatcgccacactgacttgcacaatggttgaactagtttacagtcccaccaacagtgtaaaagtgttcctatttctccatatcctctccagcacctgttgtttcctgactttttaatgatcaccattcttactggtgtgagatggtatctcattgtggttttgatttgcatttctctgatgaccagtgatggcgagcattttttcatgcatcttttggctgcataaatgtcttcttttgagaagtgtatgttcatatccttcgcccactttttgatggggttgtttttttcttgtaaatttgtttgacttctttgtagattctggatattagccctttgtcagatgagtagactgcaaaaattttctcccattctgtaggttgcctgtttactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccactttgaattgatttttgtataaggtgtaaggaagggatccagtttcagctttctacatatggctagccagttttcccagcaccatttattaaatagggaatcctttccccatttcttgtttttgtcaggtttgtcaaagatcagatggttgtagatatgcggcagtatttctgagggctctgttctgttccattggtctacatctctgttttggtaccagtaccatgctgttttggttactggagccttgtagtatagtttgaagtcaggtagcgtgatgcctccagctttgttcttttggcttaggattgacttggcaatgctggcccttttttggttccatatggactttaaagtagttttttccaattcagtgaagaaagtcattggtagcttgatggggatggcactgaatctataatttaccttgggcagtatggccattttcacgatattgattcttcctacccatgagcatggaatcttcttccatttgtttgtatcctcttttatttcattgagcagtggtttgaagttctccttgaagaggtccttcacatcccttgtaagttggattcctaggtattttattctctttgaagcaattgtgaatgggagttaactcatgatttggctctctgtttgttattggtgtgtaagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaatacccttgatttccttctcctgcctgattgccctggccagaacttccaacactatgttgaataggagtggtgagagaaggcatccctctctcaagacagggcatccctgtcttgtgccagttttcaaagggaatgcttccagtttttgcgcattcagtatgatattggctgtgggtttgtcatagataccttattattttgagatacttcccatcaatacataatttattgagagtttttggcataaagccttgttgaattttgtcaaaggccttttctgcatctattgagataatcatgtggtttttgtcgttggttctgtttatatgctggattatgtttattaatttgcgtatattgaaccagccttgcatcccagggatgaagcccacttgatcatggtggataagctttttgatgtgctgctggatttgttttgccagtattttattgaggatttttgcattgatgttcatcagggatattggtattaaattctcttttttttttgttgtgtctctgccaggctttggtatcaggatgatgctggcctcataaaatgagttagggaggattccctctttttctattgattggaatcgtttcagaaggaatggtaccagctcctccttgtacctctggtagaattcggctgtgaatccgtctggtcctggactttttttggttggtaagctattaattattgcctcaatttcagagcctgttattggtctattcagagatccagcttcttcctggtttagtcttgggagggtgtatgtgtcgaggaatttatccatttcttctagattttctagtttatttccgtagaggtgattatagtagtctctgatggtagtttgtatttctgtgggatcggtggtgatatcccctttatcattttttattgcgtctatttgattcttctctcttttcttctttattagtcttgctagctgtctatcaattttattgatcttttcaaaaaaaccagctcctggattcattgattttttgaagggttttttgtgtctctatccctttcagttctgctctgatcttagttatttcttgccttctgctagcttttgaatgtgtttgctcttgcgtctctagttcttttaattgtgatgttagggtgtcaattttttctttagttaattcttacgtattatattttatttttaactattgtaaataggattactttcttaatttctttttcagattgttcgctgttggcatatagaaatcctactgatttttgtatgttgcttctgtatcctccaattttaataaatttatcagttttaatttggtggagtctaggtttttccaaatataagatcatatcatctgcaaataaagataatttgacttcttcctttccaatttggatgcccttcatttctttctcttatctgattgctctagctaggacttccagtactatgttgaataacagtgatgaaagtgggcatatttgatccttgagcagtcttattgaaaaagaaagaaaaaataaaaaaagaaagtggacttcgttgtcttgttccatattttagaggaaaggctttcagttttccccattcagtgtgatactagccataagtctgttgtatatggcttttattatattgaggtatgttccttctatatcttgtttattgagggtttttatcatgaagaggtgttaaattttatcaagtgctttttaatcatcaattgaaataatcatatgtcttctgtccttcattctgttgagatgatatatcacattgattgatttgcatatgttaaaccatccttgcatccagggataaatctcacttggtcatgatgaatgatctttttaatgtattgttgaatttggtctgctagtatttgttgagaatttttgcatcaatattcatcagtgaaatattggcctgtagttttattttttggtgcgtctttgtctgcttttggtatcaggatagatctagcctcatagaatgagtttgcaagtattcccccctcctatactttttgtaatagtttgagtaggattggtattaattcttctccaaatgtttggtacaattcagcagtgaagccattgggtcctggctttttctttgctgggaaaatttttatttttttattaacagtttctatctcataccttgttattagtctgttcaggttttggatttcttcctggttcaatctgggtaggttgtacatatgtaggaatttatcaatttcttctagattttccaatttattggcatatagttgctcataatagccactaatgagcctttgaatttctgtggcatttgttctaatgtctcatttttcatttctaatcttatttggctcctctctcttttttttcttattctgtctaaagatttgtcaattttgtttatcttttcaaagaccaactttttgtttcattgatcttttgtgctactttatttcaaaatctttaattctgctctgatttttattatcttttcttctactaattctgggtttggtttgctcttgcttttctagttctttaagatgcattgttaggtaatttgtttgaagtttttttttctttttcgatgtagatgcttttagttataaacttccctcttagtacttcttttgttgtatcccataggttttggcatgttgtgtttccattaacatttgtttcagaaaacttttcaatttcccccttaacctcttcattgacccactggtcattcaggagcatattaatttccatgtatttgtatagtttctaaaatttctccttttattgatttctacttttatttcattgtagtcagagaagatgcttgatattatttcaattttttgaatgttttaacacttgctttgtgacctaacatatgatctatccttgagaataattcatgtgctgaggaaaagaatgtgtattctgcagctgttggatgaaatgttctgtaaatatttatgaggtccatttggtctatagtgcacattaggtgtgatatttctttattgattctctgtctggaagatctctccagtgccaaaagtggggtgttggcgtctccagctattattggtctgtctctttagctctggtaatctttcctttatatatctgcgtgttccagtgttggatgcatatacatttgtaattgttatcctcttgctgagtcgatccccttatcattatataatgaccttctttgtctcttcttatagtttttgtcttgaaatctattttgtctgatgtaagtgtagctacttctgctcctttttagtttccattggtatggaatatctttttacatcatttttagtctgtatgtgtcttccataaatgaagtgtgtttcttctaagcgacagatcactgaatcttcattttatgtcttttgattggagagtttagtacatttacatccaatgttattactgataagtaatattcatgccattttattatttgttttctgattgttttgtggtcttctcttcgtcctttcttcttgtcttccttttagtaaaggtgattttctctggtggtatgatttaatttcttgctttttacttttgtgtctatttgttgtatgtttgtgatttgagttaccatgagattttccagcactattttataagccattattttaagcttatcactgttatcacaacctaatagtgcttgcataaacaagcaaaaagaaaactaataataactctatgccttaacttcatcccccacattttaactttttgttgtttctatttatatcttaatgtactatgcatcccttgaaaatttcttttagttattattttcaattggttgatcttttggtctatttagtataagactagtttacaaggctgggcgcggtggctcacgcctgtaatcccagcactttgggaagccgaggtgggtggatcacgaggtcaagagatcaagaccatcctgccaagagatcaagaccatcctggccaacatggtgaaaccccgtctctactaaaaatacaaaaattagctgggcgtggtggcgcatgcctgtagtcccagctacttgggaggctgaggcaggagaatcacttgaacctggaaaaaaaaaaaaaaaagagtagtttacaaatcacagttacagtgttttcatattctgtgtttttctgtgtacttactattaccaatgagttttggaccttcagatgatttcttattgctcattaatgtccttttctttcaaattgaagaactcgttagcatttcttgtagatcaggtcttgtgttgatgaaatcattcagcttttgtctgtctggggaagtctttatttcttcttcacatttgaaggatattttcacgatatgtattattctagagtaaatgttttcttttccttcagcactttacatatgtcatgccgctctctcctggcctgtaaggtttccattgaaaagtctgctgtgagacctattggagctccattttatgttatttgcttcttttctcttgctgctgttggaatctttcctttatgcttgacccttggtagtttgattattaaaagccttgaggtagttttctttgggttaaatctgcttggtgttctataaccttcttgtattaggattttgatatctttctctaggtttgggaagtttactgttattatccctttaaactttttactcctatctctttctctacctcctctttaaggccaataactcttagatttgcccctttggggctgttttctagatctcatagatgtgcttcattcttttttattattttttcttttgtcccttctgattgtgtattttcattttttatttctttatttttttatttgactattttcaaatagcctgtcttcaagctaattctttcttctgcttagtctattcttccgttaagagactctgatgcactcttcagtatatcaattacatttttcaccctgagaatttcttgattcttttaaattatttcaatccctttgttaaatgtatctgataggattctgaattccttctctgtgttatcttgaatttgagtttcctcaacacagctacttggtctctttaaatctattttctatctttatgctttcttctttcttccctggaaggatactattatgagctttcatacccttcggctagttacttctctctttcctctttcctttgggcccagggatggtgccagctacactgctgccagcctcaggctcctgcactatccctttttggttccatcacaccctatccaccataagttgttcctttgtaaataaaccctcctctaattattctaatttaagtgttccaactgttttatattgagtccttgactgatatgggaaaattggcagaatatgaatctcctagtaccatcactgaggtgtagaatactgaaagttattatggaagagttctgagatcttagcagtatagagcattgcacagtcttattcctccattatggagaagaaggggctatttggcatgtattttctgaatttgggagcatattttaatatagcaactcatgtttgctactgtttgaatgaagaaatttcactgagcattttttaatgagacactggtcaagagtgccaagcctgaaataatcataatgtattgtgccttagaagaagatgcaggccattttcaactcattttacttctctgcagcccttaaagggtaaacaagagcatgtcagggattcctgtggctccatatgaagggtcgtggagactagcagaagggcagaaaccatcagactgcagtttctccaggctaaacaatggaacatccaacctgaaaatgacgttgggatagtgtcccgatgaaatacggatttcattctagaaggagttcttttggtagcaaagataggcatgaagctgaacattgctccaagaaaaccaaacattgcttataagaaccatataatgttcacacaggtagccagtagcagatggcagagatacatttgactacttactaagtggtttcttcattctctctttgcttccttcataggagatgtatgagaatatgagactcaaagagagagaaaaaagggaaagttcatttttaaaaaaaaagataaaaagataagccctctcctttactgtaagcctctaggttcaaaaacaggtttagcttgagttaggacaggtggagaggaacatagtttaggaaaggaggctggaggcaaggagatgagtctagaatggactttgatatggaagctataaaagaagcaatcttgaatattgaaacaagagtatactattaaacaagaatgattggaaaattgtggagttggccacgaaactgttaagcaaaccgctactcaggagaaaggaagagttattagaaaaggaacacaagttcatgtttatacttcaactcttgagactcactgcaattcccttctgacaggaatttttttttgtcttatatatggtagagttaattgttctagaagcctacttcaagctaacttaagcaacaaagtgggatttattggaaagccgcttgggtgtctcacagaacccaaggaagagaattgagctggatttcacaggacctggaaaaccctcagaaactcaattgttctctctctttcttctctctccagtcagaaccttcaggaaggggagagtggctcatgggctgagtggataaaccacaaaatgggtaatatactataggtgagttttaagtgacaaatgaagtctaagctgttattgcactggtcggtgactgaaactgaaaatgggaattagaggttaagtggagggaatatgttgccaaaatgttagaaggatcttcttcaaagagaagttgaggctctagaggataatggtagggcacagagtggaggtgaagcttgtgaggggtgggggtcaatggggaggataggagagcattcctgattttgaggaggaaggatagagggttttactggtgaatgacgtgagtaagtgtcatgaccgctcgtattctcaggattcttcagtattgggagatgtgactgcagtggacagggcagtgtcagagagactagattttataatagaagcttttaaattacctacccatcaccaacttatcaggagactgacactgtccatctcctccaaaaaaaaaaactgacctgcccggcactttgatgtccaccagttgagctttatgtttatcaagaatagttgtgtaaacttccaaaactgtttatggcaggcacagtggctcacgcctgtaatcccagcactttgggagggtgatgtgggtagatgacttgaggtcaggagtttgagaccagcctggccaacgtggtgaaaccccatctctactaaaaatacaaaaaagaaattagccaggcgtggtagcgggcgcctgtaatcccagctactcaggaggctgaggcatgagaatcgcttgaacccaggaggcggaggtggcagtgagccgagatcatgccactgcactccagcctgggtaacagagcaagactgtctcaaaagaaaaaaaaactgtttatatcagttatatttgttattgtaatgatgaaatttatagacaaactaatgaaataggagtataaacataccagtattttttaaaaataagttgaatattttatgactacataaacaataatcttttaaaagtcactgtcaatttgatgactaggagtcagccatacaactataaaaggttttgagaaaactgtaaagatctaaatagaggctgcatttagtttttttccccacaagaacctttaggttctagacatttatttcaaataaatgtcaactcatctggatgtagcttatgcaagaaagacctagaagagctcttattatggacccccattcaatgaaaacacaatggccctttatttctctttcaacatgaggaggtggaagggctgttcaagcccttctgttcacgatagcccaggaggtccaggagagaggcgagccgtgggtgagcaggagtgtctggggagtgtcaactttccattgaaaaatacccctatgatcaagccatttcacttccgtggcaatcttatttatgtattcaccaaaattgggtgggagctagtgtttagctgtcatcgtccgtaggctgctgtgtttggctcatggcagggtgtgaaactggcatcagggagtgtttgccaagtgaataagggtgaggctgccctttccagagccgccgggagaaactctggatacagagaccctagcctggcgccagtcccagcgttcctcctagtcggggaggaatctgtgggtgggaggtggggagcctgaaacccaaatacaacagccactctgggctgggcgtggttccctgggagctgggtctcagatccttttaaagctgatttctccccggatctccgggcaagatgggcaagtacacggtccgcgtagccaccggggatttgctcctggcgggctctcccaacctggtgcagctatggctggtgggcgagcacggggaggcagacctagggaagcagctgccaccggtgtggggaaaggtgagcgcggactgcggtgagagctggggccctgggactcagaggtgtcactgggggccggggccattcggagggtgctgctgccccacccatgagaaacctgggaagcggggtaggggctgaggtcgggtgcacttggtgcgcctgataggaaaagcgagaggaacaggagagatgagaggcattttcctgcccgagcggaaggacagagacgcccgctggggtgggcacggcaggcccggggggaggctggcgccccgcagtaccagctgctcctcctcacctccacctctccccggctgtgctgtggaggggaaacggagccaggattctctgaaggttcaccgaccccgccgtcctccctgaagaccccaaaacctgagctgtgtactgtcgcgcaggaggcagagtttgagatcgacgtccccctgcacctggggcgcctcctgatggtgaagctgcgcaaacacaacgtgctgttgagtctcgactggttctgcaagtggatctcagtgcagggcccggggacccaaggcgaggcctttttcccctgctaccgctgggtgcagggccacggaattatctgcctgcctgagggtactggtgagctcggtggagaaggggcacagcccctggcaggctggaggaagaagcgggtggggggaggctactgtaaaagagggaaaatgagagatgagggagatggggagaagtgaagggggagggtggctgatggggagacccgagcgcggaggggtgaccagggagggcatgtgctcttgtccctctcccccagcccggaccgtgagtgatgacccccagaacctgtttaagaaatatcgggaacaggagctcgaggaaagaaggaaggtgtaccgttgagccccaggaagtctttgatcccctaccagatcccaagaaacctgccacctgcctccttacccctacctgtgtgttcttcctccaggtggggctcctggaaagatgggttaatcctgcctatagcagggaataggcaaccggaccttcctagggacgagcgattcctcgaggataaggatttagactttaatgtctccctagcaaaagggtgagtaccaggtagaggctgggcacttgcttcctagggcacaaggtgggatgcttccttgatcttcttgcactccattctttccacaggttgaaggacttggccattaaggggacactggatttcataaattgtgtgaaaaggctggaagatttcaaaaaaatattcccacatggaaagactgtcctggctggtcagttttcacaacctcccaaaaccaatatacagacttccaacccagggatttgaaaaaggagggggatggaggattagatcagtgggattaggagttcggagctcagagctcacagggtgctccccaattgatgttcctagagcgggtttatgattcttggaagaatgatgccttctttgggtaccagtttctcaatggtgcaaaccccatgctcctgaggtgttcttcaaggctcccagcctgcctggtgctgcctccagggatggaagacttgaagacccagctggagaaagaactccaggtgctgctgggctttctgcccatccaccatcccagccattacccccacctcccttctcctcccatctccagccccttctctcatctcctccatctacacccaaggtttctcaacgttggcactattaacattctgcaccacataattctctgttggctggcggggggggggggggggggctttcctgtggatcgtagggtgtttagtagcattcctggcctctacccattgatgccagcagcatccccccggttgtgacaaccaaaaatgtgtctagatagtgctgaatgtcctggggttggggagaggaggaattgcccctgattgagaacattgatctacaacatctcctcctgtatcttcttttctttctccacattcctctcttccttcttcattgaacatatatcagccttagggaaaagcgcaagcttctggagagaaatagcaagaaaaactaaacaaagccttggagagctaaaagctgaatctgtttttggggggagatgggtagctaaaggaaatatttttgctacattggctaaagctggcagaagaggggatacgtgaagaatgcagtggccttatgtggtggaaaaccagaaacttcgctgcagggagctccaagtctgaaggaagacatcagtcatgaaaactttgcattcagttttttggttctgcagaaagtgattggtgtttaaagtaaaaaagacttgggtgggtagaggaaggatccaccctggaaaatgagagaagggcagctccagaaacaactccaaccctgttttctattcctgcccctggccctgtaggctggatctctgtttgaagtggatttctccttgctggatggagtcaagcctaatgtcatcatttttaagcagcaatgcgtggcagcccctttggtcatgctgaagcttcagcctgatggaggactcttacccatggtcatccaggtgagagggcccaggtatttttctaccagacactgatctcctttagggacttagatacacaagttctcagcccccactctctctcctgctctagctccagccaccttgacacggatgtcccccacctctgctctttctgccctcgcatccccccatggcctggctcctggccaagacctgggtccggagctctgatttccagctgcagcagttacagtcacatctgctgaggggacacttgattgctgaggttattgctgtggctacaatgagaagcttgcctagcctccatcctatctacaaggtacttcagcatctctgtcattctgtatctgactgtccttcatatttcagactcctacaaagagtctaaccttgtacatttcagtctagcagcaatcaatttatatgtggagacacatacacagatacatacacacacgcgtacacatacacagtaatatggaaacacccaggacacacacttactatgagttggggggagaagtgagaataggttttgcaaaggagttgaaattttggctgaggaggtttccaggtgggcaagtgaggggtggaacattacagccacaaagatctaaagaggcgaggaaagaagggaacatggataatggctgagattgggtgagattaaagtgtagggcatgagttgggatgaggaggaagaagaagtgggaggagatgagagaagaagccatgttacttagcggggagaagaatcaagagttattttctgaccatgtggggcttccaatgcctataaagacccatttgcacatgtcaggagggcaactggatatgtgagtctggagttcctagaagaggtgtaggttgaaaatacagattttagagtcattagaaaacaaaagtatcaaagtcattgtactggatgaagttctctagggtttgtagagaatttgaccgagatataactctagggtgaaccaacatttacagactgagagaagggagcagagtgagaaaagaaacaagagaaggaacctcattgaggtaggaggaaaatcaaaaagtgcaatccatggcagccaggaaaagaaagcgtttcaagagggacgcgtgattatctgtctcaagtgctgctgagagatcaagaaagttacagagaagtgacatttggatttctcaatatggaagtcattggttaataaatggacatgcgccatctcagggaagtggaggaagcctgattcatgggggtgagcagcaaatgtgaggtgggtaagcaaagacaacactgagtgaagatttgctgtgaaagggaaagcaagaaacagggagatggcaagacaaggatgtgggggtcaagcacaggttttctttagggtatccaatattgcacatgtttgtatgacagagagaggagaaggaatataattataggagggtgaaggcaaaaagggatgggctcatatgtgggtacctgcgaggatatgggatttttagaattcttccaaggacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtatggaaatggatgggtgaaggggaggatggttcaatattggaagaatcctaggggttgtttccctttcccattcctcccccaagctctccttcctccatggaaggcctctcccaaacctgcctcatgcctgaagagcttcctgcttaaaagggctagagtaggatcataggcctggagtttcctgatactcatctccctccctctgcaacttggcatggctgtgggttatcctcaggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccggtaggtgaaggtggcacagagaggcaatgaacggaggggcgggggactgtaggtccagaaggtcctgcattggcccctgagactgagtgtcttcttcccagggaataggtacgtggaggggatggttgggcttttctacaatagtgaccaagccatgaaggatgatctagagctgcaggcctggtgcagagagatgactgagactggactgcagagggcccaagaccaggggtgagacatggatccttccccactgaaccctgtcaacacccactcctctgcaaacaatctgcttcttctcacatcatcatgagacaccccacctgcccaaggaagctgagaattctccagagtgtgtccagaaatgctaacaagcactcctgatctccccagccctgttcctacacagtgttctctctcctctgcactaagagcttcctctggaactagatacaaaacttctcttaggtattttccctcactcttccctcccctctccccatagctcaaggttcatcccaagtgcattaacctttgagcacacacaaggtgggagtcctagggtgtgcaggccagaaccacagaaaagttcttttctgtatctccacatagctttccctgcgtgagacctatttcgtgttctggtttcgagatctctgattctcatttcaccaggattctcatttcaccaggttcctcatctccttagagtcccgggctcagctctgccactttgtcaccatgtgcatcttcacatgcacaggtcagcatgcttctaaccacctgggccaggtaacctatgtgatcatcccacaacggctcctgggatggagaagtgggggatcaaatgcccaggtcatcagcctgcatttctctgggctctcctccctgcagctggactggtactcctggatccctaatggcccatgcaccatgcagaagcccccgcccatctctaaggatgtgacagagaaggatatagtggacttactgcccaatctccaccaggcacgtatgcaaaagaccttcacaaagttccttggcagacgccagcctgtcatggtgagaagcaaatgcctgggtcctgggaaggaggcagctcaaaggaggggaagtattctgggctgagagtcccaaggggctgagccaacttgtcttctgcctctcagcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacggattatatgtgtggtggtggaaggtgggaggagagaccttgctttgtttcctgcccctttattcagattccaaagaaggaaagaaaagttttcctggaatgaaaattttttctagcaatcaatgctttttccaagggtatcttggaacctctctaagttaaatgacaagtgttctggatgactgagtccactggggctaagaaacctggctcttgacaagggtttttggcttgaggcctctctgaatcctcaataagccatcccttaggctacctgcagcaacgcctctggtgcaactcccagcacagccctcctgcatgatccctccccagctgcatcccagccttcctctcagtcctgtcccaggactcttgataaaccctcttctcatcatgctctatccttgcatccttaaaacataccatctagcccacagtcctagatactggagataaatggataaagaaggaactagtaggccagactctatgttagaaattttaaatatataatctcaatttatcacaccgggcacagtggctcatgcccgtaatcccagcactttgggaggcccaggggggcagatcatctgaggttgggagttcgagaccagcctgaccgacttggtgaaaccccttctctactaaaaatacaaaactagccaggtgtggtggcaggtgcctgtaatcccagctacttgggaggctgaggcaggagaatcacttgaacccaggaggcagaggttgcagtgagccgagattgcaccattgcactccagcctatacagcaaagagtgaaactcggtctcaaaaaaaaaaaatttatcctcacaacttctctgtgaggttggtatcactatcaccatcttataacaggaaaatgaaggttggagagataagggcagaaatgacctgggaccaaaatgcagcagagtcagattccatttgctagaaggaagcaaagcccaggattgtggtcatagcaataacagttaaaagactgatcataaaatctagaggccaatgaaagcctcggatggatctgatgtaatgggaaaaaaaggagagataaagattctttgagtcttttaaagaatcttatgcattcaaattacttatgtcccatatatttttaaaaggaacatatacaatacggttaatacggtagaaatagacatgtgtgagccatccagattcacctactgatgccctcaaccttctaatgtcccgtcctgttctgtgtattgcttc

SEQ ID NO: 351 - DNA, 178128 bp, Homo sapiens
atttgctgagaatgccattatagttccaggagtggtatatacaaaattgtcaaattggggggacacaggattctatgtatggatcttaatcaagcttaattacattgttcaaatcttccatatccaaatatttttgacttgtcaacttctgagagtgatatgttaaaatatcctactgtgatgaatttgtcagttcctctttttcctctttataatttttataattctgtcacttttttttttttttttgctttaaagcattggagtgtgagaacataatatataaggatattaactgcagcagaatatcttggcaaaaaactaaaatgtcattactagtgaattggctgaattcattgtaaaaaatattatgcagccaccaaaaaacatgaaatttgttccgtatctaataatctacaggaggtcgatgttaagtgaaaaaggcaagttgcagagtatgtatattgtgatcccatttttagtaaacgaaacaaaaacttctatattcatgaacacgtttcaatatgtttgagtttgaaaaaaggctgttaacatcagctcctctaggtaagtgactggagggagtaggaagggtagcgttaacaaatatctttgtatttcacttcctatgagaaccatatttttatttgggcaatttaagttaagcctaataagaaaatgatgatgatcagcagtcatcttaggagccctgagaaagatatgccatatgaaaaaagcaagtcacaggctgggcgtggtggctcacgcctgtaatcccagcactttgggaggccgagatgggtggatcacttgaagttaggagttcgagaccagcctggccaacatggtgaaaccttttctctactaaaaatataaaaatttgccttgggtttagtagaaaccccatctctactgaaaatataaaaattagctttgggtgacacaatgagaccctgtctcaaaaaaaaaaaaaaaaaaaagaaaaaagaaaaaagcaagtcacaactgttataatccaatttttttttttttttttttttgagacagggccttcctctgtcacccaggctggagtgcggtgacatgatctcaactcactggaatctccacctcctgggttcaaagattctcgtgtctcagccttctgagtagctgggatacagacgcatgccaccccgccccgctaatttttgtatttttagtagagacagggtttcactatgttggccaggctggtctcgaactccttaccccaagtgatccacccaccttggcctcccaaagtactgggattacaggcatgagccactgcaccgggccataatccaatcttatttaatgacatggacatgttgatatgaattaaggaaacatctgggaacacatacactaaatcggtattcttatattcaagttggaggattatggaggccttttcattgctacatgtctgtattctttgcattcattttatatatatatattgtgtgaacaagaaagataattttttcttacaaaaagcctatggactctcaccaaaaacaacagccgagacatagctgcaataaaatcctacatacaattccagccacttcacagactctctgaagcccatttattaatcacccaggttttgactccagtagacacaaggagagtttaatggcaaaaaaaattcattgacctgccaattactcccacatatcctaagaggagctggttgcagggggcaccgtagctgtaaaatggagcttaacactgttccggctctgtgggtacccacctgtgtaacatgtgagggatgggctgctggccttgatgccaaatcatctgagtcactaaaaatctcaaaaggggagtgtggcctgtaaatgcatattcaatgctgtaatgtaatatttgatactgaacgagaacttttttcattacaaatttgtctgggggtgaggatgccaaatagaactgagctccggagaggtgagagaagtagctgggaaagcaggcagattagcctcctcggaaccatgcttaggaatctgaactgtatcctgaaggcaaatggggcaattacctaaaggcctcaaaatggagtctttttaggattactttggctgcatggtggagaaagaattgaagggagcaaaatggaaagtcggcataccagttaggaggctgctgcagtgactcaagagacaatggctcttgagcagtgtgtaacaacagtcagagtaggaataagtcagtggtttgaagaaagagacattttagaggtagaataacactcggacttattgatttgggaagaggggagccaaagaggctgtagttagattcccaggtttctggcttggacaactggaagacggtggtaccatatggagatacggaatgctggaagcagcaatggggtatttgaaggggctgaaaatagtagaccttaaatgtatattatgtttctttctttgactctgggagattgacagaaggcccaggaatggtttccagggtgagacacccacttccaagtctcctgccatgtttttctgagaagagcgacagctcctgctgcactcttcttctagtccatccgcccttccctctgctctggacctcttagcctttctcctcccacttcctcatcaacacggagcagacgatccattcaggagaaagtcacagtgaaaaaagttacatgagccttagggtagaatttaatgataacaagacacatattaataactgatatatatctttttattatgcacagataaaagatttaaaactgtggttatcaaaactatacatctaagcatcttcacaaaatagctgacacactgaacagagaaaagaatacaacaggggtgttcaaactggccacagggattttaagggtactcgttttaccctcatagatgatgaaaaccagcaacaaaatcaggctcattcaggaaaaaccagaagagagaagtattgtatttggaaactgataatagtcctttttagaaaaacatctgtcagtttcatgaacaacccccagataaaacaaacatgaaaaaaatcacataggactcacccaacaaaatgtgctctgttaacacaaccagcagtacaatcatcattcaaaccatgaggtagttacagtacaaaaagactggcacgcgtgtgagcaccccacacacactcacaatcatgcccactaagaacacaagcaggaaatggatttacaatcttattacaaggcaaagaaaaaaaccattttttttgtttagaaaatgctatagaaacagtttagacagaagaaatctctggctttttaaaatacagagtaacagctggtaaacaccacatggtgaaaagctatagcgtattatacagacaatctgccttggagtttggggcattttaacaacagcttcagcatcaaacaaacaacaaaatggcctctgcaaattaagggtgtagcctgcagaaataacaaaagactgcagatacaagagttcagctgaaatacaacaatacttttaaagaaacttgtagtacacgttataaaagtagagcttgtactttgtattaaaactgtaaagtgtgaagcaattagaaatactgtaatgagaagctagggagaaaataccttatttttttcatgttcattttttagaaacatttcagaaatacttaacgacattcactctccaatatgagattaggttttatcgacacagatttcttgatctgaataataattctgacaatgagacccaaacaaataaaaggtgatttttttcctctctctctcttttaaaaagatcttttggtttgcatctataaatttgtaaattaattttaaattatttataaaatcattggcaatgtagcatctctcttaaaaatatatatttaaatatattacagaaggttttaaccctgtccttctaagacatcaatcttttaatatctcctaatagctaattttctttttaacacgatggaaaagattttttaaaaaagcaaaggactgatcgaaagaattcacagtagctgaaattaaacatttcatatggagtaacttaaatttatctaaaacacttaaatatatctttatacacaaattttgtagtaaaatatagctataagtgacttaaagactctagtcttctttgaagacatctttaaacttttttatacatagaatatgctgaaacaatacattccaccgaaggttaggcaaagcgcaatattttcaaacacaggtagcgtaatctaggtcctccactctgatacccttctgttaaaaaaaaattaaaggaaaaaaattctctaaactcatgtcttcttcgtttgtatatggaaatctagaaatttttcagtagatcaatgtagatagcctggaaatctcagccctaaagtaatgttttagttaaaatgttccttattgaaaaaaaaaaatgttccttattgaatgtgtatatctatcaggtaagtcatattattactcaacgatttggtaaaaatgattgtcaatttccacatacttgtttcccatgtagacactgccctaaggttttaagcttcatcaggattacctactgaggttccattcacagacaaccaggcataacttccttattttaagggcagtgggatttgcttatgaatattttgggggtagaatctatcttgttctacttatggaattctaagttgtttgggggaaattctggaaaaagaataatttgcaatgaagctatcttcagcagtaaaataatttagcatgataattcccccctggcattctttttttttttttttttttttaacaaggaggtatcactgagcttattttagctgcaaagtggcatcatattattccatttaatgaaattcacctcaagccctttttgacatattaaatatatgggatatatttaaggcaagagaagtaaggcaatccaaatgagtgcccttttccaatctcagcactgtcttggtggaattggtgacactattcagataaccaactggagaccgacaggatttgccatgcatttgcatcttgctacagtttggtttttatgaaagggcctatttttttttaagttgacatattttgagtggaaacactcaccctaccaaatatacttaagttgcaactctaaaagcataaggacattttcaaattttctcttcttcaactgagaaaatgaatgtgccaggtgacatattatatacttgtacttgcatacacatagaaatatatcactgtgcaaattcgtccttgactttataactgaatttcacctcaaattatacattaatttgcagaacaaaatattaggaatgggcacaaatctgtggttcctgattttggtcattttcaatttctgtaggcctgtaagaaatacaaaatttgcattaagacattttgcagtggtgtatgcaagtatgggaagaaacaggaagctgataaggtcatcagcattggttttggcccagggcacaagaaaggaatgttgccttaacacttgtcagggtgcagtccctgagggcagcacccatcaagggacacatcagaccccacaggttgtggcagcaaggtcagaagtgtgcatccagacaaaggtgcaaattagacaggaggatcgcttagaaagcctcaaagcatttcttgttttacatcttggttcagatataaagaatctttggccgcatctcctcactggttctactatctggctattaaccctttaccaactccttgagtctgggtaaaactcagggccccaaattatggatgttctcacctggacaaagcagcattttaaaaactggcatgtgtttcacattgaaaacccccaagcctgtgaggggctggtggagaagaccaccattttagctttctcacatgaattctagtgtggtacagaagcccagggtcatgtttatactagccctgggtgtggggtgaatacaacgggtgatctttatactgaaattcactctgtctttacaagggaaccaaaatccagccctctgagtctggacacgaggctcagccattggtcctgcccttggcagtagctgagctgagctgggctgggctgggttgggccgggttgggctgggttgggctaggccgtgctgctgctggagcaaggcgtgctctgcgtgctgccgatgctgtgggcagcactgctgttttccgaggctggcggggaggtggggacttgctgccttcctgctgtctcccctgcagttaataaagaaaaggcagagtcagagaaagacgcatattatgtatgtgcattcctgaaaagatcatttattccgcatttgccattttaactgatatttttctcaaccagggcagaagcaactagactaggtcctagatggctggaataccttctaaaataaggttttgctatttgttgttttatttttaaagcatcatgaatgggaaaaagaagacagctgactgacaggcagctctagtggctaagacccctgagagttgatgacaaagtccctggatttcagggtccacaacctttgatgaaatcaccaccacttggtctgtgtgagctggcaactgaccagcacctgtattcaggaaacactgtccatcttctctcataaagacactgtaggatttggagggtgtgacctttcaattgtagttaagagaaccctggaagtttgggagccttgttctgaatgcacttgttaaaaacaggagtgaaatatagactttgtcctagctacagtagagagagccttgtgtgccaaacagataaattacctgagaaaccggggtgggggatagctgctattggaaaaaccttttggggaaggggtttagctgtttgcacatggggactgcagttgccagcgaatggcctctcttccccactgaggttccctgtggggtgcagtgtgagtatctcctaacactttaagcatcccacttttcattacacaccccactgcattttagctaaagccattcatcgtgccaaatgtgcagtgctttggagaggaaggaaacctcaagtcacacacatggtttgcatttaacagtgcaaaaggccctagagttagtcttctcttcggcaaaaccggcctcagtgcaaccctcaaaaaatggctctaggtagggaaaagcgatcagggctctccaataaaaaacactgcatttactttgaaaagtcagagcataaacttcataaacttcttgtaagcagcatcccctccttcaatgtgggaaaccccagagggccaggcctgtttatgaatgagcctcctctttcctgtcatgctgaaatacacatctatcagccggagataagcaacccttccagctgcttcattaaaacaaaacactcgaggaaaggccctgccctccagtgcaggaacttggccccattacttccattctctttctggggcccctcaaaagcctctgtgaaaaaagcagttctgcaaaatgtagaactggctcatgtccctgggtctggttacagcttttcctgtcacccctttcatgaaccacacagctatacacacttttgcatcaacctcaaagtatttatgtgcttgttgtaagtttggcccttgttgtacttcctctaattatcttttcttctgggattggcgggatggataggggactggggtcaatattcctgagaagcggagaagcactgcctttttttttttttttttttttttgtgagacggagtctcgctctgtcccctaggatggactgcagtggcatgatcttggctcactgcaacctccaccccccgggttcaagcaattctcctgtctcagcctcccgagtacctgggactacaggcatgtgccaccatgcctggctaattttttgtatttttagtagagacacgatttcactgtgttagccaggatggtatcgatctcctgacctcgtgatcggcccaccttggccttccatagtgctgggattacaggcgtgagccaccacgcccggctgaaacactgcttttgacttttttggaaacctatgttttggaccctccccagcactgccctctactcttcatgtgtgtgtataattaaggctggggaaattagcctccatggcaataactttctgccaaaaattcactttccccagagtaggagctttatttctagaagggaatcaaatctcttaactattctgaggtcaaaacaaaaacaacctccagagacccaaacaactctagatatactttaagaatttgactcccttacaaaccacatgttggtccatacccagctggatcctcacataatcaatcagaaggactaatgtggctatgcatgaaccacattttaaaaatattttttcctattttaataaggatacatctgaaaagcaggaggccaactccatctttttcttttttggctcacctgggctttgtttgctcagcccaacagcaggtaaaagagaaggccttgcttcatcaagcaatagggagcaagtgtgctcctccaggatctgccctgtgcttgattattcacattcaggaaaagtgccaggactatgccctgcccaggaagcctgaatatctgctttccgatgtctatttgccaaatataatttgttgccatgtcagtttattttcatccgtgcccattaaagagacctttcaacttcccgagttttgggaactcttgttctggtaatgcaaaacacttcaaaacaaaaccccaaacaaaacaaagaagcctccgcactcaagactgcaggatgcatctcaccagctggataagtcaagttaacctaatattatattgactttgatccaataatgggccaaggtgagtctctgtctgagaatctgctgggaaatattgaaagtcccctcttcagaccatcctttccagttctgtggctattttcacatgtaagatgcaaggtttctcaatataaccatgttttaaaaataactcttaccttttgacagattaagttttttcactgtcaaatggaagtgatgctacagaaaaattcaccatgaggaagaaagttgaatgtacagatgcttctacttaatgggccaacagagacccctgggttttctgagatgggtctttggctgtctgctctccactgcagtggtctctgatttcgtggagcaccaactttctctaaaacatcccttgggtgacaagtataacaaggctgctcctaaaggagatgggcagggaggacctcgtggctaagcagactaggcccaattaacacatctaagaaattcaaggagggcgccttgcttgtaaataaatatcagacttggccagcagaggaaatgtactcagtcttcctgctttcctcctaaaatatcaaaccacattgagggaacagagatttgagaggagggagagtgagtaggggagagaggaatttggtgcctgacatactctggaggaggagagtacactgaggataaggacactaaggattaattccacccatctcacagttagcctatggctgggcctagatactgccagagatgcctcaagaaatagaaaaacaaagccaggtgcagtcacttacagtgccagcttaggaggctgaagggggaggatctcctgaggccaggagttagagactgcagtgagctatgatctcacctgtgaagagcctctgcactccaacctgggcaacagagagagaccctgtctctaccagggggaagaagaaaaaaagaagcaaaaacaaacaaacaaaaaacatttcttaatggagaatgttttatttctttagcatggcatggagttgcccagatctgacttcctgctacctctttggcgtctatattacaactgtattcttatttctaagtctttcaccatggcaggtcctggggaagaaactattcaagaaagatgtgaatagcatgggaggactctgtggggaaacaagagaagagttaaaaagaaaggtgagggcaagcttggtatttaggccaaaggagactattgcaaatactctccatgaggattattacaaataggagcagacagctgttctttatctccctggagggcagaacatgaggaaatgagtttaaatggcaggactagggatttagatcagatagaaaagaacttgctgattatgaggattggttagttatagagggaatttatggaatctccttctcaggagatatttaagcacaggattgaaaaccatatacctggggacactttagatttaatattccttgatgctagaaagaaaataaagatattttcttctagatctacgtgttggatgcgattttctatcaattaatgtctcagtttcttgatctcctaactgtaattaattcacaagctcactctttaagcagagtgaacgatactacctttaatttagagaagtcttcaatcactttttatcattttcaaatttcattcctccccagcctccacacaaaagactcttcttttgcagcaaaattctccaggaggggtgagttagatgttgttagaagtcacggggaaaagactatatcaagaattaaagtttttcacaatgtcctgcctactactttctttctatattcctgcagtgtggccaacctgtttgtatatggactttggttttctgtggtatcttccctgcctttgtggcccctgaataggatgcaaaatctgataataactaagaagaagaagaaaagcaagagggaaagagaaatcaggtggaggaggaaggctgtcctccacagctatcgctacaaccctgagtcagaaactggacttgaagctctggtttgttcaatggctagacttgctaccttagtaggtatattagttgtgtttccctttagtcaacacagagataatcactacttcacagggttattagggtgagcgtacttaaaacaagaaatgcgtaataaaagctttttcaactttaaggctgctctgatgtgtaagcagaaaaaaaatctaagcgtgtaaggaacactgtttcacagagcataataaaatgctgaagttttgaattaggtgtgcccgtcccaactcatcaggcagttttcaacaaccctccatggaacacaccatgtgttcttaaagcaaaagtcaagcgcatacccaaaagtccacccaagtcaggtaagaggttttcattagaagtagctcgggaggtgccaatgtgttcagaggcctgaggtttctccaggttcccaagtgtagcccgatgaaaagagaaacagcaagcagacagactaaggtgtgataaggtaggaggcaagagaccaagtcccagggatcagacagatgcagctggaacagacggaaaccccaatgtgactgtaaagaaggcaggctccactctcttttcactcaaatgcccatatcattattttataaaaccattaaacacagaggttaagatgaatgccttcggctttcctggtgtctattggtgtgtctttttctctcaaaaaacaaagcacctcccggagcatctggccattcatacccttcccccttcttctcaccctcccctcagtttccataaaaggttaatagaaaacttaattcttcagattagaaacacttcttctttctccagtgagacttcccttgtcagttctccatttttctgacacagttcatcaggtcattgctttcctaaaggttggcatgtgtgcctgtagctgggtttctgcctgagccaatctgcttataatcagtctgtttggttattctcttcctctgaatatatgggaactccacgacagcaaggactttctgttgctcatggctattttaccagtgcctagaatagcgttggcatttaacaatagcttaaaaaatccattgaataagttgagtgaaagaacgaatacatgagtgaacaaaccaaaaaaatttagctgacactaaacagaggcaaaaagaaaaaccgaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgtaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaaacctaagccaacagtgggaaaaactgagaaacaagcaatttatgtcgccgaacccttaaaaaactcagggaatggtggcatcaggcacctctggaaacctcccttgaacatatggctataagcaagaggggttggctgaactatatgagaagcagaatagttctctacatttcctccctcgctccactgggctgagatctgcccttcctaatccaggaagaagacgggaattttactctcttaagaggaggaaactgaaggttccagaaatgatcaacaccaggcacatttgagggcaagagtaccacattcaaaagggggggattcggcaaacatatattaatacgtattttggctcacctgggcttcttttgctcagcctaaaaggagataaagccagatggccttgcctcatctagcaacagtgaaactctgaatcaagaaagtagggttccagtcctactttgtaacaaatttgtctcctgcagaatttgccatgcgcttcactatttgcattcgggaaaagcgccaggattataccctggccgggaagtctggatatttgctttccggtgtctatttgccaaatataatttgttgccatgtcagtttatttttatcagtgcccattataatggtctttcaacagccagtcctatacctttcaagcaggaggcaaaaaaacatattttatggaagcctgaagagctaaagaggaaagatccaatgatgaggtatcagggattcatcaataaaatggcccagtcagatcatcttaaagaagttcacaatcaatacatcccacccacagcttagaatttcctcattctttttttttcctcattcttaaataatcctatattaatattctcagatgatactgcacccatgaaacaagaatagaactttttttaaaagaaaagaaattcacaggaaaaaagttattagaattaaaaaagttattggaattaaaaaatttgaagccagtattaaaaactcagtaaaaaactgaaagataaagatgagacaatctcccagaaaataaagaaagcagacacatggaaaacaggaaagaaaggaaaattaaaggacaagaggttcaactttcaaataaaatgatttctaaaatgagagaaaacagaaaaaagggggtgagaaaaaaataaatcattcttaaaaatctcagtactgaaagatatgagtttctaaactgaaagggcccaattagtgaccagcataatgtataaacatacacctaactcaagagatatcattgtaaaatttcttccagaaagaaaaaacaggttatatacaaaagggatcaggaatctgcacagctctgaacttctcaacagcaatcctcagagctagaagacaatgaggagggctttcaaaagtccgaaggaaaaagtgtctataatctaacattctgtaccttgccaaactgtctaccaggtgtttctgttaaatgaggatattttcagacatgcaaggtgtgaaaaacatttgcgtcctctgtacgctttaaaccaggaagaagaaaggcaggagatacatgacacaggacatccacaactcaaaagagaagtgaagggaatgcacagaatggtagcgaagaagatcataggaagacagcagtgtccagaaatggagggaaccggttcagacaggagcaggtcagaggctccaggaaagagctgaagaaaaggaatcagtagaacattccatatgtctcaatgtattaaaaggagattgagacagctggcagggtcagcagaagaattaatgataaatacatagaaaattaagctgatgactgaggaaggagaatggcaggaacctgagaggcggagcttgcagtgagccaagattgcgccattgcactccagcccgggtgacagagcgagactccgtctcaaaacaaaaaaaagaaaaaaaagaaaagaaaattaagctaatggggtagggtggggaaagataataattaattctagggaaaattaaaagtcatgcaggatattatactacatgagttaactgtgattagcatttaggtagtcataataatgtaaacagtaaatgctgctctaaccaaaatgtcagtatatttctattaagaggatggtgggggaaggggacattttccataacaggaggtctagagcaaaggtgtaaacctgcaaagtcaaaaagcagcaatatactcaggttatttagaagtatggattaacatccaaaaggatgagctaagcgccaaaaataatgctctggggagtgagaaaagaaggtaaggacagtaggggtgtgatttttttttcataatgagtcttgtaggattatttcaacctttaaactatttgcatgtactactttgatgaagctaaaaagttttactagaaaataaaaataaaagcatttgttcctcccttcaagaaaaaaacagataagattttgcatgtgactttagggaccttcatggactagaagttagggacccctgaactaggtagggttcctaggagcatgaacattctatggttccagcaccatttcagcccccaagcacccctcctctctacagcatcttaggagagaatgtaagttttaggaatggagttttccaaacagaattaatccagccttaagggaatatctcttattgtgcccagagttgtcatatgataaagtgggaacccagtctttgtagagtaacacacattccaggtatgtaagtagatatccacaatccaaatttgtgacttggttttgtgctccgtgctgcacatggaatggaaagcgtaaacaaaggaaaagttattcaaattaaggattgtttttcacacagaggcagatgctatctgaacccccaaatacagcatatacgatctgtgagttccacagcttcaatcactgttgaaattgaacggactgagtcagtatttgtatcctggctctccccattgcccactgcattataatcttccttattaatctaaattgctgctagctgacccaggtaacaaactgaaggggttctggaaaagaactatcatgtggtcctgaagtgagtcttcttcatgcttgtatgatgctggtattcctcaagagcaatctataaaatgaaccagaggctacagtttttaataaaaagtaattttgaagctgtctcataagtcatgccaatggattttaagcccaaatgacagtgtctataaaccttttaccttctgaatcagtgtaattcattttgctggaaagcatcacaggagggaggtctttggtttcatttttcttaaatttacttacaaacctatttctacattaacagtacttgaaaggccctcctgaagtctctggcttgggggaaaaaggatcagtaacaacagacttccaaattcaatgaggatgaatacatgccataccaccaagttttgctttttatcaggtttgtgtgcttggctgtgggtaacagtctggattattggggggatttcagtggggcatgttccagtagtgagtattatctggttgccctatattctgcctggacctggcttcctggcccaagattagctatgagagtgcagctgtgtgaccaaggccagtcagtggctgagcaggcacatggtaaacatctgtgggtgacccagtcttcttggaggactttcaaactcactcccaacagccaacacaggctgccaacagccctagaacctctcagccaggcaggaggttggaaaagttgcaaagaactgttagcttgagatctgaacatgtcggtattcctgcgacaaaattacttactttaaaatgctgctctgctaaattctgtctttctggtccttttataaactgttcatgagggagaatcctcctaaactgattcacagatggttatataatactccagaatcatgacactggagtcttatttattttgagacaacttctctctctgtcgcccaggctggagtgcagtggcaccatcacagctcacttcagcctcaacctcccaggttcaagcgatccccacctcagccagctgggacaagagatgcacaccaccacgccatgctagtttttgtgtttttttgtagagacatggtttcactatgttgcccaggctggtcttgaactcctgggctcaagtgatcctcccgcccctgcctcccaaaatgctaggattatgagaagtcattttttaatctttcacgtaaacatactttactcaaagtatcctgactaggaacaagcatttgaggactcaaagtctctctattcaagtcttctacatttttgccaagaggttgccttttgggtgaatgtcccatgctaggcatgaaagagtccattcctctccttctggcgtaatctaaaatacctcaggcaggagatgtagtatttaaagtgaaaattctgatttgaatctgacacttttaactatcagaggatcactgtgtcatgcttttattctcaacagcttgacgttttgtctagcaatcaagagggtaaagatatgactctccaaaatatccttcagtacttccttcctctttaaatcagccatcctttcagcttggcccaaggggaagccaaagatcatggcattcattggtttaatggacaattaatgaaattataaacagagaagctgggcctgccacttgcctctgacggatcaatctagcacagtttatctaggttcacagtataaaactacaaggatccaagaacaaacaagaacaagaccgattttatacattctagttctccagaatgccgcaaaatgcatgtcactcctgcccatagttgaaaggaaactaagaaagaatcaatagcaggacaatccatttgttctttctccattgcactaaagactccctttgctggcctgcattctgtattggggtcagaacaggttctctcatcaggctagtatgtttcaaccttgggattggtagggaggagcacatctgaattttgaagattgagggataatagcttgaaaatgaagtgctctgtttcatcactttttttttttttttcagttcatggaaatctatttagaaaatttaactttatagaaaaacatgaaaattttatgttttatcaaagaagacatagcatgggttaaaaaaaggttgagaaaatctggtttaagtcattgattaaggactctgatggacagtgctcaataccttggcaggtgtggtaataaaatcttggctttctttttcacttcctctcatgtatatgcctatccttaagtctttggttttgacggaatggtttgtatttctgtacgttgtctgcattaaccttaaactctaacaacaaagtagctttattagcggctaaatttcaccaacatcacaatcgcaattagcacagtttaaaccttccttttctttccactgtttatggcaaattatacttttgtgaaacccaatttataccaaatatgtaaatgtaaaaatagtaggaatgaactttctctttcattcgttatttcatccaacaaaacactgagtgtctattgtgtggcaggaacacaagctgttcaccaactcttactcaacagtcacactaacctgtgtgagaatagatgtaccacaaggcccccgtcaggagtgctccgatcacaaaggctgcaaacgcaatgcccatcacggttagggtgtccagaccatggaaaattgctataaaggagagaaaccgatacacacaactttttggttagtctgcatcatgcattgcaattttatatttgtttcacaagcactgtcataaaggttgagcactaataaaatcggagaatgcaatgaagattccaataaaatacactgtattttgtaacttgcaaatttttttcaaaggttaaatgaaattatcaggtttccaaagtattctcagtttgcaatttattttgatcaacaaactaactaaaaaatcagatttgcaaactcagtaaaatcttgtctgtcatctcattgtctcactctaaggacctactatttgaatggagggtagcttgaaaattcacaggttaagatgctttggaaaataaagtgaacttccatgatcaaaatctggcttactgctgcttattcactgaacatctccaaaaatgacacactgcacagaaaacacacaccttagaatactttatacacatatttttgtgaacatttacaagtatgaaagataacagaaagaaaggagaatatagaataaaaataaactattcctgtggattataacatttcaccgatctcctcatattaaactcttaatcttaacagcttcatattgtatcatttaaaacaacctactttttaacacttttccaaccatgatctttctataaggggaacggaaatacttcccagtggggagtgatgtcagttttatggtcagcaaaacatataaatagaaccaattgtttctccatttggcaaaggtttttatatttgaaattaattccaggccccagaaatagaacatttcctttcatttaagagaactaccttctttgagtcacttataaaaagttaaaattggtttccaagggggaggagttttaggtagaatacaatttctaaggtctctgggttttgaatataagtgggaaatacaggatctccccactattatcatattatttctactttctgctccagtcagaagcaactccagtgatctctgtataaattaaatccctgcctttcaactcacttcagtgtaaagaaagctattttttttttacattgaagactgccatacactcctgtgacctttgggcagcccagcactccaaaggctcggggaaagtatgctgtggtggaacaagtctggaaggatccgaactcccaagttctggtccccactcttctagacctgtgctctttggtgtgttcatttaccttctgaaaaatgcggatagctttagtcacctgctgaagtcaggtggaggaagaggtgggaagagctccctggaggtgaagttgaaccgagccatcaacctatttaatctagtccttaaaactgatattagaagatgatttgcctttttatacccacagatgcaaaaattgaacatgattacaagtttttaatgaaactattctaaatctccaaagatagatatgtgtccatatgtgcctctgtttgagttcatattgttccataatttaaaaaaaataatccacttaagacaatggtttatgaagtgctttgtgaaaggaactttccagactgattgttaaatgtagtgaatcagccacggagactaatcctgggaatcttaggaaaggaaaaaaagcacagattcacaaattctcctcacaagacaacattatctagaagagctctgggtggacagctgggaagtccaggttgaagtcctgcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaaagtatagcaatgagttcccttagcattacgcctctgagcagataaatattgttgataagacttaaagcaaaccacttccatggctgtatgtgaattcttgcaggttagagcagacataagcatgcaagtcattaacttgtctctctaaataagttactaccttcccattcaagccatacatgccaatggatcaacaaattaatattttaaagtggtaaaggtgaaagggaaaaagaaagcagggataaacaaaggacagaggaaaggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagttgcataaagacttacgtggagaaattggatttggttccttcatgcttggacctttttctgaaacaaaaacataaatcacaatgtattctatggagaaccaagatttaagcaaagggtcatcaaagtctcagcagaaactgacacttttccatttggtaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatatacacattttctaaaagtatctttgttctcctagccttagtgctattatcctatagtttaactccccttcattgctcatcaggattatcacagaggcccccttatctccaccactaccctccccccaattatttcctcctccacatttgcccccagagtgaatattctagagcccagagctgatcatgttataaccctgactaaaccccttgatgactctccttcctttatagggaaaaaaatccacactctttaacatggcacacaaagttctccctcccttctctatcctctctctccagcctcctttcctgatggagtccttcacccatggtgggctccccatacttagtaatttaagcttcccaaattctctatgctgctctttgtcatcatgctttgcaagccatcccaagacaccctcctccccagacctgctttgttggcattttctctgggggacctttgctgagtctcccactgttccatctccatcccagcagagctagtctctcccacccttgctcattccatccctcctctgttacacttgggccacaatacctcctagttctctctctctttttctctttcttttgctttttttttttttttttttttttgctgtgagggcaaggtctagttctcagtcatctgtatatccccaagggctcagactggcatagaataggtcttccagaaatgtttggtgaaggatgattaaaatgttaatgtactttttgcaaatggaggccacagaggaaaccagcaatcagactatgaagacgttcatatgcagtttgcaccagtgccatgaagaaggcagaaaaaaattttgtatcactgttttggaaatgagcagcctgagactctgatatcgtgtgactagagcccaaggtcacagctggaaagcatcagggcagaagttgaatcagaattccagagttctgcctagcaggctaaatgactggtgagcgtagctctgtccctagctggggaagcactgatgaagtaactatttgtgcacagctactcattatcctcagcagtgaggctgagaccagcggttgagatattatggtccaccacctatttttgtatggcccatgagctaagaatgaattttatattttgaaatgattttttaaaaatcaaaaaaggatatttcatgacgtgaaaattatatgaaattcaaattgactccataaatgaagttttatatggatgcagctatgcttatttacatactgtctatggctgctttcatgctgtaacagcagcgttgagttgttgagacagggattgtatgagccacaaataaaaaataatcactatctggtcccttacagaaaaagtgtgctgagtcctgctacagaccttgaccctactctttggagtttaaaagtgatacatgtttagcacctctcttttcatctccattttcattcaccacagaaggaacacacaccttatgtctgaattcacagggaagcaaaaagaacttgggaaaatgtgacccaaacaagcagcatctgaattgatgtctataaaaataaagaagctagacaggataaaagaaaacagaattgtaaattctcaggattaaccatctccgatgggtgggtcaacattctggccacatgagttatcaatgtctggctctaggggaaggaatgctactggatgaatcagagccaccacaattgaatggtgccccctggagttgtgcaacatagtggccctggaatgaggatatatgcaaaagtatacttaaatacaattactaagaaaataaaaatgattgtatgtttttaagaaaatctaattcagtatgcagaacacacactaattacgctaactacagaatgcactaccctgggagctgggtcccatcagcctcattggcaccaataacaacaatgatgccttacatttgtacatttgtatggtgttttgcaatagacaaaaagccttcggccttcacttatattgtctcattttaaactcccaagaactctatgaaggaagagtatctacccacaaacttctcctttcaagacgtagtatttgattccctgaactaagttcaaaggcatttaaaggttgctacaagatgcatcatgtaagaaatatacacacttctgggaataattccatccaatcaaccacccatggttaaactttctcactcagaatccccaagcggttgaaaaattatgactctctcctaaggagacctcccatgtaagagtttaagttttatagtaaggcctgtgtgatggatggcattgttttaaaattcttaatggatttctgttatgatctaatcctttacccccaccccaaataggagccttctcacagagctaaacagaaacagttgttgttcatttcccctgggtgaagtctcttcgtgatttctgagcacaaacaataacaagcagaagctgcagaactgaggttaaagaattctatcctcgaacttttctcttcccgaatccctaagaacccctgagtataactaaaatggcttgatctccaccggaaccctaccatcgagttggcatgctgagaggaaaagagtggactcaacaatatttacttttggtttaaggataagattaagattataagaaaggaatcttagctattgctgtaaagagaactgtaacaataaagatttctttacagaaaggacaaactataatcaatgttctgaattaaatcttttcatatacgctgagcaaattttggtctacctctagaaccaaaattcccctcttcagattgttcagcatggttttcataaacgggatatttctggggttatgcatgagtaactgaccacagcttttggcctttagtgctcaatttggtactaggcaccataggacggagtgggcccacagtgaaacaagacgtccaactggtacccacatctattggcatttggcaaagagaagaatggggagaggaagattcctcctggagactcaggaggtctttgtgcaggccccatttaagacagagtttttactaacttaacgtcactgtaactgaaccctttttctggattctttcaatatttatgatattcattgcaattacttgttcacttatctgtatcctgccactagaccagtgtgtctcacgtggtgggtgatttttattccaggggacatttggaaacgtctagagacattttgaatggttacaactgggctggtggtgggagggtgttgctactagcatgtagtgggtagagaccagggacactgcttaacatcctgtaacacacaggcagccccccaactacaaagggtattccagcccaaacactgattgtactgagattgagaaactttgcactaggctgtaaaggccttaaagacaagataatttgtccactatacacctaccatatttttttgaataaataaccacaaatatcacgtatattttattcttgagtactttccccagcaatgcaaccttcacaccattttcagagtagccttcctaaatgacctaatcgccgggcgcggtggctcacacctgtaatcccagcactttgggaggccgagacgggcggatcacaaggtcaggagatcaagaccatcctggctaacactgtgaaaccccgtctctactaaaaatacaaaaaataaaataaaataaaataaaaataaatgacctaatcatcagtttcctgcttgagatcttctgatggttcttaacttttagaggtacatactggaatatgtatggatgaaattaaattaaatgtctgggtttccttcaaaacaatccagtggatgacagaaagtgataaaacaagattcaccataaattggcaattgttgagacttattctatttttgtatatatttgaaatttttcaaaataaaaaggttttaaaatgtaaaatactggccgggagcggtggctcaggcctgtaatcccagcactttgggaagccgatgcaggcagatcacctgaggtcaggagtttgagacaagcctggccaacatggtgaaaccctgtatctattaaaaatacaaaaattagctgggcgtggtggcaggcacctataatcccagctacttaggaggctgaggcaggagaatcacttgaacccaggaggcggaggttgcagtgagccgagattgcgccactgcactccagcctgggtgacagaatgaaactccttctcaaaattaaataaataaataatgtaaaatacacgatgttaaaaaaaaaaatatgatatccctccttcccttcttggatagagaatgaatgccctggtctgtcaattaagcatttctaccatctttccactcagtttcccctcacctcgacctcagctcgaggacaaaacctggctggtcctttagagtatttttattctggaaagatcaaatgtgttccaaaaagtaatgcctctcttggatcaacttccaactgacgttcacaactttcccttcctcaaccctcccttcccaaaaaacctctagtttgctgagaggttgagaggaaggggaggaaattaacatttactgagtatccaagatatgcaggcatttttattttttaaagttaggtggtgaaaatacggagaaaattcagtatctcaaacatttaacttgctaagaattaaacacatctataggtatgtaaatcacggcaaattttggaatgatatttattgctcctgatgacatccacatccatgctcttctgtgtatgtgcactgtttcagagaaatggttactcctctctttcacaatttaaaaaaaatcatcaccgacgtggtgtaatcatttttactgtataagcccaagtgttctcaaatgctgtaaaaagcggtcacagaatccaaggcaaacagcactaatatgcctatacttcaaaatttcagaaaatagggtaggatggcaccacctcaactattttaaatgttttgtcataaaccataatatgcataaactatttatgttctctgggctttctgagttactactgaaaatcacagaacttctcctgaactttaatactctgctaaacaggttacacatttcccaacatcttaatcctttgggtgaacagacatttttcctaaaatccttcatcttccttttagttcataatcattagggtatttggggtgttaccttgaatactaatgtgatatggtatgaaaagggagaagagggccaggtgcagtggctcatgcctataatcccagcactttgggaggccgaggtggatggatcatctcaggtcaggagttcaagaccagcctgtgcaacatggtgaaaccccatctctactaaaaatacaagaattagctgggtgtggtggcaggtgcctgtaatcctagctactcgggaggctgaggcaggagaagcgcttgaacccaggaggtggaggttgcagtgagccgagattgcgccactgcactccagtctgggtgacagagtgagactttgtctcaaaaaaaaaaaaaaaagaaagaaagaaagaaagaaaagggagaagtggggcaggaagaggggtgtgaagacatagatgcacatgattctagttttcagtaaaaactagaatcaacctccatctggaataaggcatagggtttaagagcacaggctctggaatcacagtgcctgaatttgaatcccagatccaccatttatatgttgtgtgcccttggccaagttatcactatacagaggtgctatgaggataaaatataataatccacataaagcatttagcacagagccttgcacaaagtaaatgctcaacaaatgttagatcatcatcctcatctccatcactatcatcaccatcagctttaaactttcatctattgttaaaaatttaaatggtaaaagaacgctaacccaacactgattcccaagggacttagagatcaaaagtggcaaagatgtgctcaggaaggttccattaaaaacagtggcccagaggaggaatccagaaacatttttatagtcttgattgcctactttcctgtccacagaagaaacactaaagtatgtcaatgctattggcagtggtggccacagagcagctctctgcccagctgtgaagttgccaaccagagcctttatctgctgtcccagaaaatccaagtgttgaaaaataagatgaaccaaatgaccagagagagctggagttttggcatggccttcaaagagcacctgtgtagtaaaagcacagtgaagcgtcccattggttaggaaatttttacccaaaaagtcacagattctacaataaagagacataaagctgtctgacaggaaggacattcgtgacctgttattattcaaataaaccaatgcaattaggcaaatggtcacagtctcttttctttttttttttttttttgagacagagttttgctctgtcccccaggctggagtacagtggcgcgatcttggctcactgcaacctctgcttcccaggtttaggcaattctctgcctcagcctaaagagtagctgggattacaggcgtgtgccatgacgcctggctaatttttttggttttttttttaggtagagacagggtttcaccatgttggccaggctggtcttgaactcctgaccttgtgatccactcgcctcggcctcccaaagtgctgggattacaggcgtgagccactgcgcccagcccacagtctcttttcaaatgactattccaattcaccttgaggcagaaagcacagactccagtggtctgcattgaggataaatgatttagagtcaaaagaaaataaacttaaaaggtgagaggagtcacacacagctgaaacctgccagaaaacttaccccagtaagcgcaaagttagaaagcaaatttgcatacagcccctgggaagctggcctacagtttaaccgcctcaatttatttaacaaacctaagtaataaactttcttcacccacatgcttctcaactaaaatctagtctcaattagcaaatctcataaaattgctttgatatttggtaaaactttcctcttgaacttttatacaagaaaacattgaactttcagtacaattatactaagtttaaataaaagtaattacctaatttgcaagagaaattacttagaaaaatgtcaccaggctcaaaagaagaatggatgaattgctggaagttatactgcggcaatattaatgcctaattattgtctggcatgggaaaaagcaagccgctgccttcaattactagcagaattacctctctcaaaatagttacgagtaacagatggaatccgaggtagctgctcttattgttaaattatcagagacatttgaaccagagcaactctaccttgaatagggctgggtaaaatgaggccgaggcctattgtgctgcattcccaggagtttaggcattctcagtcacaggatgggagagaaggtcacaagatacaggtcataaagaccccgctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccgggaattgcctgcccctttctaggacagctcatgaattacccaccccttgtttagcatatgatcaacaaataaccataaaaatagcaaccagcagcctctggggctgctctgtctatggagtagccattcttttgtttctttacgtctctaataaacttgctttcactttactctgtggactcatccccaaattctttcttgggtgaaatctaagaaccctctattggggtctgaattgggactcctttctggtaacaaaatcactttcatagtacaaaatggagccagctgctgcccaattgtgattactctgcaacacaatttatattcttatttctttctcctgaacccaataaaaaggaactatttggaccatccatttatataaagactgggtctattataactttcaaatggttgaaaaccaatcaataaaagtaaaacaaacaacaacaaaaatgttgccgagaacatctcatgtacacttcacaacaactttaggacggccagaaaaatgaattaaagattattttgcttcttcaaacagcatagttgagtattacaactgaaaggaccttttggaagtcacccagtccaaacctctcctttccagatagagaaaatgaaacccaaagagctggtggtaggggggttctccaatgtcccacagccagttagcagagaaagctaaaagcagtgccttaggctcccagctccaatccagtgtgcctgccacctatactcttctgccattttgagggagcacattcattcataggaagggggcagatgccaccaccagatacacaattggaatggcacagctgttttcacagaggttagtcaaccaataagacactagacagtacctgcatgcctctgttctggtaggttctgcccactgtccaggggtcacccctgctgcctagtcttgccaaatcccaatccaacatgctcagatcaggaatgccatcccagggccacaccaaaccctagatctggtgtcagcaccacccagcaggccttccagctaataccctgaaactggagccagacagtgtgctggcttttgtcaaggcccttggtgcccaggctcctctgtgcccctcagagtggcgagaggcagcctgtagctctaatcctgaaatatctaaccccgcttggaatccactttcactctcccagccttctctcagtttgacacccttagatatcaatgttactagatggtgacaactgtaattgcctagatatcccatgtgacatttggttccacccctcagatgctgacagctgcctggtgtgtccttgcttgtttataacccttggagctgtgatgcgggtccttgtcagatgctcttctcaccgcccacagggcctcatatccactcctaacatttgttagggcccagttctgcctctctactgctctggctggccagacccatgccaggtctggctctgccctgcctgtcctctcaggtactgatgccacaccccttagggcacagccttccttttctcacagaagatacagcttgctgaatgttcctgcttgtggagaaagaggcatgcttggctccaagcaacaaatgtgattgtgcaaaattctgaaaactgaattttaagatgcatttgggcagtggttctcatctgttacacctaagatgaataatgttcacatattctcaaaggcatttgcaattttgataaagcaatacaataggttatagccagcataaactttagcagtagatcacagaaagatgaactgtggattgtgtgcaattcccgggacatgggactaactagaacccttttttgcatactcaaggaagcatatttgaatgcaagggagagtgaccttatgacaggaacaacctagacctgattctttttacagaggaaatcattttcaaatagattacttacaactaagccataatggctgtaagagaaccagctaaagaaaagactcttcgggcaaaaaatggtcttctaaagtaactaactggccctttagttatcttgtgaataaagctggactttgatttacactattgggtcttcttaacaagcagagctcaggccccatgctctgatcgtgcctcccaaagcacacctttagattctgcttcatggtggatcacagcaaggggcttagtgaacgtcttcttattctgcatcatggcccagattatcgaggcgtccagcgaggtgcaggcttcgtcaggaggcacacactgcagacaggcagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacataatttattgaatacttagattgaaaaacagaatggttgtatggggactgtctatactgcattatgaaggtgacagattttacatttttctccaataagataatcatgttgctgagtttgtttcatttttaatcctggtataggctcatgtaaaactaaactttccagggtcatctgcttttaatgtttcaaaatgcagatcctgggggctgtgcccaggttgtggaggccatgagattagccgcttcaaacctattaatgagcatgctcaggcccactacatctgttttgaaaaaatatgatcacactccgcactttttctttaaaataactttgttttcttgtctatatttatcaataggtatagttcttttttatttttcttgagacagggtcttgctgtgttacccaggctggagtacagtggtacaatcatggctcactgcagccttggcctcatgggctcaagtcatactcctgcctcagcctccccagtagctgggactacaggtgtgcaccactacacccagctaatatatatatagtagtgacaggggtctcactatgctgaccaggctggtctcgaactcccagcaagctgccaagctcagcctcccaaagtgctaggatgacaggcatgagcccacgcccagcctaataggtataactctaaagtaaatgacagcttctatggtaagaagacatattaatacagccatcattttaagtctatagcaggcatcccaaaaagctaatcaagttccatcttttccaaacacaaaagagcaaagactttaggccttgctgtcattgctgctctgagcaacatgccagtcagacacttcttataagacaaccctcactgccctactcttaccccctcaaaaagagaaaagcctttaacaagagccctcttgtaaagaaaaacaacaaattttctgtggagaggcatgatgactgaaaagagttgcattttgctttcctgttttagtttactgttactttcctattgagctcttcagttaagcaagagtctatgattccgcatttaactcagtggagtgtgaccctgggcaagacactctgctctccgggtctcggtttcatcagcaaagggcagggttggtctcaacaatctctgagatctcttcctagaagattctttggcgctctctattgtcacagaaagcactcagaaaataatagaaatgtgaaaatattacctataagcagcaaacagaaagacagtggtaacagctcatccaagcctctgccagataaagggctgtcattgtacatactgtcctatttgctcctctacccaggagggaagccaggtatgattataacagtatatgaggaaatacaggctctaaggggtccagagactggcttaaagtcccattggtggcagcagagcttccttctcagtcccaggctctttccatgttatcttaccttgggggtaaagggcgacttgaggtttagggttatatcccatcatgtcatcccctgaggcttagaactctctttacgattaattttcccagattaacacacatgaagctgggctgttccaggccaggtcagagagaagtaacagccaaagccacagcaaagatccctggtaactgctaggtctcccctccaagacctctaacccttaaacgttacccttctgcccacaggaagcagctggtcccacagccacacatgaagctcctcatggctctctaccactgtccactaagccccaaccctgatggtgaatgcctacaaggctaaggcatcaccgccgcaaaagcaaacctaggaatatagtctaaatcactgtatatgtgctccccaatgattatgatcatatctgctctattttcgtatgcaaacaaaattctcttgggtgttatcagagaaaaggatgcccaggggactataatgatgcaaggaattcagatcaattgtaatctatttggaaatggtggtttttcctcctacctccatacctaagacttaaaatctgtgagttaaatgagaaaattccatacatacattattaataacactgcttgattcttagccttttagacattgatatatgactgcgaaaggactggaaatcagtttactctgtgtgagatagccacagaataaatgcacatatgaaattatacataattatggcagatcacagaaacaaaactatggcagaagatacctttcatatacaagaccaacctagtgggtatcatagttaaccttgcagatctcccctatcaaatgcattccaccaaggtcaaatggttctgctttttgttatggcaatagaacattcaatctggagagtgacaggaggcaaatatgatgaactgatatgaaactgagaaaagctaaaatatttgttagtttcccctagaagtctccctgagacaagtcaaccttatatttcacacagaaaaggttaaaaaacaatgacaatgccagtcccagcaggacctggaaaaattaattctcacaatgaacttgtcctttcggcttgctgtgtttttggcctgcaaactatctgaaaagcaaagataaagccagaaatctccctccatggaaaagcgtcttgatttatcactcgtaaggtactactaagtagcacgcatggaaaaaagaaactcatgctgtcaggatttattatctaagactccataaaactcacagttccctgctaatagtgactttaatatttcagttgggcagttccaaaacaaaaaacctcaacctgcaagaccttgggattaaacttttctgcctcacctaaaaatgccaaaataaccatccgaatggatgaaggcccacaaaccttaggcaacttctgggggtgcttctccatcttcgtacacagcgtcagctcacactgtagaaagagcagtgaggtgttgaagacaggcttgaagacaaagctgaatcgcttcttatccatgtcagcttgcgggataggaaagtgcactctcttgggactgtagaatttcacagattcatctttaggacaaatattctcaataatggtgtaatgagacatcctatcagggttcgaatatggagagataaagcacgtttggatggcaaatcccagttcttgttcagccttagtaacagatacctatgaaagaacagaaagatgaattaggaaatgagttagcatctcactttcactttaggcacaaggaccatatgccaagacagcccttcagatgacacgctgctttatcttcataacatagttatagccttctttctaattacaaaagtaacacacacacattgaaagaaaaagatattttccacttcaatttgatatagatgatgacagtgaattatttctttcaaatattagtccattagattcaaatacaagatgagtaagtctcttccacctcccaatgagtcctctgagagctaaaaataaaaacatattttgcatttaaagtggattttccgaagtaaataaaacaccagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgccaagtactcccccttcgctccataagcccaggggtagtttaggggaaatctaatctggaaacgtttccgactcatttatacttccccctttgaaaacacttgtatgggctacgtccaaattttgttaaggttcttttccttagaaacaggaagtaatgtttagccaagtgtaaacagaattcaaacctcaactatcctgaacttagctaaaatccccagaccagaggagattctccatttggtgacacgtggatcactgcatgaactgcccctccctgctatgcctcattctttgactaaatttaggatcaaaataaacttaaacacttgtagaaacagctagtccttacccatagaccaacagccgcagaatcatttcaaaagacatggagatagaaacagactttccacgctgagatacccaggggaaacccctgacatcacatggggctttgaatccgcagcactgttgtgaaagattcctacgtggtggttaactgcaggacactcaacagtgaaaatgctaatgaagaggattctgataatgtcactgtggtgacattctgtaaatactaacacttcagtatttttgcaatacttctgaaaaacaagatattctatcttggaaaggtggcaaattacatatgtgctattactaaaaactgccgtttaacatgaactcagaaaccacatgccaaaatgtgtaacagagggactgcaaatctcttctctaatctcaaaagaaagtatgtagcggcagaatgtctaaggtatcccaaaaagggatacctttgtagcagagggaaaaaatatatattattttttaatatattttatgtatatatagtttatatatataaattatcagcaaatcttttactaaaaaggattttacttttagaccagaagtgagtaggagaaggactacgggctttgtagtgagacgagctcataaaaattacatgctctcctgctcacgtgctgggcaccgagactcagtttactcacctacagaatgagaacacgaatacccacaagatatcataattgtgaaaactagcaaagtaaaagttacatgcaaacaacacagttcccagagtgtcaataaatgctacctattagtaatagtagtattctagatttaaaattttgggttattaacaactgggtttgtaaattccccaagacaaatgaaccaaaagaaaactgccattatgtgaccaacagtcacctggagatgaccaatgaacaggtggcaacactgttaacttggattatgaaagggactgtatggtgtagagggaatagaggataaactatgagaaatataggtgatatatgaaaaggtataaatgggaaaacaagaatggaaaaaaaaaactaccaataacacacttcaagtaagccagcatttgaaggatgggggaaaaaacccaaaatatccagggtaaggtacaggaggaagattgaccactgattagcataaatcagcaaagccaggcatagatttggaaaagaacaatctgcaattatgcagcacccctgaaatccacagcgcaatagggtgctgttgaccaactgcccatgtgaactgtacagccagaaaagcaagagaaaaacagccatcttggcttaggaaaagcatgtagaaggcagtatattttccccaatggagaaagaaggtgtgctcaaagaaagagaactctcagaatgggggaggggcagaatccatatgatcaaggaaaacaacatctagcgccagcgggctctgtcccagagtcagtgcgaatgtgagagttatgtgtctttccaaaacagaaacacgtgcaccaaagtcacttttaacatatggaagtaccccactttgaccctttaagcttctcacccctcccactatgaagctgagcttgcagctgagcaccaaaaccagctcattagatgaggaccttcccataagaccaacagatgatatgcccacttgaaacactaaggttgaaacatgaaaggttgtacccagggcacaagaaacagcagacatcctggtgccataaggacatttatcttttctagaatccactctctgaacctggatgtttgcattgataagacgttatgttttctcccctttcaaatggcactttggagataagtgatagtcgtatccagcgaagatcagtcagagctctggagtcacacggcctatgagcactgaatctgaactccactagtaccagctgtgtggcctcagacaaatttgtgcctcaattttctcatccataaaatgaagatattattagcctcccttataggatggctctaaagagttaactaactgctgcaatacttacaactctgtttggcacataataaatctgcagcaaatgttagatgttgttatttcattattaccgccactgcctaatattgtgtagtcactccagattccagatttaggttgcacatgattattaacattatatataggaaatagtttaaataagtttatacagatactcagatcatgatctagaaaaaaaaatgtcatgagttataatagcacatagcatttcacttaaaagtgagtgcaatttaaaagataacaagtcagtttcagtggcggcatggacccacagggatttggctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttgttaacattcatctacaaaatactgtcttcacttagcataatgtattaaatcttgaaatttcctgctttggtcagaagtcagtctggaagcgttctctgagccaatccctcatcagacctgttgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggtcagtgttgtatagctccatgttgaaggtgatgtttccgtggggctgttcctggaagctgctggggttcctcacctgctgaaggctgcaattaaactggaaataacaacccacaggaagattaatgacagtcatatgaaggatgaaggccctgtagcttcatgagctttggcttttaacatctgattttattttcagatagtccctaactaaagccaacaaaatagacagcattttccacaaaccccctactgataacaaacacataccaccacgatttcaggtcgggtgaacagggaagcatctccttcatccatatctcccggaaatccattatcacctgactccagatcttcataaccatctggccaaccactactgtccccaagggctggaacctgtatcacaatctaaaaggcaaagaaagcacagccaatgttataaaaacaccaaaccatgtgtgtttggttctgcctcacacaaacactcatgtaatcattctgatgcaaattgaaaatctgactttaagacaaaataataaaataacatccaggctttttcgaattatatcttcaaagtgatgaagaataaggagaaacccaatgcaggttcaagttaaaagctaaactaatatttgtatcttctcttgtgaaaaataaatatttatgttgtaaccatattgaataattacaaatgatttcaaatggtgggaaaacactagatactagaatggagttgaatggagttgtcaagagacttgcctataccgtgagaaggggcttccccttaagagtctttatattataaactctaagaactactagcagttggcgaatacaagaagctttggttatatatatcctttaagagttgtagaaagtttggttggagtcagcagcgaaggacctaatgtttggttatatatatcctttaagagttgtagaaagtttggttggagtcagcagcgaaggacctaatgtttactatggagcacatctcttcattgccgctcttgtacccctctaacttttgctcatttcttccctaagaaatctttctctatggtgtatggatgtggaaaagaatacgttttattccaggaatcttttttttccacctttttcgctatccacctgcagatatattcccggaatctatcttgacataggttgaaattatgattcctggattatttctaaataggatgagaaaattcacccaagggtcatgacgccataaatgaaatcctaatttcttttgcttcacatgcttggattctgaacatgatgcaaaatagaaatatatagtaagtctgaaaattactacaaacaattataattggtgagaacagctaaaacagtctccaaagggagtaggatgggaagaaaattaaaaaaaaaaaacaaactgcctttctctctgtaccaggtcctccaaagaaagtactgacgccaattaaaggaagcatctaggatattgctaaactcaaagatcataataaagaaaagaaaaatatgtgagaaaaaaaggaactttaagggatcattacatgcctttctctcctgaagcaactgacttttttttttttttattttttcttaacagacatattactgtagccacttttggtgttaacttggaccccagttttaaaatgccataatcaagtatttcagtaatatatgacattcattatatctgtagacactggataactgaacgaaaattcatgctgcaattatcaggaggtcaaaggttaataaattaattatttgagtaacaaaaggagattagcagggcctagcctggtgtctaggaaagattagtggacaagaggtcaggaagttggattcagtcgtcctggctctgccattagcccatccctggagtttaaaaaagcaagtctttttaacttcttggagttcagtttcctcacctgtgaaatgaagaagctgaataagctcatcttagggttatttgctgctccaacagtctaatattctctgaggaacaatatgcttgggttcatgggagagtcacttcccacaggaaccacgctgaccagagcacctgattgctagcctctcttctctggatggggtcgaactagcagccacagctcagccaccccatgtcaaagctggatatggcactaagaagacaccccccctcccaccccaacccaccctgtgtcaaaggtggacacagggatctctgagccttatttttaccattaaaagtaaaacccaaaatgcaaaatcagcactttaaagttcttttggaacttcacattttaaattcttttaatattcactgcctagtctctgcacccaagagaatgggtttaatctgaaaagattttgaccaactgagaagaaagatttctggaaaatgcagcttagctattgcaacggtttatcattgggggaaatctgtggaatctttctccaagtaacttcaaaagtaggagagtttcttcaatgtatggtctttcttagaggtggagagagacttaataattccttaaaggtcctttttgagttttaaattctctttttggatttttattcatgaaggagggagaagttctcctacttctggacgagactcaaatgaggccagagagaccacacatctggttaacccggctgtgcagaggtgctgctcgttcatatagcccagggccttaaaattttatccttataagggccagttgagcttgggcactgagagaagtcataatcaccttgacagtgcagcctttgtcatcaggagacggaaacggggggtgagaaaacaggccttccaattcccaaagactcaccaataaaacaaataaaaccaaagagctcagggtcaaagtacatccattttgttgagaactgacacttggctttcttcaggcctggggtgaaaaccctcttcatcttcaaagaaatgttaagactaactttaagggagcacacagccaggctctggcaaagggcaaagctttgttctggaaaacactcacggagttatagtagaccacaccatcaagggctgaccaccggggccgagtaccgcagccattcagaggagactccaaaacaaagtgtgtgccattcatcttggccttgcaggtaggatccaacagggtgacgtccatccccgagtagccactggcctaaaacaacaaccaccaaagacatggttggaggcccacaggcagttctgttgtataattgacacaattgacaattgcctggtcttccaaggacaggcgatgagaggcctgcatcgtgccccttccccaagtatctcttcccagctgcccacctctcaacagctcaagggtagtatctgttggccttggaaattcaatagcaaaatattgacacacaaggatctggaacccccaccccctgtcactgagaacaacaggaaccaggtgagaatcacagccaaggggaagtaggcccatccaactgagaaaacagtatcaagcctccggagttcaaaaatgaaagagatagggagaaattacagatgcagactagggccagatgggaaaggaggtagcctctcttccctcctgtaatcagctgcaccgacctgaaaagaatctttttctacagccacgatcatcttctcattgtcacatttgacagacagggcaatatccacgctcccttgcacctcttctggctctctgagaccaggaaacagttgtatgctgggaatgacagggtcctttggccgagggagcccatcttctccctcttcattccagactctcctggaaatatctgggaaaggaaacggaaggcctccattttggccttcccctccccggatgggcgggttctgcagggcaggcagggcaccagggtccagcaggatccgtagctcaggaggaatagtgtggacttcctcatctcccatctcctctgctggtgaaagaagaaggcaaaacatcagcagtgtttgatgccaggccacaaccaacatcattacaggcagaacaggaggaattagcatagaatgggcaggtgtaaaatgacttttaataagcagtgcataaaggtcattagaagtctagaagcctgaattctagtcctggtgttctctctaactagctcagtggctttaggcaagcggcttgcttctctgtgcctcaaatttgcttttccaattttttaaattaagtggttggaaatgatcagtggttcttaactttggctacacatgaaaatcacttgggagctttaaaaaatattcctacgcccaggttgtaccccaaacaatttaaactcagactctctggggtggtacccaatcattaatatgttttagtctctccatgtgtaactgcaatgtgcacctaagactgagaaccaatggaacagacagtttctaaggctgtccaagctagaaaaatctgtgatttaagttacatgatgcaatattattccattgaaatgccactaaaatactttccttgaatcaagagagtcttttgaataatttctctaatgatgtcttgaaacaatattggtatgttaaaattacttcaccaccttctttttgacagctaaattttaacaggtatctgggcaccttggccttttggaacatattcccttgaaagataagaaatagctgcatagatacatttattccttcaaagggagagacgtatttccatacaatcaatactcaatattttgtcgtatttctaacaactaaaaaaataataatttccccagtattctttatatctactatctaaggccaactgatgtacacttgaggtcaaatccatctcagtggaagctggaagtgaagatgatagttggacattatctctcctttaataatattctttggaaaggacgctagagctgtaagggtccaaaataagtcatagctttgtagggtttttaatttgtactttcacgaaaaccttcacaacaaccctgtaaggtctgtcctattattttccccttattactgaagaaaaatctgtggctcagaggtgaagcaacttctccccaaacagtgactaaatggtagagctggggcttgaacctgtactcctaatccttattctattggcatttcactcagtggtggtaccatgagctgaggaacaggtctagggatcacaaaactagggtttcaagtcatgctagctagaagactccagaaaacctcaagaatttgttgaccctctgctttccaccccattcagctggggtagtaactcctgccatcctctgggtatgaacactcaagtatgagtcctcgtgactattttcctaaaagatacagccttttaccatgaacttctttcctgcagtcttaactcttctgtattctcagccataagtggtcattaggtgtctcggagagaagaacctaatgtaatcacactaaagataacctataacaaagttctctgaatatgcattcaactctatgtcactgaaaatctgtattacagtttcctcaaaatctctgtctaggtaattttaagccttctgataaaaagtagtcaaattattaaaatgtacaagagaaaaacagcaacatataagctgaaatgacagttcctcactggaaaagcttcatttggggggtattttttacataacttaaaaaacttctaacttaccattattttcaagccgaagatgaaatctattagccacaggagccattgtgtatgaagttattggactatagccattgtccaaagcccacttcaccagattcccttgggttgaaggaatgtcatctcttattgatttggtcattgtcatagatctttcactctcttttccaaagccaatactgttaggagcctgaagatatagcaaaaaaatcactcatgagtctaaaattaaacagtactttagataataaaaattaaatatcttaaataagtagattctatattgtatatgagggaattatttattcttttgacccctgttttccttgggctaagaacgatgatgtgaaaaacctttaatagccgactaaaagacatctacgtatgctgcttgatcatactatttgtattgcctatgctgataaaaaaaatcatccaatgacatgtaagtagttacatactaagtatgcctagtctataactgtacagttagtctaatgtttaaattattaacacacacagtacatatgtataataaactttcccttttttttacttaaaatgacatataaagtatacaaacagacatgttatattgccctcaaattcccatgcttccacttcctattcccctagatttcaatgaaagatagcacaatcacttacagccacttaacaatggagatatgtcctgagaaatgcatcattaggtgatttagtcattgtgtgagcatcatagagtgcacttacacaaacctacatggtagagcctactacacacctaggctatatggtacagcctactgctcctaggctacaaacctgcacagcatgttactgcactgaatactgtaggcagtagtaacatgatggtcagtatttgtgcatctaaacatagaaaaggtacagtaaaaatatggtattacaatctgataagaccactgtcgtatatgtggtccctcactgactgaaccatattatatgctcaagactgtacttcagtgtggagactatcccatctatataaactattaaattccacatggtaaaacaaccaatgtttatatttcatctaaaatgtatgatcaattagtaattctataactgtattcatttgccaattctactaactgaatatacttgtatcttctattctaaatattaattaattaatttaggttactctccccttaagtatcactgttttatccagtaatacaagtaggtcttaagattagctttcagggatgggtgcaatacttcacacctataatactagcatttggggaggctgaggcggaaggactgcttgagcccaagagtttgagacgagcttgggtaacacaggaagatcccatctctacaaaaattttaaaattagccaggcatggtggcatttgcctgcagtcccagctactcaggaggctgaggtgggaggatcacctgagcccgtgagttagaggttgcagtaagctatagtcatgccactgcactctagcctgggtgacagagggagaccctgccttaaaaaaaaaaaaaaaaaaaaaaaaaaaagactagctttcactggataatcaattacaaaattaaaatgacagaaatatttttgggaaaggatataaatggactctactcaaccaggttattcaacaaggacatggaaggtaaatttatacatcagttgctgactcctgtggcagtgctcttctcagagggtgagagagctaaatgctgcagaggggaccccaaagggaaggtaccatattttcaacaactgcaccaacagggctggaaagcccttccagcatgcagattacaccattttcgtgctgtataaaaatcactttaatttccatgcccagtgattttctcctgcatgcatgcagcatttttcctaaattcctcatttgtttcccattctgtttgcccctaacatgactaaatattaatcctttcccactgtaaaaccctaaaagattcacaggctctaagttctcttggcctatgtggttgtgggatattggctgaagccacatatatttcaactcaaatcttaaaggatctcattcagtatatttttctattacctaaagtgcttatgtgtgggaatactgccagactcaccagtcacaaattctatatgcaaaggaaccagacagaactttaaccaacttctgcggccatttgtaaactcagtttaatagattcagaatattttagctcttactccaattcagaaaaaaactccttagggtaaagaagggctagggaggaaagaaacaaagaggaaggaaggaaggaaagagctaaaatgagatcatgaaagatccaatttattcttagaactttttatgcattcagtcaacagtagtttcttaggtacagcttcttccagccttttagagctacatgtcattttgattggctggaatcacaacaattggcctaaacaacactgcttgccctcatctgccctagtctctttcatgttgttggacagctgagaaaatatcgtatttccagaacactatcatcataactgccacctgtccttttgcaccaatgtggaatgagctgtttgcacctttccagattaaatctaggagctgtcaatacatctcattttgattatgtctgggaacttaaaagactcaacatctatctacacatttgtaaagcagcaaggcttgggacaatggcagacaagttggttcccagctttgagcaaattctcacactgtacttctggaagtccctaggctttttccagctttagtggagctacgccaaatgcaggtgtacaaggaggtctccaaaaaccaccaccatctttcccagccatatcttcatgaaagataaggagttaagtctaagtgcctccacactcccccatatttacatctggactgatggtataggggagggaggactaaggaagggaatggccagagagcgtagtgcatatgcccactgagatttttaaaaatgtattctctaagaacaagctgcccatcatcaaccctgaagtcctgaggccacatgaaataatataagaggaaacctctaacaggtttcctccatctatttttttatgttttagaggttcttcctaccataaaagtgattatgcatggtccacacaggacctgagaaaagagccagagctggacaaggcaatgtagacacctccaatgttcccattcttgcccactgcctggctctttgcacctcttttgaccattttgccatctggaggacacattctgcccatgccccacccccgacacacacatgcataagacatccatatttaatggtgctcttctttaaattactccatcagactccttacaattcccttagtagacatctttctttcttttcaccttgtatagagaagtgccctaattgttcctatagacactctgaaagagttatttatggaaggaagatgaaccccctttttatggcaggcactctgctaggcatatattatcttatttctcttccaaaatataaggagataggcattaccattcctgttagagaaggagaacctaagactcacagaagcaacacatgtagctgagaacttacatgcgcaggccctgtgtccagtgctttaggtgaaatatcctataggcccttaacaagtatttggcaaataaatgaacaaacaaatgaactcagctaatgaaccacaaactcaaggtgagtactatcatcatacccatttcacaggtgaccaaacagactccgtgttcatcagtcagactgcacaacatctactaggagtagtaattggaaatgggatttaaatctagccctgtctggcacaaagtcaagattctttcaatttcactatgctgtctctaaaggaaatactagaaacaaggtttctataaaccattgccccctttctaaatagtaatttaaacttttgtgggagcaggtacctttccctcacagcacagtcagaattcacatctgaaacagggaattagaaaatcacaaagcataaactggttgggagaataaaaaagaacatcatgaaacattacctaattgtttagtaatgttgtcatgcattgtccaaaattggcctggaacaagcgtacagccaaggagaggaacataaacagatcttgcactgggatgagcaatctcatttctagcctttctgattcatatgagagatggggacattcaaagtgaactccaggactgccatggaccaggcacacatactcagggaaagagccatcgaagggtcaaggctgaaagaatatttacacaagaactccagcagggaattaaaatgtaccgtatgtttttgcctttcaaagcatgattccctttcctgtttttgttattctgaaattaaaaacatttggccggtgtgccaggcagcaaaagcagcagacagcctaggtcaccaacacccctcatgccatgccagagaaggcaatcaaaacatctctgacttcagatcatggctaggctttgggcttgacaacaaattaatgtatcaccattacatatgatggctcactgggatcctagcaaagttataaaaaaaaaaaaaacccacgggaaccagaaacgattactttaaaattaaaatatgtgtgctagtggttttgcctgctgcctctggtgagtgcttttacatgacgttgccaagggaactgttggctttgctcactgtggtatcacatggaaggtgccatgaatgaatgaataataccaaaaccaagggcatccctctcccaaaatactgaaaacataaaacccacttcagcttactcagtgcaggaactaaaagagagattggccaaaaaaaaaaaaaaaaaaaaaaaaaatttgagcccatagaagagatactaaagagataattatcttcttaaaaaatagggaggaggatttttctttaactttcaatataattcagtcaaatagttattgcctaagcatatttgagataagatttactttaccaagtttcaacattcaacttttgaggaaaccagctgctgtttgcccatcatgccaatgggctaagccttgtgcgtacatctctattaaatagagggccttgggaacaagctggagtagacttgtccagcatcatttcactgacttcgcacttactgtgattcttctatcagtgtttcacacttaggagttggaagcaagcaaaaagacatgccaatatttcgtatttaactcaaaaagaaaagtcaatgatgtgagctggggtcagcctaatagtccatactttctctaagtacctaactccaaaataaaagctgatattcggtactatgacactgaggtccttgtgggatgctcaatatgaaggcttaattgtgttcattactttacacttactattagtggaaagcatactaatgtatttcaggaatttcacaaatgagggagctggggttcagagaggttaggggacttgccaaaggtcacagtgggattacctggactcagacctgggtccgtcttaatccaaggccatgtttgaacaaccgcacctattttataggagcatgctattttgcaaagtgaaaaataattgacagagcttagagagtccaaagaggcaggaactttaaaaataacacttataaagtacagcttaaattgttgtcatttatctaaacaaaacaaaagacatgctccaccaacttacaataattttcaggcttcccttaacatcaaaagatttgatcacccagttgacagactttttgcacttcaagatcaggatgagatttttgaccacttcaagatcctcttgagaaggtcttatatcaattgttatatccacctggaaagcactgtgaatggaagacaaaggcaaagttaagacctacatgccagaaagttgcaactatctcccctcttccaagtcttcatgtttctagtgtctggccagttgattaaaaagctggagttgatcccaggccaatgacatgtgcaaaacagattgttactgcacacataacaaaattgttttacataacaatagaaacatatgcttgctgataattagtcactaaagtttttctcttctttgatggaaaagaggtggttacttaatgcagccactgtttgaagtggacttgaacgaaccagaagagtttacttttgaagcagtattgttgctttttcaaccttcaacaccttcgatgtacaggattcccatttggctaatatgctcaaattccttcaaaactgaagtaggtggcagtttggtgagttgggggcggggtgttgggataagggaagcatggtggtaaaaaaaaaaattaggaaacttcagagtaaaataagagacaaaaggctaaagaatttcttgatttatataaggtttgcttaagtcattaacaattgctacagaatcgtatctgcatttactttcccaaacttctggatataaggttattaaaataaagaaaacagatggtcaaccaagtgattactggaaaattgatgaacacaacccaaacttctaagaattcgtaaaaaagagaattttttactaaacaataacatccctgtcattctgaatttaagggaacagtctttctttccatctcagctttacacacttgtaaagcataaaatgcatggtatactccaatgaagcctcaggcctgacgtcgaagcacattcaccagactgctcctattcccattcccttttcactttctacaaaattcttcaagtggccagagtggaatcttatcaaaacgatctgtagcttacacgctttgaaagtcaaaccccgattagcattttcacctcgaaatccctctacaatatacatttaaattttcaagtcactagtccagatgcaaaggaaggagggtgaaatgcaggctcatgtgggaaaagaacctactttttctcctttttctttaattccctaattattcttgatagggagggtcgaatttccaatccaggggtaggaagctgagagggagaacaagcgcacaagggagaggcaagttctatcgaatggctttttggtatgtcaccatgaagggccactccagcatacacacacacacacacacacacacacacacacacacacacacaccaagcacacaagggagaggcaagcgctatcgaatggctctttcgtatgtcaccatggagggccactccagcatacacacacacacacacacacacacacacacacacacacacacacaccaagcacacaagggagaggcaagttctatcgaatggctctttggtatggcaccatgaagagccactccaccacacacgtgcatgcgcatacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaaggaagagtgactgtgtcctgtaattaacacccagaagtttggaacaggcttcaggaattcatctgaaatatctgggatctagggacagatgcagaatataaaatataccactggtgcctttactctgttcttcaaagcttctgtgaaacacatctgatgaagcacacctgaagcatcaatggctaccttccctcctgcgtgaagcatcaatggctcccttccctcctgcgtaggggagggtgtaggacgggctacacctctccctgcctcaagtcaaggaagatctttactttcatctcttgtcacactcacacacttagactcacttacctgtaggggttagagttgggggtgattagctcgatgatgtgtacttcctcattctggggctggctggacatcacacacccttctgctgctttgggttgaaggtactcagcaaggtaattgagtgagagaaaattcttccctatgttgcactttggagggaacacttgatctgaaagaggcacaggacaatctgtcaaaccactgaggtactcggtaaccagattcaaaggaaggagggtgacagtgaaactgagcaaatggcagacacagggaaccacgagctcaaaggatggttcttcgtctgtgaagtccgcaaccactgccctgaaatgcatcctgttatggtcaccagtgaccgcctattgactagcccccaactaggggcctcttttggctaaatcttctccttgcatgttctctgtgatacttcctgtcctcgtctgtttcctctgacctatctttcacatctcttccactggttcctcctctgctcagaatctgtatagaccccaacccagagaatctgattcagaacacccaggcggggcctagggagctttcttttttgaaaagctcgtagtagattccaatataaaccaaggctaagaacttctcagctccttcctcaatcccctttctatctcattctttttctaggtgatctcaatcactcccatggtttcaacctgtacctagatcatgactccttttctgagcagttgacttatactgtcatctgtctaccaagcatctcctatctaaaaatccaatacttatgtatttcatggtcagcgtatttaacattcaatccattctatccccaaatgcactcctccttggatatttgttatttcaactatcaggagaagcaaccacctaattaatcctccgacaccccatgtagaattaatctttccctcatatgtattcctcacagcactttatactctgaagatgaaaggtaggaatttgggggaaataaagaaggcagactttcactctttctcacaatctgaacacagacaactcaagtttatatggcactttacagtttacaaagtgctttcgcaaacattatctcactgtgctgagagttgctcaccacctccacccgggaaagtgatgcaagtaccagaatctgaagacactcccacaacggcacatgccatttacacagcacggcggctgatgggatttccatccacgggcttaaatatttcaacagaacttgaaagaaactgctggcagtgtgacagctgggaccagtgtcaaggaagttctaggtgtagcatgcttttttcagaagggataattaatcagaggcctggcactactataaaacagacttctgccttttccattttgaggacaggatgccagggttcaagtccacatggaagtctcactttggagtaaggaatccaaccagggggtcccaagactgggttgatactgtccctccccctccccacttgtgcaacctcccttgtgctgaggtccgcagcacacactggggcatcatggctctggccaccacagcacccccagcaccaccccagaacaaaggggaccaaagcctctgtttgtcggctcgttgcgagagagcattgggtttgcactctgcagtctcctctaattcccctccccctcagagagaaaagctcaaggctccactgactcaggctgctagagcagcctccctccacatctgctgagggttttgccagatgagcaaatgaggtatgcacaccgtgcagctgcagccctgcggatgcctcccccacatcacaggatggaaaatgatattggaacggcaaggttgaaatttaattaagaaagagcgtctatgggccagggacaggacagtctggaactcaagagactagggccctcctgggattgtggccggcatatccagttcataggtgtgcctggcttgtatctggcacatagtgggcatatggtataggtttcctgaattaacaaacaatgatgtgagatttgagacaaataacaaaatattcactcatgtgaagccactaggaaaggtctaattgttcaaaagttgatgttattaagggctctagtcccagaagccattgtcactaagttgaataagctgaccacttttgttgtgtgtggtttctcccccgctccccaatgactttccgaatgcctggcatcaaaacttataccgagtgccaagtagaaaggaaaccacaaaggggaattcccgggtagaaacctggcaagtttgggggcagggggagtcacatgcttatttgtattttagggaaagattgacaaatgactttgagacacagaaggatatactctgagagcaggaatgaacctggggggtaatgcaaacacctcattttcctgctgtggaaactgaggctctggtggtaagtcaatgttgcttgaagcctcgcagcaagaccagctgggataagagcaaaactcttaaattctttcattctgggtatatagatgagagcagttcccaaacgtcagcaagcatcagatctcctaaagggctgattgaaacactgactgctgggtcccacccccagagttcctgattcagttggtctgggttgggcctgagaactggcatttccatcaagtccccaagtgatgcggatgctgctggggcaaaaaccacactctgagaactgctcgggttagagcaaccaggcctcatggcctgcgatcgctgggtacaagaaaggtagagccaggtcggattctgggaagtgggggatgaagcttgctcagtgcagtctgagccgtggtgataaacatatcactttatggtccactgacctcaccaaggaacctcctttccctactgctcctctctccacggcatggcccggtgactcatactcaactggtggctggagtcaagtttcaggggttccgaaggtgttaccaaggagttaacagtttttactgcaccagacacaaggtcctttaagttggcttcccctacccagtgtgcacaggctgaaccagttaagtgacaacccgtggctctcagggtaagtgactactgtgcttagaaagaagctcatgcactgccgagagaacacagtccaacattctaaatgttattataacaaattttcttattctaacaaattccaaggggtaatcaacattctttcatgctactagaattctgcttcagaaacgcggcccgctggccagggcttagagtctttattaaaagaaatttttcattttgtctcaatgggatttgacctctgttattagctacctatcatgagagtacagaaacaaacttagactttttgagcccagccctcctctaagtccccttctctctgcctcaactaaacaaggatgttcatccaggtggaccacttccctttttgagttatgcttatttggctaggacttaaagtacagctcaggcaacaagcgttaaactcaagagtcaggaagcctgggtttgtgttctggctttgtcacttgttagtaacttggatgtgagcaggttcacttagccctccactaagccctctgtaaaacggtggaaatgacatcttcctcctggggttactgtggggttaagtgggatgcacgtgaaggcccctgaaatggcttctgcacgtagcatcctctccgacgtccacgtccacctttcctgcctctgtctctcacacactttaaagcagcccagatccaaataagagttgggatcaagtgttcactaacccacccttccctgtcttgtctatgaggaggtgacagctgctgtagaatttaacagaaagcagctggatgctgaagaccttaaacgcagtgttcacacaatcagccagctataacaaggacccattcacaagagttatttcctagtaacttatgggggttccaaatatactcaactgaaaataatgatttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacttgagccctgcaggttgaggctgcagtgagcactgatcgcaccactgcactccagcctgggcaacagagcaagaccctgttgaaggaaggaagggagggagagagggagggagggagggagggaggaaaagaatgaaagaatgaaagaatgagaaagaaagagaaggttttttgtttttgtttttgttttaaaaaaggctttcaaaactgggtttctggatatttctatccctttgcaatgcaaggaaatttaaataggcaatctcttatcaagaccctacacttcttttctccaataatttgtccttgtaatagtcatttgtactaaaaatatatttaaatacttttcctttgctattgtccaaaatgtaacctatgtctcagcaccacaaactgacacaggcttcaaacgtttgcagaacacaggtaagaggaagccacctgctgacccattcattctgccagctcttccactccatcagtcatcacctccttcccacaccctcagcttctcacctccacttactttttttgacttctgtgcatgggtgtcttctaaatcccacacaacaaccttctcctctctccccctgctcctccctgtgtttcacttggccataaccaggcctgcttccccaggaggaaaaaagaagggagggaatatggggggcggtggagaggcctggggccaaatgacccctcaggtcccttccaggtccaacattctgtaattctgtgattccttgccctaaccacctggtttcagaaaagaaaacaattgcctgtcataaatcagtcattaactgaagccacataaaatttaccttcccccactttaatataaatgtttcttgctatcttgagttcggtgaatgaagtaactgctccatactcttttcgggcccaatttaacagatgttcatttccatgggggaagttcctttcttctgtttctgctgtcaaggagaagtttgctgatgaaaactggaccacagaaccctcagacacctagaggaaagagaattgcgtatttaacatggtgcagtcaccggagctgaatcataattagagaaagtacttctcaaatcgaagtgcttgtaaatcgaacctcttccctttgttatacaagcagatcagcgtttttaagcagcggattcaaggaataatcccaagcctagtcctcccagacaaaggcaaaactaccaatgcaggatgtccctctgaactctgaaagaaccttgtgaggacggactgcattgcacattgagtaatcgtaagaattatcactgctatttccaagaaatctaaatcgaagaccaatcttacaatgaatgtatttcaagtcaagtgggaagccttgatgaatgttctcgtgggcttataaaaagcttcaggatcaagacaagtgatcccaaagtcctgctagcaactgatcacgactttcaggtcttccacagttgcagcatctgccaacagagtcatcacaatagggaaacagcgagagtcctcttggtttatgttcacctcagcactgagataaaaatggccaaaggttgccagcctttctatcacattgctctatttcataagagtgagatgaatgtttgtaacagtttattgtgtaagacccccaaattcccatagataatgaagtcaagaggctgttaaactgatctaataaaactttcaggatgacgtatgcaagtacctcattcttgctgaatgtatttagaccactgctgacctagcatatcatggtatatgtgtaattaacacatccaaaggaggaaaatcatcatcttgttgctgtgctataatcaaatttagttgctggtgaaaatatgtatgccatttttgttggctagcatttataaaataactgattttttcaatgtcagagtgaaacctcaaaatgtgggcaagaaggctcacaaattctcaggtcatagaactataaatgtcttgtattaaatttcacatgaaccatttattcataacgaaaagcatgcagtttctgaagtaagactaagaagcaagtcgagggcagggattttattagtggttctatcacagcagcatttttaacacacacaaaattatattttcccagctactgtgctaggcattaatattttctatacaattatataaacgtatcttctaaaaacgctggcaaaaaaaagtacttcaattaattgattccatgacctactaatgttgcaagctgaaaactagaatcacctgaaaagtttctagatatcctgatgcccgggccacacagatggtacagagctacatgttccactctggttttgtttataactggcatcaggacattcagaaatgatcgtgactacacttgacagcactgatacgtagtaagtgtgcagtcagtggtagctgtgtagaactacacagggctctgtggaagccctgaattaatcactaataaactcggtgtaaaccaaagctactcacaacagctaccactgactgcacacttactacgtatcagtgctgtcaagtgtagtcacgatcatttctgaatgtcctgatgccagttataaacaaaaccagaggggaacatgtagctctaaccttgttttgacgtcgcctgaataagaaaaaaatcctaggtcattttcctgccaaaaaataaccatgcccacctaagtgtaacttctctgaggcttagctactcatcaacactgaacttccaacaatgtttatctaattttttgacttttgcactgtagtaaaatcttcctttcacttgtactaaaaaggcatttttatcaaggctgtcaccaaaacccacaacagtccagaggcctttgtcccactgccagcacagttctgaatgtttagacgagaaaccctggatgttctgcttcttgtttctcattcatgttgtggccataaactacagcaaccctatatacattatacacagagtacgtttttcagagcggaaagcgggatgtcacactggtgcattccagaggcaagaaagcaaacagcacaaatacagaagatatcaacggcaactccgaattgtgtcctgaagtaattaaagagcgatgccgtgatgaagctggtgatggggctgattcgtggaggaggaacaactccctctgctccctccaggcattgttgtcctcacgggccagcagcaataagcttcatacactcagggctgaggaatttggaactggagttaactgccactcctcaggcacattccaataagaagaaagcaaagctgcagtgaggtgtccctgactgcaggtcagtggaaattttcagcttcagcaaggagtgagctagcactcccctcctgactgccagctctcctgaccctgacaaggctacagctgagttttagaaggtgttgttttagaaggtattgttcagatgttatttccatctgatttgcggaactgtgaggcaggctacggtgacctctacagcagaaaagcggaaacctcagagagtctaatggcctacccaaggccagagagtcatgcaccaggcccagaccagaacttaagacttctgactcctggtcacagctggcctctgcttgcacccttccagaaagaagacctcactagctcccaagacagcagatttctgttctgttagattcattttttatacactagtctgagccatgcctactagaacaaagaattccttcgtctttcttccatgagacaagacttcaggtgtttaaaggtgtcatctgacctcaatcacatgtttgctttttcagggcaacacccctagcttcttcagttctgccccagataccctggttgtcagagcgtcaacaggatagtctctgaaagacggtgtcgggacaagattcaaggtctccaggtatggtctgagaagcatactgtgatggttcattttatgtgtcaacttgactgggccacaggtgcccagatatttggccaaacattattctgggtattttggtgaggatgcatttggatgagatttaaatgttagtacattgagtagggcagatttctctccctgacatgtatgggttcatccaatcagttgaaggcctgaatagaacaaaaagctgactctctcacaagtaagaattctacctgatggctttcaaactggaacatcagctcttcccggtgctacagcagcctacaggccttcgaactggaactggggcactggctctgcagattttggacttcttagcctctataattgcatgagacaattcctataataaatctctttctccatatatgtgaacactgcatgaagcatccacattagctttggcatcagctgaaccctgctatgatctcatatttactaattgatatagtttgcatatttgtccccacctaaatctcatgttgaatggtaacccccaacgtttcacatggggcctggtgggaggtgtttggatcatgggggcagatccccccatgaatggcttaggccatccccttggtaataagtgaactctcgtcttgagttcacgtgagatctgctcatttaaaagtgtgtggcacctcccccgacacacgttctctctcttgctcctgcttttgccatgtgtaagtgcctgcacctgcttcatcttcctccataagtaaaagcatcctgaggtctccccagaggcagatgttggtgctatgcttcctgtacagcttgcagaaccatgagccaattaaacctcttttcttataaattgcccagtctcaagtatttctttttagcaatgcaagaacagcctaataaactaatctatgctttaaacatagagccaacaaagatttatggagtgcctgcctactccattgttctccatgctggagacacagtggagagacacagtggagaatatgacagaaaaaattccctgcccttatggagattaaagtctaataagacagccagaggagcacaataaggtcactgagaagttaaagacctaaaggagacgaaagaacaaaccacacaaacatcagggcaaggagcattcacagttgagacgcagcaagtgtaaggtctgacatggtgaaggaagaccaaggaggtcagtgtggctggacacagggctgagaggaggttggtaggacacagggctgaggcaaggttggtaggacacaggtcccagaggagaccagtaggcccaacaggaccttgtagaccgttgtaaggactattgaaacatctaccaaatgttttcgcaggatggctctggctgctatgttgagtctaaggggagacaaaaagcaggagatcattagtagacttccggaataattcaggtgagaaacagtggtcactcacaccaggaaggatggtagagatgatggtacctaaccccccaaggtcttttcaccagttcgaggcttttctatcctatccttatacccataattctcccaaaataaatgcaaagtcttatagttattcttcagacccatatttcaagtctgaagagaccatgtaaaaatccttattttattagctataaataattaaattttatagcacaccttctgcactttcatctaaatccctgagaggttgaccaagacaaggctgaagtctgtgactcatacgtacactcccacactaacctgagcacattagcagtccttgctggggttccaggttgttcagccaactaccaagggacctcacagaaccttcctcatctttgtaagggcatcatgctacaacccaccaagaaccctgctgcattagtccattctcacactgctataaaaaaatacctgggactgggtaatttacaaagaaaagaggtttaattggctcatggttccacaggctgtacaggaagcatggctgggaggcctcaggaaacttacaatcatggtggaaggtgaagaggaagcaggcgtgacttatatggcaggagcaggaggaagagagggagtgggtaggtgctacatacttttaaataaccagatctcgtggtaaatcactcactatgacgagaacagcacaaaagaggaaatcttcccatccccatgatctaatcacctcctactaccaggccccacttccaacactggggattacaatttattttattttatttattattttttgagatggagtcttgctcttgtcacccaggctgaagtgcaatggtgcgatctcggctcactgcaacctccacctcccaggttcaagagattattctgccttagcctcccgagtagctgggattacaggcgtgtgccaccacatccggctaatttttgtattattagtaaagacgggtttcaccatgttggcaaggctggtctcaaactcctgacctcaggtgatccacccacctcggcctcccaaagtgctgggattacaggtgtaagccaccacacccagctgggattacaatttttttttttttttagatggagtctcgctctgtcgcccaggctggagtgcaatggcatgatcttggctcattgcaacctccacctcacgggttcaattgattctcctgcctcagcctcccaagtagctgggattacaggcgtccaccatcaggcccggctaatttttgtatttttagtagagacagggtttcaccaggttgtccaggctggtcttgaactcctgacctcaggtgatccacctgcctcagccttccaaagtgctgggattataggcctgagccactgtgcccggtcacaggattactatttaacatgagatttgggcagggacatagacccaaatcatatcatttgctgaaatgaagacaagatatttccaggtcattcctctagtctaccagtccatgctccagacactgcattaattttcatggcatagcacccttatcagagtctggcttgtagaagaacataggatataaagagaatagcaaaacacataagaaatgtagggaaaataattttgtctaatatgagaaagggttgcaatcatcactgcaaggaagataactgcaagagtgtataggagaaaaacaacctatttttctctatgctcacaccactctcaatagtttacttctgacatcgcatgtctgggtgtttttcccacaccaactaattctccaactcagaacaccaattgatgctgtgtatttcgatgtaattctgataccatctacctggagataggtcagaccgcacagattaagggctcagtcccacaagactgcccctcttcagatgcttctgatagtggggctataaatcataggttcccatgaccctgaggttcaattattttctagaatggctcacagaactcaaggaaatacttttaagtttattcatttatgataaaggatacaactcaagaacagcagccagatggaagagatgcacagggcaaggtacggggaaggggtgaggagcttctgtgccctctcggagagcgccactcccccacgccccggcacctccacatgctcaccaaccagcagctctccaaaccctaccccacagatcagggatttctagggagccttcattccacaggcatgactgataaaaccattggtcatgtatgattaagtcaatctccagcccttctcccctccttcagaggggtgggctgaaagttctaacctctaatcacatggttggttcccttggcaaccagcccccatccagaggctatccaggagccccagccaccagtcatctcaccagcatacaaaaaggtacttaacacttcagagatgatgagggttggaggagctgtgtgccagaggaggagactatttattccatgccccatcttccaccttatccctggaggcttgccacaacactgtcccattttgggtccttataatctcaaccaaactgttgcagtaactttctaccctcccagccgctattcctgttccttctacccctcctccacactgtcacctgggtaatccttctaaaaagtaaacacatgataaagcggaatggcacctaagcatcttaacatggcgcatgactgaagtgcctctgcccgccctcatctcatgccaccctcccacatacccaagaactactcacagttgtagaacacatcatgctgccacacactcctgggtctttttacaccctgcaccctgcctgaacccgtctatcctaccttgctcccatggcaaaccgttctgtgtcctcccaggagtatcacctgctctgtgaagcctcccaggctccctactctcctcacaatgagctgcacacaagtgactgtacagacctttagtccatccctctctcacatggactgcaactatttatcagcatacctgccaccctcatttgacaaagagcaacacctcgagggccaagaaaaaaccttgttcattctgaatcccttgggcctggcatagtgctgggcatgaagcaaggacccaataattgcttgttgaatgaaagctcaatgttgttacctacaggaaaagatacaccataattgattcattcccattacccaaactcattgcttcccttactgcccaggaaatgagcttttggccaagctttaaagctaatgatttgatttttcacctaataactccacctaaaaaccaattattaaagcatatttagtaattccatgtcttccccacaacccaatgaactttcctcctgcttgctaattaaaacccaatcctctaacattccctgacatgacaaatgtcttcctgtgggaatgaacagagcactgggctccaagggtcccaattcctagtaaacgtttgttgaaggggaaccatgaagcactttacagtcaaacaaatcctgggatgctgaggtgcaccctggactctcctgaatgctcctccctacttgaaccatgcacaacatttgtatttgaaattcaggttatgctaccagacttttttaaagagcagaacattactctatctgccaattgctgggagttttattataagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccacggaagcctcaaggttgatctcccaagcctgagtgaagtgtacaagtcccagctaatgagcacagacaccattttcctggcactgaggttctttgctttagcacttagcacatcagctgactcaccacctggcaggttgcattgtagcctctctctgggcctccccaacgttggtttagtcttcagtggtgaggagaggaacttgctgtggatagtgccacacatccccatcctcctgcctccttgacccctaccccaaaaagaatgctcccagatgaagtcttgaggaaacttcaggccaccctagatcaaaagtggatattaagtctcatcttaagtttcacctcaacctccttcaagtctattcaaatgttaccttctcaatgggcccatttaaatttacaaccccaccacccagccccactctaggaattctgattttcccaaactcactttacattttatttctacagtacttgtcaccttctaaaatgccatataatatgcttattgcccaactccttccactagaaggttccttcagaggctgggatcttagtgtgcattgtccatgggtataccccaagtgttgggtacaaaaaagatacttgttaagtatttgtttgataaataaaacaaatcttgatgtccaattaactggcagtgcctgcctaaggttctgtgctgagaaggattctgaggtcatattcaggagcagtggagaaatgggaacaaatgccatgagcaaccacgtgtctgccagggggttagcgaaggcatcattgctctacagctgttatccaatgtagtgtccactggccacatggcaccatcaagtacctgaacctgaaatgttgctggttaaattgacctgtgttatataaatgtaaaatgcataccacttagcacaagaaaaatccctatctcattaatttttattgactgattacaagtttaagtgatattattttggatctactgggttaaacaaagtgtcattaatattaattttacttactttttttttttttttttgagacggagtttcgctcatcacccaggctggagtgtagtggcacgatctcagctcactgcagtctctgcctcccaggttcaagcgattctcctgcctcagcctcccgagtagctgggattacaggcacctgccaccatgcccggttaattttttgtatttttagtagatatggggtttcaccatgttgggcaggctggtctcgaactcctgacctcaggtgatctgcccaccccggcctcccaaagtgctgggattacaggcacgaggagccatgcccagccactcagccttcttttactttttaaatgcaccaatagaagacttaaaattacatatattgttggcattatatttctattggacagtgcttctctagagcctcctccaatttgaccctaagaaaggaacatgtttatgaactgatcatgtccatccatctgcttcttggtctggtctcaacataaatcaatgtcaagaaaacatctcaagcccaacgcttcccaaagtctgatcctcagacagaagtacgttaaaatgcagactccagggtggtgggaggtagaaatgtaggaaactacattataatcctccctctaccactcatgattctgacgcatacttgaggaacattgttctaggccatagatatgaatattatttaaactccaataatctttataaagctcgaatgagattgtttgaagaacgagcaagaatctctcctctgcactgatgataaaaagccaagagggagagtgtaaagccaagtcatggatggagtcatctccttgcacatctcaaaaggaagaaatgggccttgtgaaataagagaaaccatagctccccaatgataatgaaaaagcctgttgagatctcagaggaaatctgttccaggaatctcaaacgcacgcgtacacacacacacacacatcccctacaactcagctgtggtccatttggaacttgagttatcagctgggtgagtgcctgctattcaggttacaggcccttggggctgctctaactcgcacatccaactgcacacatgtccgtgactttggcattggtggaagttcaacacttacacaatgaaaatagactcctccccctcttctgtcctgccctactcccagctttcagtattcctcttcccttttcctgactcctgcacaaacaaatctctttttggagttgcctgcttaggaaaatagaaagagcaaaacaaggaaaacaaagaaagcaaagaaaaacacactgatatttcagaaacacctgccatgccaagaacttgctggctcagttccagggggaaaagacacacggtaaaggagaataggtattcctcaagaatctcagttgaggtttaagtgggatctacagattggccctagaactcatcacagcccccacacagaaaggcattacaaagattatgcttttatgtattttggacacacaaagtccagcaaaaacaaacatactggaacagcactgaaatatttaccttccaaatgaagactgaaccctgcattttaaaagaggaaaatcacacgttctccctacccaattcctgggaggaccccacttgcctatttcctctgaagccatgtgatgtgaaatgcaatccgaaacatgttttctattaacatatatcatgactcaatgccttttaaaaaagcttcatttcaaagaaataataacttccatgcctgtgaacctaggttcataatttgcaaagctacatattcatgagccatgtgatgatggtatctgccaatcatgcattcatgaaacacaaatccatgcagccatttaaaaattcttgggtgattttatttagtaccccaaaccagattactttcttccaataaaatgacttaaaacatatttgactattactttttctcaaaacattcatgatgatcatcctgttcttaatttttgctgaaatataaaaaaaacctaaatgactgaaaccgccccatgttcttaacaccctgcatgtttacacacgtccaagaggaaagctctgagatgctgccctccaaacacaaacatgcacaaacttgaacatgagccagtacaaaagcaatactctcatctcccatggaaacgttatcagaacaacagtacatgtgagtgtgtatatacacaaagagaagcaaaagatgtctttccatctaaaaaacaaactaagtccccacaagttaccaaactgatgaagcacaagctgctttctaatatagttttccaaagtagagtcccaggccacacaggaatcctgtccagctttacaaaaaattcttcagactcctaactttacccttcctcatctgccaatgttagcctgatggaagagcttacccccaaattcaaagtgcatttcaatctaaatgatgtttttcacgaaaaaaaataaaatgttggtatcattactattacttgccatattcctttatctaattttgtcctccaaatgtgctcctggagaaccccacaggagggaagactctctttttttttcttctaagttacatccaatcagccaagtcaagttcaagagcaaaaactgatttttacaaatgcctggctccaaacatgttcctagaattctctttatagagttttttttttcatcaaggctgataatctcaactccattttacagagaaggaaattgaagctgacagaagctaaaggatctacccaaggcacacagctggcagacaacagggttgacaatagaaccaaagacctggtttctcactctagagctctttctattccatcgctgtggaagagtcagctaccaggctcagaaatcagtagtgtagggtagacacgcacatccctcagcctcatgttaataaaacactaggaaatatgatattaatcacaaaagctcaggctgcacacttcctaagtgcatgtcacatggattctgaatcctcatatctgatagtggaaacaactggggctctgagcaattagataaagtgccagattacacacctttagcaagaaatgagtgcagattcaaactgtctgctggactccaaaaatgatgctctttccactgtgggaaggtggacactctgcctggaaaggtcatctcccgttggtgagggaactgactggctcacaggtcagcaaagacctgggtgtcttagggcaagctttctaccaagtctgggtaggcaaatacagaggaacattctccaggcttagaggagagtgaaaaggaaaagcagtgaggcaaagcagggggctcccacccttcactgctgcttgcagagattctcctggtgggttatttccctctctgtcccctcttccccagcaatctcaggagctgtgctggtcagagtggagaggaacggaatggaagggacagacagaaatagaaatgaaacagttaaagcaacgaaataattacttggctagaagtcaagttagagtaaacaacaacaaattgctcaaggatcttaaaaatttctgtgatggtcagttttatatgtcaacgtatctaggccatcttccccagctatgcaatcaaacactcatctacacgttactgtgaggtattttgtagacgcaattaaactccataatcaggtggcactaaggaagggagattgtatcagataatctgggtgggcctgattcaatccattgaaagccattaagagcacacccaaggcttccctgaggaagaaaaaattccacctgtggacagcggcttccgctcatgcctgagctgcccttcctgaaggcctccctgcggactttgattgccctgcctgtccccacaatggcataagccaattctttgtaataaatctcttcatatatatatccccgactggttctgtttctctagataaatgctgactgatagctcctgggaatggctggtgcaagccctaggagaaacagagctgcatattctggcccaggaaccacagacctaacaacagtttgggaaaaaaagttctaaagggtatttccttggagggcaagaatggaggtgaggcctctagcccgaaataactgtggttggagcctccttgagcttcctaaaattagctctgaagcaaaggcagagccctcttaagcaggccacacccattttgcagtctacattgaagtctctgaagatgatcaaggtggtctcctaggtcaaagcaaagaaggttgaactgcacatatttagcatcaattaacaaacggtccccacagggttcaggatagatgtagatattagggcatcctggtggagctgatccagaaacgctccaactgggaccccagagggaaagctcttgggaaaggggtcaagaaacagttttaaaatctttattcaagtgaaatactgatatgatctagatcccagtactgaaataagtcatgcataaaacactttgctgaaacaagaagtttgctcacctgatgcgatgccctgatttggctctataggttcaattctgaagccctgttcttggaacagtcatgagtggctccagactggaggccagagttagagataaaatcatagtcatgccctcgagtcagcagtgtgactgttcccaatgaggtccccatttaccattctggaaagtattattattattattattattattattattgctaacatttactgagtacttactaagcactgtccctgggttagagcccccgtttactagctatgggaccaggtacatgttaacctctttgtctcagtttcctcatcttaaaacaaagacaacaaaagcacctacttcacaggcttattatgaagactaagctcatacatgtaagtactcagaagagtacctcacacacggcacacactagaagtgcttgttaaacatacacatatgtgtgtatgtatcctcacattgggccatgagatttgtctgacagatgctgaggttgacaggccacgagtcattcctcactatggcaggaccatagccttcttatacaaactgcaagaaaaggatataaaaaccctgttttaatggattggggcaggcttggctccaaacagcagctctgaacatcactctgccatctgtatcacccagaaccaatagaatctcaagaacaggctctctgtgataaagatggaaaggccagagatcaaatggactgtgagacttttgctagaggtggcagacggaagaccccctgacttccaggtatacactgtgtcattcaccacctcagtgggacaaggcagaggcaaaccaatggtgactccctagcacagtggcattaaggacccacagttgcaacaaagaccctgggtcatctaaggatacagtgttaggaacaaaaggcaaaagcagatcttgagaaaagcaaattctatcctagacacagaaattagaaggctaaagggactccttcctcccctgcgaaatcagaagtagcttccaagctagagttagataatgtggactcgaggtgcaagaaccaatttgcctcaaataaacccaacaacctgtgtccaggaaggagttggaccatcctggagttgctttctgagatggagagtgtaggtcacctgtggagaacccttaccaaaggcatcactgtctataatttatgagcggaacaaggcacagccacagccttcaagtcagcctcccagagtctcctggtagacagttggggtttctttcccctcctattacatggaaataaaatattctgcaaccttccttaacaaaacagtcactttttctaccgaacagctctctggaggctggccaccacgtcaacaaagggcaccagagatgtgacatttgatacaattgcccaacacttgggaagggcagatgcatctgattaccagattagccttagacaataaagccttaaaagacgttatgggactccacacgaagaaacaccaaccttgcctcctcagtgaaagtgagtttatttgacctcaatttgttgaatgaaagcaaagccttcacagggctgcaacccatgcctgcacacagacatgacgcaagtccagccagagccaggaaaagtctacacttgcgtgaaccctcctggacagtaggtcttcctcaggaaaaatacacccaggcaaatctcccaggggccacgggccattcactcactcacaacattcaccagccttaacctagcaagttagaataaatcccagggagtctttcaaaaaccccttctggaccaggtttaccagttgaaactgggctctttccaatgttctaattgccatagtgacatttaggaagagctcaatggccacaatagggccaaaaactcctattcctaggaaacaggaatgacttgtttgaactagggtagttgactgaccctagttcatgagaggatcaagacccatataattaaggcccttaaggacaagccacaaaaccaacagatgagcagactccggaataaaaatgcatggtacacaaccacttggaatatcccacaggacacaatgagtcattccacaagagacatttaaaaaaagaagaagaaccaccagcaatcttgaaacatttagttatttaatctcccttcaagagagaatttatctggggaaagacctcactgcaaaacacaaactggtatatccgggtccctggaatacaggggtaatgcttctggccgagccaagagctgtgtttgtgtctgcaaccttgacccatttgccacatgctgttctccagagccaacctcatgcaggaagctgccttgattgcatttggaagaagagaattctcattttctccaatttctactattctcatcttctccaattttcactattatttagcgtaatagtacttagcacactaaactgcaattcccaatttttcaatcagctctcccacacaatgggaagctccctgacgacaggcaattcaccccagttttccctagatcctccacagctagcacagttcacagtcaggcactaaaaactgtgtgttggatgaatgaacaagcacatacataaaccatcatacccggtatgctaattctgtgtttttttctaaacatgggggtgggggaactgccaaagaagggaaagaaggaaattagcaaagaaaaaaattatttccagatttttaaatgtaacacaatagaatacagaattttttttaaaaaaagttcccttctccacaagcaaacttgaatgtctgagttattcttagggcgtttttggacagacactacaaccctcagttacacatcacttggcttcatgaaaaggtaacagctggacatgcacggtggtatgggctgtgcgtgtcccttcctagtgctgcactgagcacacatctggggctatttagcaactgattggaaatttagccttctgatttccagttaaatactaggcacaggaaaacaaatagcacttgtttttcactgagtcttgtcagtcatccaaactccagtgcagaccagagaactgcctgtggtttggtggcagaggcccaaaatatttggacctttttttttttaatgcctctagtttaagtaaaaggaataaactagatgttggcagctccagcttcttcacccatccctccccgcttcttgaaaatacaaaactggttttaaatttattaatttacatttttcattaggattaagttttgatttgtttttaatccaaagctaatagcatagagtttagtttctgtcatttattgcaactgccctgccttgatatttacttggatttgctgaagaggcaatgctcaatttgccagtttctgttccaaattaaattgggatataacatctagcagtcgtactatcaaagaatcacagagtttaaaagctgggaggaactttagagatgagctagtacgatcccctcattttagaaatgaggaaacgaggtctgagtagttaagtgattttttttcccgatgatgtatataactagttagtggcagagccaagactagtactcaggcctcctaacacccaggccagggtgttaactggaaacaaaaacctgaattacctccgagtagagctgcccaataaagtacaggacacccagttaaagttgaatttcaggtaaacaatgaatactttttcagtatatgttatgtcccatatactacatgggcacactaacaaaatgatttgttatttatctgaaattcaactttaattgggcatcctctatttttatatgccagctccagcaattgtacctcaaagaccaaaatccccttctatgccccatcccccactcaaacatacacacattcacatacatttgctctctgattttaatgataaatggctagaaaaaaatagatcacagcacagtaatatcgagagtgaatgaggttggaagaagctgcttatttcttgaaacttctaatcttagatacccttttttccttatgagcatgcaaagtgactaagcctgacataagtaagctggccaaggcctctggactaggtattttaggttattaaaagccaggcactagggtctcatcttgaaaacgtctgcttgtcctagggctccaagtctacagaccttgcaggagagaatgctcaagtttggaatacaaataaagcaagattaaaaaaaaaaaattagaggccgggcatagtggctcacacctgtaatcccagtactttgggaggccaaggcaggtggacggcttcagcccaagagtttaagaccagcctgggcaacaaagtgaaaccccatctttacaaaaaaaaaagtcaaaaattagctgggtgtgggggtacatgcctgtaatcccagctactcgggaggctgaggtgagaggatggtttgagcccaggcagcagaggttacagtgagccgagatcatgccactgaactctagcttgggctacagagccagaccctctctcaaaaaaaaaaagaaaaaaagaaaaaaaaatcaggtacatggaataaagtaaaaagatacatttaaaaacctagtccctgcccagcactgtggctcgcgcctataaacccagcactttgggaggccaaagtgggtgcatcacttgagaccaggagtttgagattagcctggacaatatggcaaaaccctatctctacaaaaaataccaaaaaaaatcagctggtcatgttggcatgcacctgtagtcccagctactcgggaggctgaggcaggaggatcgcttgagcccagaaggttgaggctacagtgaggcatgtttgcaccactgcactccagcctgagtaagggagtgagactctgtcctcaaaaaaaaaaaaaaaaaaaaaaaaaaaagtgctgcagcaagtttttactagttttatgaaatacagtccacataccataatattcagccttttaaactgtacaattcagtgtttctgtgtgtattcacaaggtgtggtatattcaccactatgtaattatagaacatttttgtcacctcccaaaagaaatctcgtatcattagtagtcattccccattttcccctcccatcagcccctggcaattactaatctactttctgtttctatagatttgcccattctggacattttatataaattggaatcatacaacttgtgacaattagcatctggcttctttcacttagtataatgttttcaagacccatctatgttgtggtatgtatcagaacttcaatcctttttatggctaatattccattatatggatatagcactgttttcatccactcatctgttggtagacatttgggttgtttccactttttggttactgtgaataatgatgctttggacatttgtggacaagttcttggggacatgtgttttgctcagttttccacagaaccattttacattcccaccagcaatgtatgcgtgttccaatttccctacagctttcacaacccttgttatcgccttttttattaaagccatcctagtgtgaagtggcatctcactgtggttttcattagcatgtccctaatgactcatgatattgagcatcttttcatgtgttttttggccatttgtgtcttttctctagaaaccgtgtatttaaattgtagtatgtccttaaagacaacttcatactgtggctctcattttagcaaattcaggttgaaggttcaggcatcatcacccagttaagttatcttactttttttttcagtgtagaaatgaatgcataaataaaaacaggcttatgtgatccttctaagagattatttgcagtttcaacatggcacactgagagggtaagatgatttttatttctgattgttctctgggccacccatacaccctgcaaaaggaaaactataagattattacaacttcatcacgtgtgtgtgtgactcacactcaaagattcactacttgaaactcagcctgaaagcatcactcttcatcccactcatatttcctaggtaaccagaataaccagataaaggagctgcacctgcagagaaaaccaaatcccactttctccctgcctgacacgttcccttcttgcctgtgctgtgagggggtgagaaggactgaaatgatttgacagaaaaagacagatgcctttattactagtattaaagtatgttttcagtcaccctcaagggtggctgcgatgtcctgggtaacataaggccctcctaactaattatgaaagttttccttttttaatttgggcagtcataacaacacagacatgtccatttaaataaaaaggtcaccctgataaatgagtagatgctattacttgaacttttctcattgccctatttaaaaaaaaacagttaaaagttctgtaactctacgtacacagtagacagctctgagacagaaatgcaaaccatccagcagcatatcaggaaacaggcaaggatacatgcatcgtggactgagagtcaagagacccattcgctttccacagctcctttaggctccctgggtaacctcggagaagacagtgatgaaaacggtgaagcctgaatttccagagatcccgtgggccctctgaagtgtttgatgaacactttatataaaataatttagttatcttatccccaaactttaactcttaactatacaaatggataaagagaacacactactggatttctattgatcaccagaccctctgtggcaaaggctatcaaggagatgaggagaaactaaaattcatttcaggccacagagaggaagggaaaagcctgcccaaggagagtggcccagcttgtgcaaggacttgcatcactcgttgtctgctgatgtgagaacgtgaatgaacaacagatgttccatcgtctcttccaggccaagaagaaatgtgcagacgggaaaaaaaccgttttccctaaaggaagcctgctggacaacaaagcagagttcaggtgtcctggaatttaaatccttgacttctcctgatgctgcctcccacgtgttggtaattttaggctcattacttgatctgcaatctccttacatgggattgatccaaatggggctgacgttcaattgtttactaaagcggccaccttctttcattgttagtgtctaaactgatgaccaagaagcagtttttacagattttaagcaaaattaaagcaaattaataactaagagtaagacactttccgtcaaaacccatgaactggcagactgaagaaagaatccaggcagcgataagtacaactatgacatacgtagcccacactttcatctggacctatagcccagagaaacagaaccccttttgatctggggccagccaaactagatatttcataaatacagatgcaaattcaacacccgtcccacatgctctttactgtgactagaaataaataagagcagcaacagcaggtgatgtctataaacattttatatgtgatctcacttactcaagataacagccctatgatgcagggcctgagaaaaatccggcttagagaaattaatttgcccaaggtcactgcttggatctaaaccaggacatgcactgcctttgctcataatgcctccataacctgcccactgtggtagccactagcctcacatagctactaagcacctgaaatgtggctaagcaggactgaagaactgtaatttaagtagccacgcacagctatttcctatagtattggacagtatagctctacagtatgagggctaaatgtgcatatgactttatgatcagagccattagtattactatcacaagtaactttaattagaggagactgacagtgattatgagtacgaaggcagacagtttagcataacagcttgtagaatgggtcccatctaggtttgagtaccaactctgcaagtaactagccatgtgatttggcccactacttaacttctctaaatcttagttcttcatctataagaaaggatctacactatggtactgtagaaggctatcgtgagaattaaagtattagagcatttagtgacctgaaatatcctaagtgctaaataaatgtgctagtaataacaactaaataattactgatttttgatttttggcctttttaatatagaataagagttgcaattcccagaaaaggctacaataaagttattgtaatgcccaccttgtaaatgtaccttttgagtttaaatgttttcttttgaaattaatttaaatttacagcaaagttgctagtacaaaggactctactatacccttttaactagattcatcagtttttaaaaccttgccacatttgctttattcttctctatacaacatgtttttttcctgaatgatctgaccttttagcccttaatcttaaagagtattaagtatgtttcctaaggatattctcttacataaaaacaacataattatcaaattcaaggaatataacattgatataatattttaatctataggctcaattataatttatttatataaaatacaatccactgtccccctaatgtcttttatagcagctgccccactccctacccaacaggatccagctcaggatcacatgtgtcttgtctttttgtctcctctaatctggaatggctccccagcctttctctgtctttcatgactgatacttttgaagattataggccagttatcttatagaatgtcgttcaatttggttttgtcagcgtttcttcatgattagattcaggttatatgcatttctggcaaaaataccacaaaagtgatgctgtgttctctctcatttataggcacacagcgtccatctgccccacattgctgatatgaattttaatcacctggttaaggtatcatgggatatccccaaggtatatagtcactattttttatgtgtaattaataagtaatttgtatgaaagatattttaagaatatctaaatatactacttcctgaactccctccatctctgctagatttagcatctgttgataattcttgcctggtcaacttttattatgatggttgcaaaatgatcattttctaactcctttgctccttctagattttctagttggcattttactataaagatgagcttttccttttctcccttttattcatttatgtacttattataataattgtattgactatggattcttacattattcaacaagaacctttgagtttttagaagtactcttcaaacacaggggaaagaaactacagatctggattgagagacattaactgggcaaagtttattcatgaggcaagaggaaaactattaactggggactccacttgttttggatgcttgtgggcaagagaggtttaaggcctcaggcaccgcagttaggacattagcctgcagctctcgtaatagacaatgtgagttacaactaccaagttgcagtgctgctcatcatcagacatgatatcacaccaaaaaaattccatccaaacaacccatcgatttctccacaactagcacacttgaatgttctggcaaactcaaagggacatgatttacaaatagtaggtaatatttggatctttcgacaagagctgagttccagcttgtttttttaataaaatacaaatgacttcattttggagctcactgtgtcactttctcaacaaacagatcctcatatcaggaattaggcctgtgttatatacaaatagtatgggtccgtgcatattcattttgtggtcagggaccacacacccggtagccagttacaatatttacagggctcctgatgccacaaggggggtttcagagctgaaaccaaagctcaggccacacagagtatgacgacaggtcctgctctaatgtgcgcactagaccccagcctctgcccacagaagatgggcaggtgtgtctgctttctgtgaatgcttatctatgtcatcatccaaatatcactaagtgcatcctccaaatttaacactctttggactctggcattatttcagtgaaagtaagcctttatgaaaagtttggcaaagtttaaggaccattatgtccttgtgctaaggatcagtttgggggaggtttaagcacttaccaaaaacagtctggagaccccagtggcaagtctctctgtcttcagatgccacaccagggggtgtggggagttgagcaggaacacaacagacttgtggtggatgtggactgaggagatgggattcaggtgaagtgtgacctaggaagcaacagaaagagggcagaaatcttagccctggctttccatgaaaatcactcagagcagcctctggaatactttttttgcaactcactatcaacagaaacaagctataatgtagctcagattctatgaataagatacattaagttgaaccagatgatattgccaatatttgaccattttttactacaaaatggctatttcatattagtcaaccacactaatctcaaccaaagcatgatttagctccctgccaaagaacaaataaacagaacacattttttctttctaaaagtcagcaaaggtggaacaaaagttaccttcccttaggcctgctttaagctttaggtcaaatgactaaggtgaaacttggaaaacaaaatccccttggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtatacagcccctgtcaaaaaaaaaaaaaaaaaaaaaacagggaagaaaaccatgggatggatacaaaaactgtaaccaattttgacagcagatcaaggactattgcaggtcatcactgttgtcattaacatcaccaaaaagcacctgtgaatggagctgcaaaccatggactcaacaaagtcctcttggcacacatgagcccagggcaacatgaacataggagaacaaagggatatataaggaaatattgactagatactttcatacagtctgtctcatactggctttccatacagagcggggaggcaagacccaagaatcacatatttaaacagagtgaactcatcaaacataaccataaagtaataagggagggacaggacaaaaaaggacttaggctagaaagacacagactgaatgatgcactgggaataatagtacatctcagctagaatcctcatgaggatgacatggtctagatccacgatctgtgtctatacaaccatcagggatacagcactaaatgctggactatttcacattttcccaatggctgccagcccactgtgatctcaacatacttctacctttttttgtagggaccacttatgaccaatgtcacttatcatagtatgctctcaggtcattgataaataaaacagtaaactttcattatctttcaaaacccaggctttagcacatggtaagcactcagcaaatgtcaaaataatgttttaattctctgcttttcaatgccacaaaaatattctatgaataacttgcatcatcttgttcactagcttgagaatgcatgtcttaatttccaaaatggactgtaggccaggagcttgagaccagcctggccaacatggaaaaaccccgtctctactaaaaatacaaaaataaattagccgggcatagtagcaggcacctgatactcaggtggctgagacacaagaatcgcttgaacccaggaagtggaggttgcagtgagcccagatcgtgccactgcactccagcctgggctacagagtgagactctgtttcaaaaacaagcaaacaaaaaactgtgcttaacatagacacgataatacacttgatcttagccaaaaggccgggaagtaaacacacacaataaatattgacttatcacagcaaattcatatatttatatgttacctaaaggggaaaaaaaggttcaaaggaatttagctggctaatttgcaaaaaaatacaaaaataagcaatactccaactgtcatgagctatttctgcacacagctaggatcatttttatatctggcataagcatagcactaaatcaaagtactagatgaacagtgatgtcaagtacagctacagcaaagtaatgtgctccttggttgtaaagactctacctcacagcacactttggagatgctgtccgcatctagaaataaacagattgatagccactgagaagaagagatgctatagaaatagcagaagcaaagattcaaactgtactgaacaaagagacacacacacactatggagaatgaaggagggatgaaatcatcatttgttccagtgtacctgaaaactgcaaagcaacactctttcactaatagcatgtatcagtaaaaggtttctctatttatttattcaagactatttactgagtaccataatgatgcaaagactagtaatgtatatctgcaggggctgcatcaacccttcttctgaagattttctttgcagtcctcaggcatacaattcttcttagagctcatagatatgcagaagtttcggtcaaaatatatactacaaaatactagtaagtatgtatttcaaatgaacaagaattttttataaaagctcatgaaatgagaagaaaaagatctatgagacagatattggtgctcaggtccaaaattttccagatggtcaaaagtgctgaggcctggctcatacaatcaagggaagatttctaggagccacagctctctgagctttcctggaaacagctccctcttcaatatgtggcagtgtctggccaagatgaatctctgactctggcacacagggtccaggcagagccccaaaagccatttggcaaagaagaattcacactacaattgggaaattcaaagaaaaatacccaatagtttctttaaaagatcatttggcagggacaatgagtcctgcaagtgcctgctcacctaatccctcagcaacctgtcttttctatgcttcccccgcttgagtaaatcttgctgaagggaagataaaggacaaccaaaacagctaacaaaagaaccatggtataaaagcttccagaaatgtagagagaacacacagcaatatctcaaagaattcctggctaagttgctcaatttctcccaggcttgggggaaaaaaaaaaagacaaaagaaaagaaaaagaaaatcctccttaggatcaattatagctcagggtagactacagttacaaatataagaatatcctgaagctttttgtggttacactctccagtgctcatggtctaaaggccgagctgaggcagactacagcaaataaatatcccatgaagaaatgatacaaagagtatccagaaatctccagcttggaaatccaaacagtagtttaaagagttgaccatcaatcctatgtcaaatttacacataaaaatacaggttaacagctttgtctatgggctgataagtaataaggaattgaacactgggaccatgcaagctgtgaaggctggtagaaccaaaggggatgcagctcaaaggagcagcaatgaccagtctcgaaaccactggcttctttgtaaatctttgggagtcatggaacatttgagaactgaatgcatgtgtgcaccctctccttaccaaaccaaaccaaacaaaaaacatccatatcacacaaacttttgcagacaatgtcagggaattacattcattgcagggcccatgaactccccgttaggcacccattaacccagattaagaaccccatcgtaaaagagtaagaaagttctaagagcaacaatggtaacaaaatggatccatctaattaaactacaaattacaccgctggtcttaagatgtcatcctttcagcagaagaacttaatagatgaagactcagaactaaaaaaactttcacatgcagtttctcgtgaaacccgtactttgaccacaaactggtccatgaagcctaatccaagagttcctgttctaaccatgctggtttcaaacagtgctggatattcggtattcctgatggtgtgagaaaatgcaagcaaatctgatctgccacatcccttatgtaacaccatccctcatacattgctgattcttcccctaaatggaaaagagttaattggtctaacctgttctacaacatctattcatactaggtcttctgcagttacctgtgcaatgcaacaaacatacaattttataaagaaattcaaagcagatcttctgagtgtttttctggggaatctgaacacaactttgcccaaagtcaaggacaactctaaggagcacaaagcctctgagtggaaacactacctccctatctctcacttgggaagaacgtctttgctcacattatcagcagaaaataacaaggacaatcttttctggaccttgttatagtgaaggcttctgggttctccaaaggttatctttgataagcaaaaactatctattgtctcaaactctgtagattactttatgaaaatgaattacaggaagagggggaaaccctacttgctttatggaaagattccttatgaaaattgttttgaatttcccaagattcataatatagatgcaaggcatttctaccatagagatttcagaatatgaattagttagaccccctacttctggggttcattaaaacgaacgaaaaagcaaagtgagcaaggcaactgatatgctagtctaacagctgtccaattttgctaacgtgtcagtgaggtccatttcaacatttctgattcttagaacagcccctgtgggctgttcatgaagcaatgaagtcatccaaaacactaccagggaaactcttattatctaaaaccagaccaaataattctctgaaatggatgattcaataatcagtttacactaagataagaaaagaactccaacagcgtgcctacaaccaagacccataaaatcacatgctggtctgtatatagccatcatctgtcccctcttcaggggtaaggagacatcccacttggcaacaatgttagtagtaactgaaaacatcctgaatctgggtctcccagcacccacactttgcacccacaaatggaaaggcacaaacctatttcaggacactagggtcccactgaactcaaatttcactgacatttgggcaatatgacttttaggaactcaaacctgaccccagatggatctaaaatgtgcaactgactgctaggggtgggaacagtatttacttagttgctgctgcagtatttaaagtatattctgatctaaggaacccctacagctgatattttattcaccattgcttgtccttcaccatttgggaattggcataaaaagattccctcaaaatatttttagagaactgggtgtggagctttaaaatttttcctttttatttttatatttctctgaatttctagaagaatattaatcagttggtgctgaattcaagaaatcttgacatacacacacattcccccccacacacacccagggtccccatcctgacctggggcactcaactaaccattctccttggtcaaatggtatcaagctctttcccaatggttttgtcttgaaaccacttaaagtgctgagaggggcactgtcagtctatttcaaaactaatctcccttccccccaacaaggacatgattcaggattccctgagagcctctgaaaatcatctaatataaccacaaaagagacaaaaaaaaaaaaaaaaaaaaaacctaaaatgaaagtctgaaacgggatgcagaaataagctctgctccatattttgtatgccctggaaaaatactgggaactaaatttgggttgggggttgaggggcaagagctcatataaacagaggagtatttatgaaactacaggtcatgaccttctaaaggggtcctgggagccgttgcaaggagattccagagacccaggcccttccttcccagagcagccacagctcccccggctgcggagaagagaggcaggcaaagcggagaccctgatgtgtgggtggttcgggtggaggaacgctgctagtgccctcagcaggccactactgatgcaagtctgaggacacagacaggcacttttctatcattctttggcattaagataggttgtgtgaatggggtactgtgtacatcactaacacaccgcagccttgcaggattctggcctaaagtgcaccacagtgctccggatggacttgtgggtccagctcacaatgccatctccagtaaaatctttccccctccctcagacagagccagagctctctcagacagcactggtgtttctacctctgcctctgcctggcactataatgaactgcttagatcaagcttgtccaacccacggccacatgctgcccaggatggctttgaatgaggcccaacacaaattcgtaaactttctcaaaacattatgagatttcttttgcaatttttttttctttttcgttcatgagttttcattagcattcatgtactttatgtgtggcccgagacaattcttccaatgtggcccagggaagccaaaagatcggacgccctggtttggatgtttgtcccccctgtcacagtataaattcctcaggtcattcttcaagggcagaaactgagtcacactcatttctgcatccttaggcctagcacagggcaggacatctagtaggcagtccacaagttctctgaaagaaggaataaaagaaggaacgaacaaaagttattaatgaaatgtgactaggataataattacagagtcatattgacctgtttttctggccagaacaagggggttggggtgtatatagtaaacagaacattaacacacagtcaagataagcagattccagctactgaaacaaatgacggagatgcttcctggaaggtatgctggacagcatgccaaggccactcccaggctttgtaggacaagccaccctgatcatcatcctctctgtgtgtaagacagcgtagaatggcacttgggccatccatgggaaccataaaaggcaaagaaaagaaaatagaaaatgtttgttatcttaaacagttacgcaaataaaaacacataaaatgtaaaaaacctttggagcgtgttttcttccttagggatagataacaaagataaaatattttgagcaaatattccactatcttttagaggcatagaattttacacgggtttgcatgtaggcaattaagtgtgttagaatgattagaaattaaaattttagacaaactgaagaaactcaatatttgcaaattgattaaaatggagggaaagtttgctttttatatatatatattccctgtcacatttaataaatacatccattcagatcactttttgtttttaacactaatatgtaaccaaagccccatataactatgtgctatacaaacgtatttcctctcaagttctcctttttttgagacaagatctcactctgtcgcccaggctggagtgcagttgcacaatcagagctcaccgtaaccttcaactcctcaagtaatctcctgtcttggcctcccaagtagctatggccacaggcataaaccaccataaccagctaagtttgttttctttttttttttttttttttgtagagacagggtcttgctatgttgtccaagctgatctcaaatcctggtctcaagcaatcctcccacctcagcctctcaaaatgctgggattacaggtgtgagccacacagtacctagcctaatttctacattttataatgggcttcaaattagctttgctacatacctgtttagtaagccagtatgctcacatgtatatgtctttaccaacaacagaatgttagaatggcctgtgcatcagtactgtgatgtatcaaactgcataataaagagaatcactagagtgatcattagaagctgatttacaaaataagcatagcaggaactcaattcccacaaaatctgagtactggagtaatcattccacctgctacgtgcagtcagagattgaagctgtcctcactgggttaacaagaattccggacagaaaatataattaagcattaacatgctgctctttgacctagtttcttgtaaccaagtcacatagcactagattctcaccatttgcatccccattgctcctatagatagataggatgtctgatgttagaatcctaagggttttgtttgagagttgcatgagcagatcctgaattccaacgggacagctgacaccaaccagtttaaagactcccacaaaggaaccaccaaatcagcatgagaacacagtttcttcatccccctgtcccacgactttaccctgcactcttcgacccatcaacaatctccatatttcagcccacccaaaacccttaaaaactccaaccccaaactcctgtgggagatggatttgagttttcccccagttcagcagctgtacaattaaacctctgtctctgctgcaacctggtatctcagtgtattgacttgccacgcacgttggacaatgaacctattatggctgtaagatctcaataaggatttctgtttaagcagcatcttaaagttagttaatttgtaatagcaaaaacaaacaaacaaaaccccacaaaatgcagttgtagtcaggtagcgatttaagatgctctcagcagcaaaggatggcatttggattcccctgggctaaagtacaatcttagaaagtatattaacctgaagctggtaaggaattctttaggagtacagtgttaccttgctagcagaaatcagaaatccagagaggagtaattactaagacatgaacattcaaaaacaccgcacttggattattgttaaaaatcatggtggcagcagtagtaataaccatcatcatcatcatctcctaaggaaagacaataggtagatccatggctcctgttgagatttgctgctctcatcaaaaggaagtgctctgcgtaatatctaattactcccatcttaaaggtaaagaaattggtgttcttgccaaagtcatatggctagaaaatgacagtgctggaagtagaatgaatgtctctccctgtctgtctgtctgtctctccccctacctacccacccccatctttaatcttgggtgttagtcttgggacatagaggagaatgggaagctgctctatagcagtaagaggcaggaactattttactcctggaaactatatacaaactcagcaaagtaacttctcaattctttctggaaggagggataaatgcattaattactgttttgtattttcacattggatcacagaaaaaaaaaaaaaaagccatgctctttaagatgactttgtgttggccgggtgcagtgactcatgcctgtaatcccagcactttgggaggccaaggcaggaggatcacctgaggtcgggagttcaagaccagcctggccaacatggagaaaccccgtctctattaaaaatacaaaattagccgggtgtggtggcgcatgcctgtaattccagctactcaggaggctgaggcaggagaatcccttaaacccaggaggcggaagttgagttgagccgagatcatgccattgcactccagcctgggcaacaagagcgaaactccatctcaaaaaaaaaaaaaaaatagaagactttgtgtccagaggatattactgacctatgtcctgttgacccatctcttacagcatccagaatctgctgccttgtattaactttgtacatataaactatctcagagcatggggtgggacttgtatttttatcaccttagaaccttgtccagtatctagcacttacaggaattacattaatatttggtaacgaatgaatgactgaatgaagaaattgataggttttggatctgtgtccccacccaaatctcatgttgaactgtaatccccaatgttggaggtggggcctaatgggaggtgactgcattataggggtagtttctcgtgaatggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcgggtatttctttatggcaatgtgagaatggactaatacatgaatcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggggataataattgtatctattctatcagatgtcaaagggttaaatctgtcatttgtcgaaagcacttagaacagtgactggcatctggtaagcactctctaagtgttagctattattacttctacccactaaaaccacagctgctattctccattcccttggttcctatggaaggaagctcttgtctataccatcctccattgaggcttcaagtcaaaacgggtttcctcatagtcctctaaacatcaagctgctggcatccttggactcggcccacattctcctcctaaaccaacttctctctgggcacacacgggccctgttaaccttcccctttgcccccactctctttcttccccacctggccaccccacttcctgagtcacgctcccaaagcttactcacagcactatcatgaccaacaacatctccaaggctcacttcactctagccagacttggagatacttcaaaggccccacatgattggagagaaggataagggagctgtgtttttgttttttttgtttttttttttaatacaacacatcctgaaggggatgccctgtttccatgtgtgtattttactctgacacaaaccgatcactctcaggcttgaacaagctcggtgaagacctccaccagatacaaaaccaaaaaggccgagacagctgcaaaggtttctatttccctagagatgggagtttcatggaaggctaaggatcaccacagcaaccagactacaaaaacagtcgtgggcttcagcaccgtaactctggtaaagcaatttgtgctctgtgaaaggctggggcacagaagttgaagaatgatcaaagtaaacactgctcctcaggcaccattttgttgtgctgatttcaagacactgagtctcagcatcaaagttctgttatgaaagatgcgcatcaagtgccaaagatttgctaggctggactgcctgccctggtgcaaaggtctggagagaaactcatagcacattttccaaaacaaccatttcaaatttgctctaagagcagaccagggtaaaaatgtatgccattatatcaagttaccctgcccatgctagaacaactgttgatcccaaccctggattaaaaaaaaaaaaaagagtgggtgatttttctcataaaaccctaaatagactttatcccatgctgaacttacatagactgattcctacagatttaagaaaaaattacctaaactttattaaacaccaattgaaaaaaatcacctgttctagtctctgatctgccaccctaaatctatactgcagtttacataataaataagaaactacagcatactatttctacactctatagaagcagcaaatatagagtatagtaactaaaacagaaatctcttcatggatttataagaggcttcaatatttattagtatgattaatttaattattaactatgttaactatagcttgaatatataggaacttgttctttttaaagaaactcaaattggtctacctgagtaatcttacaatatcctcaaaaattaggttaaaaaatatacaattcccattagcaaatttatagaaaaatccttcagacctctgttatgttggcagtacacaatgcattcctaaaaaacacttagtggtagtgagaaatctgtaacttaaactgccccaaacaggaacactgagaaatacaacaacaaccatgtgatgtgtacacatacttaccacaccccttttctctaggatgtgtcccatgtatagtgcgctgctttctgaatcttttgtggggaaggggtccacttacacaatttctggagtttcagcagaggctcactcagtaagtcagcagggactctgcaatccacaaaatttattgttccataggcccctctagcccagcagtttgcaatgcataagaggtaattagtaatatctaacacctaaatgcttcacagacaggaatgaatggcttggcttacgggcttgctcagtcttttctagctgcaccctcctccttttatctctaggttaataagcgtgaagttactaaactaacagggaaaagaggttctcatgttatgttttgcgcatttactattcattcctcagaaactgaatggctactatgtgtaaagcactttactcagtcaatccttcccaaagtgtggagataataagaatgttttaagatatactttatgtatatatatttttacaggaattaaaaacatgatttcatgtttaggaagttgaggatgaagctaaagtcattttttaagtgagtagatttaagaaaaaatattatgggccggacacggtggctcacgtctgtaatcccagcactttggaaggccgaggtggatggatcctgaggtcaggaggtcaagaccatcttggctaacacggtgaaaccccgtctctactaaaaaatacaaaaaaattagccgggcgtggtggcgggcacctgtagtcccagctactcaggaggctgaggcaggagaatggcatgaacatgggaggcggagcttgcagtgagccgagatcgtgccactgcactccagcctgggtgacagagcaagactctgtctcaaaaaaaaaaaaaaaaaaggtaaataatgcaaataatatatgaatactacacaaactgtgaagactaatagcacatataaacttatatttgggaagcaccactaagtaatgaaaggacttcaaatgtgagtcagacacaatacctgccctcaagaagctcacagtttgatgggggcagagggacaggcagatacaaacacatctgtgggcagcaggaagggggcacttcagctgggccagagggtgaatggggaaaggtggatctaaggggtccagacaaggagaagggcagtggaggcagcatgagtgggtgtgaagaatacttaattcagacggagctaaggaaatacaaaaaagaataaagaagaatgtcgttgaaagggtactggagccagatcacaatgagccttgaaagccaagcttaaccagttaatgaaagacgatcatttgcttttcagagacatagaccctgatttgcttcctgatagataatgagtacattaacttctggcttagtaagtgtcacttagttaaccacattactgcactgattcactaaatgaacttccattacctgacttacttgcccaaaagaaaacatatcattcataaatctaataacaattttaaatcccatttttgtttaggatctaaagggtacctttagattgttgctgaattaccaaggaatatcttgcatggtgagaaaaatcaaactctagccctcaaccctaaatctcctagacttgaggagtttgttccttggctttgtccccaggtcatagtccctcaataaacacttgttgagtttggggtataaccataaactatcaatgaattaagcaactgagctaggagccttgagcatttctataaggaacaacttatagggcctggtaattctggtcctggttacattattttatgtaaaagtctgtaagttctatccataattctctactgtgtaagaaatgagctgaattaagcctcttatctatccctctactttatcatctctaaggtgaaaacaagttaccattgtagaatggtgtacaatgtctttctgagatgccctcttaaatcttggcaagacctaccaatacaatattagcatcttcagtacacatttcagacaattttaggtcagaatctctctcattcttttcaaagaagaaagtaagtaaattgttggcatgaaattttagaacaaaaataggattgtctgatttctagaaaataatcatttgttgtttgccctcaaggagaaaaaaagttaattgtctgagaaacagaggaaattaactttcactataaaccacaaaccccggtgctccccaattttgccttcctcctaatgtaagatcctgacatatcattcattttaaaaagggggttaggcacagtagctcaggcctgtaatcccagcactctgggaggctgaggcggacagatcacttgaggacaagagtttgagaccagcctggccaacatagtgaaactttgtctctaaaaataataaaaataaataaataaatgatttttttttttttggcttaagtatcttactttgggcttcagtctccccataaatgaaaaggttagactctatctctatggccacctataaatctagagcctatggttctttcagcaactaatagagtcagtaaaagtcttcaggacagatctctaggccaggcacagtggctcatgagcattatcccagcaatttgggaggccaaggcgggcagatcacctgaagtcaggagttcaagaccagcctggccaatatggtgaaaccccgtctctactaaaaaatacaaaaattagttaggcttggtggcaggcgcctgtaatctcagctaatcaggaggctgaggcagggagaattgcatgaatgcaggaggcagaggttgcggtgagccgagatcgcgccactgcactccagtctgggcaacagagcaagactccatctcaaaaaacaaaagatctctagaaatgaatgtatctcaataaatgagttgatgtgactgaattatcaatttcataaatgccatgtcacactaaaatgatctgtgtactcaattaaaaggaacaattttaaaaagtttagtttagcctgccaaagtgaatactagagaacaaaatagaagtgctttctcctttcaacaagtgaaaatgtcttgaaatgctggcttgaaaaattaaataatgtttgttttagagagtttctttgctttccttaactttaattctgggtcagtgtgcccacttagtcttttacatttggcagaagcaaaacaaataatgaaatactcaaagctaatcctaagggtaaaccatgatttacagtgcattttaaaataggaagtgttgacatggtagtagtctaaaaacaagttaatatacttggtcttgctaatttcttttagatatacttttctttttttttttgagagtctcactctgtcacccaggctggaatgcagtggcacgatctcggctcactgcaacctctgcttcccaggtgcaagtgattctcccgcctcaacctcccaaatagctgggagtacagacgtgcgccaccagccaggctaatttttgtatttttagtagagatggggtttcactatgttctcaagctggtcccaaactcctggcctcaagtgatccacccacctcggcctcccaaagtgctaggattataggcgtaagccactgcgcccggcctagatatacttttcaatgagagagttgtataattgatactgaaagatgagcaggttttttttattgaaatataagtttccaataaatcaaaatatgatttaaaaaaaagagtaaatgcaaacaacagtatcccactgtcaggttctcaaatgccgttttgatgggataaatcctcctcagtaaggacaatggcattttttggttaaaccctacatcactagtctgagaacaagtctcggtcatcacaatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcccttgccagtggaactattcgcatttctccttatagaaccaattctccgttgttagcaaacacggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccattcaggtctcagttcaagcacgcttcctctaagaagcccttcctaaccaccctaacaaccaactcttcctgtcacttgaatacccaggtagctccacaacttggtgctgggaaatcctttcatttacatttttataaaattgaagggaaaagacacaaagcctgttggcatctatcccaagaatatctcctgggcacttctaagtaaaggccactgccagcaaaacaaaaataaccaactttcaacctactcaagacatgcaagaattcaagaccaaatcagaatgcatcccagagttcacctgattctgccagcaggagccctgcagtgctgaatttctgggcatgtgaatgatacattgttgtactgaaacattcattttccaagattcctttccaaattcaactccatggtctttcttttgtctgttttgctaaagggcaaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcgggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcctcaatttccacacctgtaaaacagagctaacagaatctcccttccaggggtgttgaaaaaaacaaataaaatgccaggttttgtaattctctggaaagaagcctaccagcgtttgactttggctctgatcagtgtagtgccattacctcctgcctacaggtccctggattttcaagcagggtgacaaattggtggcagctgcatacatgaccctccaaacacttggcttcctcatgaggaactaatggttgttctgtcatttgtctgcttttccttcacctttgggatttggagctcattaaagacgagggccgaaaggtagcacaaacatcaacatctttgctagttgttcctgttcaggcaccactaacctggacaagctcaggttttgctccccaaatctcaccgtagttctggagacttctgaatctaacaaacaaaggtcctgggaagaccacattcattccacacctgaccccaacaccacatctactctgaggttaccccaaatctctgaacaaaaactcaatcacctgtgctcgctgcctttcctccctggcaggtaccttccaaaaaaataggaacataggaagtgccaaagcaaggaactgcttccaaggcagctgacatcactggattgtgaggtaaagctagaggtttctcccaatctgtagtggggaaatctggggacaaacatttatcttcagaggcctgtctacactgccccttccagtgtcacaggctgtcacaattcacctggctttgaagacctgtggtgttcagctgaagaccattctcccagcatcaacaccaacaggcaaaaccatcagatgaagctttcacagctgccaaggtacttgctgtcctcaacatatttcatactcaactcggctctattttatttaccagtctcctcccctagtcttggaaaattctcctttcagccctctgccaaaccacatccccatttcaaacctttccaatttctcacctccaaaaagcagcaccaggcaagcacacctggctccaattattccagcaatgccttcccccagccccagccccaaccccagctctagccccagccctagccccagccccacatccccctaacatgcctgattacttagcacttaacgtgtttatctcagcccagctgtagttgattacatctatttggttaagtttctatctcgtgtatttagggcgatgagatgtttctacgtctccgtactttctgttacaggtgttgctctttgtccctggatgcacggtgaccgtgagctccgagggctgcctgtctcctcactcctgcaatgctttgcaccggtgcccagttcacaaaggcagctgcagctgactgtccaactgcctggttctaatttatgtggagagaggcctccactcaacaaactgaaataattagttcttctaatcttctgcatttcaataaataaaagaaagacagggaaagattcacatgtactctgtcctgacgaaacagtagagctctttggaaaatcatgaaatttttactgtgcaaggcagtaagatataagcaatgaaactcaaaagcattttcccaagtattcagagaccagatctgcccccagatctgtaaatcctacttaatctaggttaaaaaaaaaaaaaaaacacacataagaagacatgagacacccttagtttacatttcagctcttaggtggttccttattcactgaatgctgagggtttctttaaggatattttgtagtttaacaactccagaaatgcttttgactctaattctcaattggtattttgaaatattaattttctcaatgtctttatattgacagaaaataaaaaaagaaactgagatccaaatgggtctacacatttgccctcaagtttaaacaaaaaagatcacaacagagggaagaccaaaaaagagggaagtcttttattaagactcacaatccagtgctgtcttctataccttgaagccttggtttaagaaacattactttatgcccaagccatacataccaatatcaataactagatcttcaaaaaatataattaatgagaaacttccatatatagaatttctagacttaacctatttgctaaactgctacatcaacatacttatttattcatgcaaatgtttatttcacaaatgtttcttgactgcttactatgtagtgggcactgttctaattcctggcaataccaactaaagataaaacatctatactgatgatatactagcagaagagatagacagtgaacatatttaaaaataaatatcaggtggtaatataagttacattttaaagtaaaacagtaaaagagagtgtgtctgttgtggggtgctatgactattttaaatggggtggtcaatgaaggcctctcagtggaggtaatggcaaagcagggactgggtgaaggcagccacatgagtaactgggagaagtacttcaggcaaaacaaagagcccatgccaaggacaggaggcaagatgtcagggcccactgcagcacagtgagcaatggtgagagtgctgggagaagggggaaaagatcattcagggctctggtggggattgcgcattttcattgaaatgtaaaaaaccatggcaggaagctgaactggtgaacttcgtgactggacggaagtctttcaaaagatcatgctggctgccacttagagaatagatcttaattgctaacaatgatagcagctgacatttatggagtgctgatgatattccacgcactgttctaagcaccagtcatgctttaattatttaatcgtcacagcaactctatgaagtagatactatgattatgcccacatgaggaaaatgaagcataaagaagttaactgacttgcccaaagccccacagctcatgagcagtgtagccaggcttccaacactggcgctctaccccagatcttgcactcctaagagggatgggccagaggcccactgcctctcaagtaaaaatgtgatggtgggtcagaccgaaggtggtggtcagaagtgggcagattcagaatatggtcttagggtagaacaaataggattggatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatactgctgtaacaaattaccataaactgggtggcttagaacaacagaaggctattctctcacagttctggaggccagaagtccaaaatcagcattgctaggccaaaaccaaggtgtcagcagagccacatgccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgactgtatttaggggccaccagataatccaggataatcctccatctcacaattcttaatttaatcacacctgctaaggctttttctatataaaggcaacattcccaggtttaggggttagaacgtggatatatctttgggggccattatttagcctatcacagtcaggaataccacaaataaaaacaataaaacgtacaggtgtggataaacagtgagcaaagcttttcccttttacatgagaatttgatcttctgttaactctctcaattctgtaaccctggtaatctggtaagacaatatgtcaattataacacaaggcagcttgctattgggactggaaaattttaagacatctgataagaagtgacatctgggggcttccctgagagcagtgattcttgtaaatggggcatatttatgagacagagtaccatgaaaactattcctacatagttgcctactagttcccgcaagggtctaaggctttttttttttttttttttttttctgacatggagtttcactcttgttgcccaggctggagtgcaatggcatgatattggctcactgcaacctctgcctcccgggctcaagcgattctcctgcctcagcctcccaagtagctgagaatacaggcatgcgtcaccatgcctggctaattttgtatttttagtagagacgggtttcaccattttggttaggctggtctcgaactcctgacctcaggtaacccacccgcctcagcctcccaaagtgctgggattacaggtgtgagccactgcacccggccttcctaaggcttttaaactagagaactacacacacacacacacacacacacacacacacacacacacacacacacagagatctcatctcctggcatttgagccatcagctggagagctctggatggctatgtgaactgatgaactgatgtgtgaacagtcacaaggcacacaacaaggaggaatgccttgctgccatgccgtaagctgtggtccttgtcctatacccttttaagtataatgaagccacccatggcctatgatagtctcatgggtctgaatgtttatttggacccaagaagactccttgcctgagtttgttgccacatgtaataatatcgtttcagttcattatttccatttcttcctccaccacagttactcagcagcaaaaaggagtagagcatttgtttcatctgttcatgctcttgtgtggcctcactcaaacagcaaaatggctaaaaagggcaaagggaaaggaaaagctagagaacaaaaattagtaaattcacaaaaactgagctaactgttccctcagggagaagtgagtactgcctacaaggaacatgctgcgctgcctgtgctatgccttccagaggcctctccagcagaatgaaatgtaaaatccctaacccacagttctgctggaaatgtgcaagtgggctcattactcagagccaagataaaggataaatctttatgagtaccgtaagtatgagtcataaaaaataggaaacatatgtaggacgtatacacagtaatagcaccaagccagagaaagtgtttaggaaatgtatttaagaacacatgacaaaacaggacgaaaaattgcccttgtacattgctctaaaacacatttaaaaaaaaaacctcacagcaagtcaagggcccatatcactttgctgatctctaataaacatagatcatttccatatttggaaataggctggcctttttattttaaatgcaaataggagagctgaatcaagaaaaagtaacttggagtaggctttgaaagattttatgatttgggaaatttgaagagcttccaaataaaatactgggaattagatcttaacagcattaaaaatgaacacaaaagattcttttagaaaaataattgttcacaatggtaatattaccatttcatttagattctcactatcttaacaaccactggaaaaatgagtggaatcttcaaaccttatgaaagcaggaatcaaaaataaactgcaacacatgggctgacaacataccgagagcaatgaagggcctgcgtgaaagccctcacggggatgctgggctcagcaggaagaactcgcagcaaggaagaagcagagccccctggccaaaagcaccaagtgacaatctaggggatgagggcgttcagaatagaagggagggtgatcggcccccagaagtcttttggggccagatgactgaggcaaaatgtatcatcattggaaattaagctcttcagttgcctttgattttggaagatgcccgaatttaagacagcttggcaaggctaggagacacctacatgcccatgtgcccaacacggaatcatgtgtgtcccaacggacctttggctcccttggaccagggctttctcctttaccttcagaaactgctgcctcccaaggaaagcactgcttgcacatcgactgacctgaggttgagaggaggagcagaggaatgtggaaaggattgtttttaccttcattaagtgttaaatttacctaagactcccagagagtcaatgctcttcaggaactattctgaggcagaaatttcaatataacttccacctcatgaaaaaatccaactgtaggtcattaaaagaccccaggggcatggcgagggctgagaggtacgacagctcactttcgaccttttgtgctcaggcctctcagcagttgctatacctctctgcccctctcccccaaggcacctcggtatgtgctcacatcactggtagtgaggccacacctcactctgggagggggactcaccttttaagaagacatcgatgcagcttccacgtaaacgggtccacaggcatgcagtccctaacctgtggcaagcccagtgctaggcacagagaaccgacagccacatcaccgacttgctggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtggaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctggtgggtaaagcttgaaaaggctgccaaatccaatgaccagcaacttttgagctgacttagaaaacaagctacaaagacttgagtccagagtaaacaaaggaaaaagccatattaaacagggaacaaattactatatcggcagggatattttaagtactcactgagcaagaaaacaaaatcaaaaaaatcaagttataaggtatttaataatacacggtagagtaaaatgccctctttcagttagaggaatcaaagttaattaattccagcaatattaagaattggctggagtcaccccctacatcatgaggacagatcattctcaatggcccaacttcaaacctggctcagatcaaatgagcaacccaagggagctgcatagagttgaaaaccatttatagctttttacccagctgacggaaaggactaactagtttactagcagatgactaaaacccctcagagtaaagaagaatgtaacaaagatttagaaatgggctagggaaaagactgaacaaagatctgcagtttagagtaaaaaataagattaattaaaagagatttaattaaaaaagtaaatcaaagcagtcatacaaaatggaggacacctgcttagctccaatgttgaggggcctagggaccaaacactaagtccactaatagaatgcaaagcaaataaagatgcactatgcaaaaggaaagtcatttaagaagactttcagttatactctaaataacatccttggtgccatgcaataacccaatttgcataatgcaaaaaaagacccaagacctagttcctgcccgaaagcagtccactcaccagctgagtgtgcagaattaacacacacgattcagcagcaagtaatacaataaaacatataattccatactgtgggaaggcacaggttgtggtagggggaagaagattcagagcgatgtttagaaaagaaagaaatggaggagggtaaagcaatcaggcaagggtttggtgaagagctaagacctaagcatgggcttccaaagtggcaagaattgagagactgaagaaagaagtccaggtggaattaagaataagggcgtggggcaaggggtttagctggtaagcccagggggaggctcaggaatctatacatcaagggatccgatgcaggggcttcacacagcacacacactttgagaagccgatccacaggattaagtccaaatccttacgtggcctttccagtctcatcttccactcagccccagcctacccccttcattgtcttcatcctctattacaggaattgccaagctcttcctgcaaagggctgaatagtaactatttaaagctttgcaggccatgcaggtctctgacacaatactcaactctgccacagtagtgagaaggcagccatagacaacatattatcaaatgggtgtggctttaaaactaataaaactttaaaaacaggcatcggactgatgaatgcattaacaaaacatggtatagccacacaatgaaaactacccaggaataaaaaggaatgaaacaactgatacatgctacaacatcgaggaacctcaagtgctttacgctaagtgaaagaagctagacacaaaagatacatattgcatgatcccattcatatgaatgtgcagaacagataaatctagaaagtagattagtggctaccttgggctagtgccgggtcgtggggggcacacacagggaatgggagagtgactgttaatagatacaaggtttcttcttagggtgatggaaatgttgtaaaattagattatgggccactggttgcacatttctataaatatactaaaaaccactgacttgtacactttaaacaggtaaactttatggtacgtaaattatatctcattaaagctattttaaaaacacaaacaggcagcaggcagaattcagtcctgcctagcacccttgatctgtccaccagccacaccgtgtaggtgaagaactttcctccacacctggcgcccactctgtgtatattgagtcctcccatcccttggctcaacaacactaatttgacttttaagccctccgtcaaatgttctttcttctgggaatccttccctcacttccagagagaatgaacacaccctttgttgggcttctgtacttttttttttttttttttagacagcgtctcgctctgtctcccaggttggagtgcagtggcgcgatcgtggttcactgcagcctcaaccttcgggctcaagtgatcctcctgcctcagcctcccaaatagctgggaccacaggtgcacactactatgcctggctgtttgtatttttgatagaaacagggttttgccatattgcccaggctggtcttgaactcctaagctcaagcgatctgcccgcctcagcctcccaaagtgctgagattacaggcgtgagccaccacagctggccttctgcaaatttttaaaatatattagtcatattatttgtcatgtttcattaaattcattctctctcaactctaataggtgctaaagacataaaaatgagtaagaatctggcagagcacctacctagcacacagtgggttcttaatagtgattcattgaacaggcctgtgaatgaataaacaaattcattatgagagcattatttagagaagtttggttttatgaagaggttcacaagctagacagaaagaatcagggtctaaagctgaagaggccagtcccaggagaccagttaaggaggctccagggtaagtggagaaaaacagagaaattcaagggcaattgcagaggaaatgtcaataaaatgtggtgattggccaaatatagggtttaaagagaatgggcaggccaggtgtggtggctcacacctctaatcccagcactttgggaggctgagatggatggatcacttgaggccaggagttcaagaccagcctggccaacatggtgaaaccccatctctactaaaaatacaaaaattagccaggtgtagtggcgggtgcctgtaatcccagctacctgggaggctgaggcaggagaattgcttgaactcgggaggcggaggttgcagtcaaccaagatcgcgccaatgcactccagcctgggtgacagagcaagactgtgtctccaaaaaaaaagacaaaaaaaaagaggatgagtaaatacaagatggttcaaaagttccaagatggatggtactggtgacattgatgggtcagggaagccagattgaaaagccagcactagggtcaggagaactggcctgggagggttcttaaattctattttagagagaataaaaattactgttagctagcagttgactgtacctataccggccctaagtgccacagagacatttctcaatggtcagtgaaccctctaaagaagtgctactagctgggcacagtggctcacgcctataatccccgcactttgggaggctgagacaggcagatcacgaggtcaagagattgagaccatcctggccaacatggtgaaactccgtctctactaaaaatacaaaaattagctgggcgtggtggcacatgcctatggtcccagctactcaggaggctgaggcaagagaatcgcttgaacccaggaggcggaggttgcagtgagccgaggtcacgccactgcactccagcctggtgacagagcgagacgccatctcacaaaaagtaataattaaaaaaaaaaaagtgctattaacatctccattttacagatgaggaaacagggcttagggaattaagtaactcacccagggtcacacatggggagtggcagagctgagactagccctgtatctaacatgggagcgaaccacagtgacagccactcctccagtccatatctgaggcacctggcagctcaagatgggacccaagagccgggatgcttcagccatctgactgtagttccactggagaagcccaggcagagtttttggagttgtaagcaaggaagtgacaagcaaaatcctaagaccagacaagccacctcagggagaggagacagaggaaaacagaaagccaagggctatgcctcagtcaagaacccccgaggttaggcacactggctcacgcctgtaagctcagcactttgggagtccaaggcgagtggatcacttgagctcaggagtttgagaccaacatggtgaaaaaaatacaaaaattagccgggcgtggtggtgtgcgcctatagtcccagctactcaagaggctgagatgggagaatcgcttgaggttgcagtaagctgagatcgcaccactatactccagcctgggcgacagagccagaccctgtctcacggggaaaaaaaaaaaaaccccaagaagaaagagtgagcagctgagaaagaaacagaaaaacagatggaatggtagaatgagaaccaggaaaccaagagggaggtgccagaaagggagtgcttgacagcactggaggcttcataagctggggaggagcaagagtggggcaggcagatgtgtagaggcagctctgcaacagaagttggtgccccgaggggctagtccagtgctagcaccaagttcttggttaatagtgaacatgtcaccgctacaccctctggcctggttcccctaaggtattagggctaggtggaccccagggaccctctagtcctagcagcccttgagttgttcaaaggggcatcatcagggtctccccagagattagctcaggccacagagagggaagaagggaaagaaggacgtacagatgttcactcattccagtggagcaggggaaggaaaagagaaataagctgacctgaggcatcagaggggccaagtcatacatggcctcttcatcgtggaagaaagaaaagtgaaataattaaacgtgtctaaacttacacagaaatatttagaaaataccgtggaaggagtgattgaagtcaatgcaataaatacttctgcagagtttaagtatttaaatcagcgattagcagttaagtttccttttactctcaaacagaatgtcaagaagcagataagcaatggcaaggagaaggctcaagctggaaaactggagacgctgcacacgcatgcactgggcctttgcccaatcagcacatctgcatctcagatttgcagagctgctcctgacttgggtctattgcttttttttaatactctcccaaaagttctaagagcaaaatgtcacatttttaaatgcagagagtgctcttgtaaaaacattgtctaacaacactttcaggaaattatataattctttttttaaagccaagggcagttaccatggcaacagtagtacaggtcagggttctaaccctaacctccataaagacaaaacaccatactggttggaaaatgctgctgctggacaaattttaaaaggggtcagctgggcacggtggctcacgcctgtaatcccagcactttgggaagccgaggctgacggatcacaaggtcaagagatcgaggccatcctggccaacatggtgaaaccccgtctctactaaaactctactaaaaatacaaaaattagctgggcatggtggcgtatgcctgtagtcccagctactcaggaggctaaggcaggagaatctcttgaacccaagaggcggaggttgcagtgagccaagatcgtgccactgcactccagcctaggcgacagagtgagactcgtctcgaaaaaaaaagggggtgtcaaggcagtctctatctgggggaagaggcaataatgacaggtttttacaatctgtccagccagcatagaacataaatcggcattacctcattctaaaaaggccgagtccaaccaggctcagtccctctgccggggcaggggctgtactttcctggggcaactttacagcatctggatattactgtgacgaatgacaggatttaagtgacgtgaccaacctgcatcttggtaggaacgttttaacttcttagcttagccttgtgtcctggtttgtttcctaaaccccggtgtttgctattacctctctgatttctgctttcactttttctaaaagtccaagactgcatttttggagagttcctattggagagttagctggaattttagattgaacatcttgccccaaagtgttagacatcatccttgactagtgtgaccagtgccagctctcgcttgcattgtcctctgttgtgacagctagcagatgcattgccttgctgtccctaaccctgctcccctttccaggcctggactggcaccttcacacgacctagcagggtgtcattgtttaaattgcattgagtgtcttcaagtaaaggagtaactctttttatataatatgagtgtcctattcattcaggccctccaatcctatgtggacagacagattcagttgcctttgtaggtaatgaaatgatttctatagtaatactcaaataaatggggaagggaagaaaggagagaggaaatgggcaggtggggagagacagagaaaaaagagagagagagagaaatagtacaggcatgggccacataacaatgtttcaatcaacaagggaccacatatacaacggtggtctcataagattatagtaccataattttcctgtacctttttgacatttaggcatgtttaggtacacaaattcttaccattgtgttacaattgcctacaatattcagcatagtaacatgctgtgcacatttgtagcctagtagccatgggctatatataccatatggccgaggtgcgtagtaggacataccatctaggtttgtgtacctacactatgatgtttgcacaacacaatcccctaacaacacatttctctgaatgtgtctctgtcatgaagcaatgcatgacagtatctgttaaggactggtggaaaactaaatgaccatttcagaggtaatcttccctgtcaagctgggtgatttccagaacagcttccttttaaacaaacaccaggcagtgcttatatgcggaatgtatttgtttagaaaccaaatttcactgatatacagtgtctgtgtgtgaggggtttcctttgacacttgcttagtacataccacataaaaggtatctcaaacataaatagccctgggttttttgttttttctgcatatgcacaggactgcattaggaagtcatttatgaatagcagcagggtaaaaaatgccccagatagagaaaagaatgtagctagtttaatgtttttgctctcacatatgtactctcccaaaacccagccttgagattttgtatcagttcttttagtggtgttgggcaaggcacacccactcctccccaagcactgtattatctgaatctcgataatcgagggggaaaaagagaaaaggtgttcgtgtattaatattgtggaaatggggaaggattacatatagataggtaggtaggtagataaagatctccaaaatggtcaatctttgaattgccaaattccccaatgtaagcaaaaagatgtcaaatcagatggcgaagtctgaatactgaagctcttgcatatcattcttagcaagaagagtcagttaatatgctagttctctcttaccacacagttaaaacaagtttggatacaagacgtagtaaattataagcagaggacaggtgagctatttgtgtgaacacagctgaaggcctgggggtggggggaatgtttaactatgaaaacagacaagaacataaaaggccccttggtggtgccatttagcatggggattagcagccacatagagcacaatggctcctgagctcagccctgcattttataattactgacatgtggtgtgataatcctaaaccatgaaagggaaaaaaagagacactgccacacacagaccaacttaatactgccccaaagctgcaaggaagggaatcaaaaaggactccaagcactgcaaagagttattacaaacctatgcacagaacccaaaccctcactaacagacctacttgctggctgtctaacaaagcagactcagcagactagcaggttctgtagcccagaaccaagtaagagctaaaaggaaaggacaactagctggagtatgggaaaagcttgcagcttgcactgtagaatccaacagacacaactcgggggctggctccacaactcaccatctggttgtataacctccctaagcccaagcatcctcttctgcaaaaacagtgaccaccaagcctccctttcaggctgacgacaagactggcagaaccaaacaagtgcctggcaggtggctggcccacaggagacacgcagtcttcaccactacggctgctagtattgtcatttgggggatgtgagagctgttaagaggcaagtcgagcagttagcacttgacagtgtttacttccttctctttctccccactgtggtctttcctgccctcaaaaagaaccaaaaaagggacagctttatgccaatcctcagagaaggtacaaagtaaaagtgacttggagccacatgtgtgattaaccacacatcccatttgtctgtgcctgccaaaaagcctggagccaaatttcaaacacaatcataccaaccacataaacccaaatggctcgcaagctgcacccttctttttcccttggtcctcattctgtatttctgcttacactgttggtatgcctgttgctggaggctcatcccaaatcctcttttggaatgaggcagagaagctcatagggttatgagctttttgacgggtgaagttattaaacctggcccctttcccatggtaatggagcctcctgatccccactccacccctacagccaggcactggcacgcccattgctcctttaatgtcaaaacaaatgcataaatttaaatgtccatatcttttctacacatatgtaatggctaacttgggacttatcctcagcagcttttcataataagcaagcaattagataggtcagaaatagaaaagacacaccaccacataaaagcaggtcacaagtaaaaattagatgataggaaacaaaattgttgccattccagcaactaatgaaagtatgttactgtaaacaagcctctaatggtgctgtaacccctctcaggaatcaggaaacgccctgagcaattaaactcgggagtccgacacaagggggcggctgcattttacttcaaagtcagagggtactaggagctggttttcatggggatggaaaccatgacactggtcctcacttgctctaaaagataaatctgatctctcagcattgtttatgctcttctgctgtcctctgttgccagaaagtcattttccagtttcctgttcgcttccaaggctgttgtttccgaaaccaatgattacaaatgagaggtgtgttctcagatgaaaaatacaataggtctactctgacccgaggagaacccagcagggaggccgatgacaaaacattgctttggtactgagggctttttatgtactgttgtaacaagtgtgtttctgatacaaattctctgctggcctataaaactgttcatccaacttaagcgttactgtctccctaaatcttgtcaacctgctgcagttactacttttgggtgtaggctctgtcaccgcctctacacaggaaaattaaaaatctctccccagctgaagaactttaaggcacctgggaggtaggaatttattaatagtaaaatattagatatggggtgatttataatagatcttgatactgatcttgcaccaataacaagccaaggggaaatggggctgatttagtaattccctcacatttaaggatgacatcatgaaaaccaactactccagtcttcagtcatagtcaattacagcttggagccagcacggtaattgttttgctaatttgtaagtaacggcacttatttcattttgaaaaatatttgcctttaatatttggtagaggccaggtgaggtggctcacacctgtaatcccagcactctgggagtctgaggcggacggatcacttgaggccaggagtttgagaccagactggccaacatgatgaaactccatttctactaaaaatataaaaaattagccgggcacggtggcatatgcctgtaatcccagctactcaggtggctgaggcatgagaattgcttgaacccgggaggtggaggttgcagtgagccaagatcacacaactgtgctccagcctgggtgacacagcaagactctgtctcaaaaaaaaaaaaaaaaaaaaaaaattggtagagactgcacaaaggctgcctctggccctcctactattaccctcaaaacagatcagctgttatttttagcatagaccatatcatgacatatctacaaaaaccaagttatccattgaaaataacaaaaagcattaggtgagtttaagttgaaggagtaagcaatcttggtaaaagtgaattgagccaacgtaaactttatagactaattagcatgtcagcaggtcaaacggtttttttaaatagtttcattgagatacaattcccataccataaaattcacccacttaaattacaattcaacagtttttagtatattcacagaattgtgcaaccattaaaattttagaacatttttgtcatctcctccaccttttttttttgttgttgagatggagtctcactctgttgctcaggctggagtgcagcagcgcaatcttggctcactgcaacctccacctcctgggttcaagtcattctcctgcctcagcctcccaagtagctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctccacttttttaaaaaaacatgtaacgtttagcagtcaacctccatttccttctttcccctctagccctaagcaatgactaatttactttgtctctataaatttctgtatcctgaacatttcacatacatggaatcatatgatatgtggtctttgtgtctgtcttttttcatttagtggattttcaaggttcatccatgctgtagcacctatcagtatgccatcctttttactgctcagtaacactccattgtatggatataccatattttatttacccattcatcagaagatgaaaatttgggtttttccacttttggactaatgctgccatgaacagtcacagacaagtctttgtgtggacatgtgttttcacttctctcgggtatatacctaagagtggaattgctgggtcatgtggttcaaatgatttttaaaaactgtttgcatagctgcgggaatgttctccatagtcatatgtcaaaagagtgagcgatatttaatccttatacacacccatcttaccaaccacaaacaatctttcattctctcgtcctgaccctcattctgatgttatcctctatgctcactttgtatatgcaaactactctgagatctgccgtatgtgagcaacgcagagccagatggaatctccaaaaatcagttatcccaaaatcttgttttcaaacagtattgaactacaaccatctaattcttaaaggtccgtctgttgtctattctcagaaacatcttcaaatcactggcccaaaatcatacatatactatactaatatcgaaagagaataatgttcaggtttttaaacaagtttgagactaccctttgtaggccctctttcttttcttcctcactgaacacactatgtccctgatgccagctaatgttatgtatcctcagtactgccaggtcctaaaatgaatcccattttgaataacatagtaaccaagtgcaggagagctctgctgtcactcctcgaggtatttttctcttgtttcagtagtcttactcgaatttgttttcagagtcaacaacagtactgcacaatttaacgtcaagaattttctgctgttgctgcttctgtaacagcttggactttcttttccctctgagttcctctgagagaagcatatataaaatgagtaattgtcgctgctaaagaattgctggagtcagcaacgcttcataggagctgcatttcctcctctcctcctttccctctcaccacaaactctcccccatcagttcagaattaaaggcacattactgggataaagaaatctgacctgaaatatgagttgcagcaacaatggcaagcaaccaagagtattaacaataatttccaatgttgctggaaaggttagatgatctgtctttgaaatgagccaactctgcacacgttcatgagattaaaatcagcttgcttttccttaacatctcgtgcttctcctcttcctaccaccccaaaaggatggggtggctgaggcacataaacaagtggctctggaaattaactttcttgaccagaagaaagctcaaagataaattccattctgcattacttttcctatacttcactatgatcaggattttttgtggtttctctctccctggagagcgaatacctgagtgataacatttctgacacacagaagcttaaaaacagaatactctgtgttatcttgttgggaaatctgtactcttaaatgatgaccattcacccacaatctaggccatttttgagccacaggaaagaggacgccatttctctctgaagatgatgaccttgcgcaaataagttttctgcacctgttttgtcacctgtaaaatgagtataattgtaggattcatggagttactgtatgagtgcttcgaacagtgtttggcagagtaaatgctgagtaactatgagcatatatctttatcatcaccatctccgctaatgtcaccgccacctttgggaagctgcctagatagtgataaggagctatgctcagggattttcaggcaagtacaaagtaccgccatctttattccagagtgttcccatttcccctcactcatcctgcagaagcaataagttcatatgacaaagtaaagaaagaagacagaggacacaggaggaaatgggaaagacatttcacaacaacagagaaaacggtaccttatttggtttctcacaatcatgtttaaaagatgaaattattattattatttttgaaacagggttctgctctatctcccaggctggagtgcaatggcaatcacggctcactccagcctcgatttcccaggctcaagcaatcctcttgcttcagcctcccaagtagctgggactacatgtgctaactaccacaccctgctaattttttttttttttagttttatttttagtagagatgaggtcttgctatgtttcccaggctggtcttgaactcctgagctcatgcgatcctcccaccttggcctctcaaagtgctgagattacaggtgtgcaccatcaccatgcctggcctaaaagttgaaattcttatgaacgtttttttccaatacggagggccaggaaatggggagagccaaccaatctctagacagagaaatcctaaagttgcccaatccagacagcagctggtattttaaatctgttctcttatgttcatacatgagcttcttttgttgaaccccagaagagaagaaaaggacttctgtccagaaaatcatctctgcagactcagtggcagtgggctgagagctgacacctgcacctacctctctctgtagctggccaggcccctggcctgcagtgcggagattcaggacatgcacctcctgtggcagcccagttgtgcctctgctggcacagcctgacaaaacagtgaagctctccatcaaggcctggacaggatgggaggcactgacaggtgacagttcacacagtgcaccaggctctggacctgccaagggaatcacaaacacaagccactcagaaacagcaattaattctgccccaaaggggcaagggtgatcaaaccactgccaacccaccagagatgcctttccaggtaaactgttccaagactaagtggccaaaaagctagcctatcttctaaaatcccaatctcttaaatttcttttggataatttggtatgtatttgattttttaaattcccttttggactcacaagtcatgaatgcattcctctgggtagaagacacttcccatttaacatttgtgtttaattccttcttccctcttggtagaaaatcagagataaaataaattgcttaaagtcccaataatactatacataaataatattaaatacctaaaattgcacttaacaaaagtataagatacagatcctatcttttcagagcttccctttattagggaaagcaaaacaaacttaagaacaatacagagcaagatgtaacatgtagaggcgatcagggccagagctgtacagcaaaatttgggccagaggtcagaaaaatcctcccaaaagaagtaggatctgagcagagcctcaaatagaaaaagtagagtgctggtcatacttggttcctgcttcttcattccctcttcctctaatcagtcaagccttaaatcctaaatccatccactcctctccatctctacttctttaccaaccctagacaattacaaaccttcctgaacggagtctgaggactcaagctctgcatgccaccttccacacaggcactgtccacctaacctagaggcactcaatgttacgggtgttcccaaagcaaatgcctgccgttggcatctctgtgggaagttcctgtcccttcagaatagctgccctaccaaataaagcctgagctccaccacagagcacaggaggcccttcttgatctagccccttcctatgtctcatccctccccactccacgtcaacttatttaaaggtctccagacacaccaggatgtttcccaactccatgtcctcattcaagcctgcttcctttacccaaattcctcttccactctcactccgcccccacaacaaacatctcaagctgaggaaggctctctttctctgccctcccgcaatccatctgcctgtctccactactgcatttacatgatagccactggtgtacacatccatctttattggtcgaatgtgacctctctgagggctgtgggtactcatctttgtatcctcagcattcatctgcagtgcctggcatatatgagatgctcaaaaaacgtttgttaaatgtataaatgaatcattgagcttaaaaaaaattgccccctctcagatcagtgagtagggcaccattccagggacttggatttggctgtagggaataagggaaataggctgctacagccctgacatcactgcagcctcctttcacattggctggattgatagagacatacccaggggaagaaggaactggatgcttactcctcacacacttctgtgagcttggtgctattgtctccattcaatcacccaggaaactgggctgaaacagtgcccactacaccacaacctcccagatagaacccacgaaaaaggcctgaatgtactccagtttgttcttcctgacttctaaataataaaggtaccctccagggttgcaaacaaagttcagaaccagccagtctgcacccagaagcagacaccctgcctggtgggccaagtctatttcaggacttacagaaattatctaggctgataatagctatctggtctgaaatgaagtatgtgccttctcaaatagtcactgccactctctggactgtggccagctgctttctgagaaagcataaggtggtgaaggaagatgtcccgagagcaacaacaggaggtactgactgtaaattccctggagcccctggcggggtgcggggaaaccatatgggcaggtgctccctctgctgccctcatcctgccctcctggcctccggctttcccagccgcagtgggatgtctggtatacttcacacccagagcttcaagaaattatcctactcctactcaattctggggacacacactggctacagctacccacactgggaaacccttctgaactggttgcagagcctcctgccatgaatttacaattatcacaaattaagcacaaataaaaatgcctttcagttccattcttgtatgtgtgcaaagctctgaacaggctgaaaacacatctgcaaaaaggcctgcaatctatttgatctgccctcctctgcatgatgccaccatcacccattaagatcttccttaaatcaccatactgctcacctccacactggggcaggggcaaaaactcaatggaaacaaatcaaataataaggtactcccaaagagggagggaactagtgccaggaagccttcagtgctgaagatgtgcacttcttgccttagagtctatgctctctgttttgccagagtccagaacagggcaaacaccctctttaagggctagagctctagccacgggttggttatatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaaaaaatatatatatatatacacacacacacacacacacacactcacgcatatatatacatatatgcatgcatatatgtatatatatgtgtatatgtgtgtgtgtgtgtgtgtgtgtgtatataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggttttcgaagttcctcatagaatttttttccctccaagattgaaaaagaaaaaaagctacaacatatgattaaactatccttacaccaaaaagacaaaaaaaaaaaatcaggaattatctaccaccatccccagggtcatataagaaatggtatctttaacagttcagcatacaacgtaataagagacactgctcggcccagtgcggtggctcatgccggtaatcccagcacttcaggaggccgaagcgggtggatcacctgaggtcaggagttcaagaccagcctagccaacatggtaaaccccgtgtctactaaaaatacaaaaattagctgggcttggtggcgtgtacctgtaatcctagtactcaggaggctgaggcagaagaatcgcttgaacccgggaggcggaggttgcagtgagccaagatcgcgccattgcactccagcctgggcgacaagagcaaaactctgtctcaaaaaaaaaaaaaaaaagagagagagagagagactgctcccatttattaagtgcccactatgcaatgctaggtgctgcatatccttctgacacattgcaaggaagcagcactaaccccattttaaagaaagcaaagtaagctcaatgtgcttaagtaactgtttcaaggttgccccagtcacccaaagcttcagacttggccctccttgcggctctctctctcaggaggcagggtcctgaagtgcccggccttgcagtaatcagggcaagagagatgatggtgcccgtggagatggagagaaggggacagagttaagtggccagggagagaatccactgggtgaggagagggaaagggtgaccaagcattgtacggtgaacatccagcccaatgcctgggctactgtgccaacactttctgtgaaaataaaaaagtggtcatagatttaggggtgagatctaccgttttgtaacttactttgaaatacctcccaaaaaataagatggattgacagatggagagatatttgataaagcaactattgcaaaatgctaattgtggaatctaaatgttccctgtacaatggtttcaacatctctacatgttgaaacttttcattaaagaaaagttgggagagggaggcaatgcttataaaaaaaattaagcccagaaatgccttaagaaaccttcctcaaaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaagacttaagggaggggacaaaaagtccctgtgaaaacacccaggctaaaggacgtaggttaaactctaagtatggggtagagtagtcctctcctaagagaacagacacagtgtaggaatcaggggagagggtttcctttgggtaaaaaacaagcctctctggccaagaaaggaaagaggcagtgtgattgtatgaagttttcctttgaatatcttggagagacgctcttctgccaccagctgttccatcgccgccttccaggtaaaatgcctgccaggccttcctggagtgcactatcctttttccatagattttctcaaacacatccatgggttcaactctcatctctttacagaaatgactccaggccatctcagacttacttatttctccttttttttctttttctttttttttttgagacagtctcgctctgtcgtccaggcgagagggcagtgacgcgctctcagctcactgcagcctccactccccaggttcaagcgattctcgtgcctcagcctcccaggtagctaggattacaggcgcccgccatcacacccagctaatttttgtattttcaatagagatggggtttcatcatattggccaggctggtctcgaactcctggcctcatgtgatccacctgcgttggcctcctgaagtgctgggattacaggcgtgagccaccatgcctggcccatacttctttttctaagctccaggcctgaatattcaacagctccttcaccatctacttttgtctcatggacacccaatctcaacatgcagaactcaggatctttacccctcgtgcctgttgttcctccttcattccctccctaagtaaatggcaccagcctcttcctacgtacacctggcaccaacctgggggaggtgccccaacatcaccccttccctctcctcacccaatggattctctctctggccactcaactctgacccctcctctccatctccatgggcaccatcgtctctcgttccctgattactgcaagatgctcttaattcttatctccaccaaaatgtcttctatagagcagccaaactgatctgaaaaacccaagtctgatcctgcttttctctgctttaaaagacttatcactccatctctgctgtccagatgaagccccaaaacctcaacgtgacttacaaggccctccaagatctggccctgcttcctgccacggccccgtctctcattcctcggacacttgctcccgtgttttggccattctggtgaagcacagaagtgctcactgtctccctatagccatcattctcctttcttcaagtgccagctggacacacagccacccagaacgaaagctatgtttcccaatcccgctagcagctggcagcttcctgtatgaagggaaggaggtcagttcttctgccatttccttctgactgctggttggaatgtggatgtaacaggcagcactagagcaagcctttggggccatgagacagaagcagcatgctgaggagggcacagcaactgagaagccacctgggtacttgatgaacatggagccacgggatcagctctgaactgcttttttttttttaataggaaacaaatgtaaactcttttttttatataagccaatgttattttgggttttctgacatttgtagcttaacctaccctaattaatgtacttgccttcttttatttcatcagaagtgccaacctttgtcccaaaggagcctctgaatagcaaggtttcctccaggaacacattccccaccgtttctgttccttcccaccaccatggcctgacaaactcctgctcattctactgatctctcaaggaagctccccaaacctccctcactgtgttagatctgtattttttcatactctcatggtactctccgtttctctccacagcacttcctgtgatgagatgtacataattatttgtgcaattattggtttcacatctacatgctcccaaagactgcaaacaccacgaaagaacagaacccaaccactctgtctgctgctgcctgcctcaccccagcacagtatctggcacaaaacagacactcaattatcgctgagaaatggggaagaaccatggggtgatgcatgctgcatgggctttgtgccaataagggactgtctgtctcagacttcctgctttcactctttacctgagagccaaagcctcactcttatactaaaaggggcagaaaaaaaaaacaccaaccatgaaatgaaggaggtggcatttttggttgctaagaatcaagtcccagttggggcttccccaccttcaactgtcacagaaagcaggaaacacaaatctgtttttgtcttctcttcccggacactcttctggccaatcccctctctccaggtggcaggacaatcctctatctctccgttggcacaccacagccccagcctcatcctgccacttctgggtcaggccctagccttcctgtccctttccctctgccacagccagctcatgaacctgtctcccatccttcccccttggcctcatagtggttccttccgcaatctgtctgcacaatgccagggccagctccattcaggaaggcttccacctgggaacagcatgatccaccccacaggctctagcacaagtgcctgagttaacacagtggctcagattctcacttgaccaccatggggcccgagtatagcacctcccagccacgaaggcttggaaaccaggaaaacatgctccgaaaccccatctgactcatctgctcacttttgtggtgacctgtgagctctggagctgctactgtaggccctcaccggcagcctcaaaaggctgggagtgtctcctgtggccacggctgaaaacccacatcccgtcttccctacgcaatctcttccctgcagtcaagagccaagtgagtgacatgctctgatgatgctccttatcagcagcacagcaaaagctgtgttaccacgtaaggatcaaccagggcgtggacgatgacgaaagaacacacctgaaagcaacaatgctcataagcacacacgcgtgctcacttcacaccatactctatcatgaaaaggcatgttgcagatacttcatccaaagcctcacagaaactctataacccactataagtaaactgttgtgagccacacagaggtagaatgtgtatttcagaaaagtgcttcctggcagtaatgtccatatggattcacctccagagacaatcctcactggtgcctcccaatctggatatttcagttcattctgggcatctggtatgtgacgagtacaagattccttaagggtagctcccaaagaaatctaacttttccttggactcaaagtgtgagctgagtttaatcctcccctgctggcttactcgagaaatctgatctcaaaatcttgccgggtgtcgtgtcttgtttgaactgaagtcaggctctgctcttctgtttggtacactctcctcggccaccagcacagaggcacagcccccttcacccacaagatgctacttctactgacaaaaatatttactgacctgaagacagcacaaattcaaataaactctggtgagaaactccccaggtggcccagaccacggccacactgccaaggccactgccaaaccagcctccttcacaaagcaggcccccaccgctcgggtgctcagcagctgggccacctgaggccacactgtgaagcacatggtggctccctgggccgctgccttgtgtgagaagctgggggttaactcttcatatgtatggttaccacaccactaggggccacacatcttgtacatgtttctgattctcacaataccactgtgaagacagtgttaatgccctcattttagagtgatgggaaactggagctcatgagaggctaagaaacacatcagcaggaagtggcaataggggatttgaacctgggtctctgagactccagctccagacttttcccctggcagagcaccacctgcctctgccttgtactttccagttcctcgcctcaggactgggtgaacagatgcataggccaaatgtaaacattcattcatatctactaaaataaaataaactgctcggttcacacgtatcacctttggttgacttaaaagacttcatgaacttaatgaaactcgtttctcattttaccaaatgccctcctccatccttttcactaatgcttgcttatctggacacatgggaaacgttcctaagatctcgctataacatcaatgtctaaattcccagttccacttaaagaaaaaaatcaaatggactcaccctttcattatgtcctttagctgcaacacagcattccaatctcagttacagaacccccacatccctgctggcggtgggccagctccaaaactcgacagaacgcagacaaagcatttgggaacagatgcatttgctgcacagactttaaatttaatcagtgccaaaagaaattactaatatcacacctcatgcaacatggacaaaaatactggcggggggggtaatgttttggagaagacatagtaagtaattttcacatttaataaatgtgatcctcaagcattctaaataccaatgcataccaagttgacacaaacatctggtacctattccacataattttcagcactctgattccccatatcacccagggttctaatgaggagcgtgtgttcagctgtaataaaagtggtaaagatgcagagggaattaaggggtaacattataggctgggaccaagacatcgcagtggggagattttattctaatgacaccattggctaataaggtttttgttattgtcccacagggaattctgaaatgctgtcagctgcaaagagggacaaactcccacagattgtgggactgggtactacaggatctattctgcccttgggctgaaaatcctttctacccccatgggatgcaagaatctgtaagaaagggcacccaggatgatttctcagccaatagcactgcctcacttcaatcgagcttcatgagaaggaatgttaccaacacaggatatgacgcaaaaacaaagctccaagaaaaaaacacctggaatgccctgagctcacaaacacgcctgacgtgtacataacatatgctcatgtttgtaccatctcaaattacaattcattggaactacagcgccttggggatggagcggtggaatgtaccaccattaaactccaaagagggcgcttctaccacagctcctacctgggtttttcaacaataaaacctggcttcaggctgaagcttatccctagtaggaaaaaggtagacaagtcctaaaacttgtaatttggatttctcagggggaaaaaaactagatttttctacagcacaactcttaggcatatcttatcatggtttctttcaccctccaagcaaaatctacatccaaaccttcctcctaacaaactaaccctcttccaagaagtcaaccaccaactttttgggccaaaagccagtgcatatttgtgtattgttgtgttgaaatcatggagcaaccatgttggagaatttcctgtattcaattgtgttttcaaatgttcaaaaggaaacaaagggcacaggttctttaggaatccaaattctcaaagtgttgggaagtgccaagctataaaaggcacatactcttccatctaaacaagataccactatacaatctggacgtgccaacagagggggatttctgcagccctctgaggaagtggtgctgttatgtttcatggtttttatgacctgaagtgaagcagtggcatgtctcagaagtcaccactggacatagcaagaggtgtccttgtattacagaagcaccgggaaatagtgaaccaggagatacaggagctgggttttaagcattccatgatctcttattctatgacaggcttgacttatagatcaaatgatgcactatatgtgaaaacgctttacaaacttcaaatactattagagacataaagtcccttgaggggaagagaaataaatgaatgagaacattttctccaatcaaaaactgttttctctaaaaacttttagaatgattaataaaatatctaagataagatgttcttatactactccctagcattactccccagaaattatttctatgaattgcactggaaagacttaaaataaaactacagctgggcatgtactccctgtaatcatgcctgtaatcccagcactatgggaggccaaagcaggagtgcttgaggccaggacttcaagaccagcctgggcaaaataaccagacccccatctctttaaaaaaatttttttaattaaattaaactatgcacagtattagagtaaaaattcctgttctctgagcacattctggaagtacaactcccaaaggcgagaacaggccatgtttctgcctccagggaattccatcaatccataaagacaatcagttggcatcatcttggccaacagttcttctgatttactttgtttggtattttgttttgttttgtttttggagacacagtctcactctgtcgcccaggctggagcacagtggcgcaatctcaactcactgcaaattccgcctcctgggttcgagtgattctcctccctcagcctcccaagtagctggaattacaggcatgcaccaccacacccggctaatttttgtatttttagtagagatggggtttcaccatgttggccaggctggtctcaaacccttggcctcaggtgatccacctgcctctgcctcagcctcccagagtactggaagtgagtcaccacaccgagcactgatttacttttgaccaataatatggtgcacctgtccctattcttctcacaagaaggaagcttaaacagaaggagacactggctacagcattcattttggaggggataagaatttatgggatgttactgcctaattggctcagaacagagaccaagaacaaatctgaaggtttgaaggatgggagaaaataagatcttttttctcctaccctatgaatttggcagatacaaaataactgaaggatagtacacttctttattaaaatgcaaatgctttatcgacttagattcaaaatattaaactgaactttatcccataaaaaaattacaacttaattcctactaatgcaatatctgatggcaaagtaagacttgcagagctacaaagctacacctcattaaccctgagggatgacattaccaaatctgttcatctctcagaccttgatttgtacctaagatgatcactaattttctcttttttatcatttgcaaactggtgtctagcaagaaagaaaaagatgggagaaagagaggtaagaatgtgtgcaaaagcacggaggaataacatgcattgcatgtggcatgctctgggcctggtgagcattctgttagggctggtggccagggtctggggtgcagagtctgaagcagagacaagtggcaagatgagaaactgtaagagggtcaggaagggcagaagggggaaaccacaactgctggggagttgaatcatcgcctataaccactggtcctgattgcagataggagaccatggattaaaaaaggaaaatctgcaaacttttggtttggctgtgcaaaatattgttaattacagccatgtgtacacactgggccacgaactaaaacacatttactttaaggagtttatacataatcagggcactcacaattggttacaggaatgagtcaaatgcttaacactgaatgccaaattattcagcttaatatataggtcccaattataagactaaactctattccttcctcttcaggctagctagcctgctgcttcaggtgcttctgttaggagggaaactgagagctgacatttgcagagaaattatgaacacctggtcactggtgtgctcttgctcctttcacagtgaagctaaaaggctctgagaagctgtggacctggtttttccagagcttgtggcagttacaggcccatcaagcagtgccatcaacagaactactcagtgtagactgggtcttagagagacagaaggattgtgctcggctcagttgctgtggttcagaaccacagttttttgggggtaagtggacggggacaaggtctggctttgttgcccaggctggagtaccatggtgcgatctgggctcactgcaacctctaccttccaggctcaagccatcctcccacctcggcctcccgaatagctgagactacaggtgtgtgccaccacaccagctcatgtcttatattttttgtagagacggggttttgtcatgttgcccaggctggtctcaaactcatgagctcaagcaatccacctgccttggcctcccaaagtgctgagattacaggcatgagccaccgtgcctggcccagaactacacttttgtattgcacctgataaaattcagaggtcccttaaactgttacacctgttactcctttatagcaaatataagcttttataaatctattgcttcatttatttgggcatatgtttgtgtgtcctctacttaccagaaactccatgagggcaaggactgtgtttcttttacttcctctctcccagtgcttgacacagtgcctggcatgcggcacgtgttcataaacatttgttgagtgatgaattcatgtgccaaacaaccaaactcccaagctgctaattctctaaggactatggagccagtctcctacgtttaatcccagcgctgccacattttagccttttaacctggggcagctacttagccattccctgcctctgtttctttatctatacaatggggataataacaggatctgccccataagactgttcttaggatcaactcatttttattattgtattactgtaattattaccatctcttcaactatgagatgtgttctggaaaaaaaaatgcaaaagagaaacttcatcaaagcacttagctaaaggaaactacatcatttgagtgccaaacctagctctgcgctttctagcaggcaggatgaaaagaaaatatgatgctcacatagatatcataaaaaggaaacaaatcacaggcaggtgcagtggctcacacctgtaatcccagcactttgggaggccagggtgggaggattgtttgagcccataagtttgagaccagcctgggcaagagagtgagacctcatctctacaaaagattaaaaaattagccaggcatggtggtgcacacctgtagtcccatctactcaggaggctgaggtgggagaatcccttgagcccagggaggtcaagactgcaatgagccaagatagtgccactgcactccagtctgggtgacacagtgagaccttgtcttaaaaaataaattaataataataataataggaaacatcagctcttgcaagaaaatacttttccaaggtctcaatttaagaggcctgtaataaagcaagaatcagtgatttttaactttttaaaccaataatttgcattattgtaggtatgaaagcaagaagcaaactggcatttatttgctaaaagcatgtgatggagtttgtgatcttggcatgatatatgccatgacatatatcaaaaagtttggattttgctgtgtcgggtcaataagcaatttctgaaaggataaaatctaagcagagatatcagttcaataaaaggctaagagagaagggtataattcaatcaaattgtatttaacctaaaaataagataaagtactgtactattattgtttaataaactctcccccaaaaatttaaaactgggataaatgagatacctgttcagaaaaacatctattgagcttgctcaagacgaaactttacatagtaacatactgtaaaacatacatctgtatctgacaaagcaaccttccaaaacagatgtgtcatatgatgtttcaaagctgatttccctttttttttttttttgaagtttgtcacattcagtgaaagtaactgctgtttttcagaaatccgtgtgtgttattttggagaaaactttgctttggtgtttttccactctggatcaactagctcctctcttttcctcccaagcaaaccttcgtaaaccacactgccagagggaactcacctttctcccatggagacagctctaatacttgcaaatggtcaaactgaaaataaaatcccttgcatgccatttcctccaacaaaaagggctttgtctcaagatttgcacagaaaaacataccaaagctacatctattatttaaagtagtaattccttctctcagtatttcatattcctttcttcccaccttacttcatctggcccaaagaaccacctttccgccacacaataaatgcctcacttattcaacattgactggcaatgagatattccacataagcaaattatccaaataactaagtcttttcttgtttcaaaaaagtaagtgtctttagtcagttttaaggaaaatctgcctaaaatgtactacatgcataatttcttcttggccatcttaaatattttgagcatcctgaaactcgcttattgtatatttttcttgaagatgtagggctgccattatgaatactaattagtttattaaaacttgatgtgatttcagttactatatctaccaaatggtcccatatttctgtgctttatagttttttcggtttcgtttttgaggtggagtctcgctcagtcgcccaggctggagtgcaatggcaccgtcccagctcactgcaacctccgcctcccgggttcaagcaattctccctacctcagcctcctgagtagctgggattacaggtactcaccaccatgcccagctaatttttgtagttttagtagagatggggtttcaccatgttggccaggctggtctcaaactcctgacctcaggtgatttgtccatctctgcttcccaaagttctgggattacaggtgtgagctaccgtgcctggctgctttatagttttgcctatacttttcatacttgtgggtttttttccagttctggctgcaggcctgtgtctctgcctcaagcctatcacttaccatcttttacactcttatatactcaattttaagtcaatcaagtctggatgaagaccagaagatggctccccaacccatccacagagtaacctatatggacttttgatggctattttccttgtaactcactaaaacgttctgacttccttcatgatgcacaaacctgctgtaaaactgatactgtatcataatattagtgacaatattagggacactgtccacagtaatctaatttgaatggcaaaccatcaaagaaagttaagcttatgcactaaaggtgaactgttgggaatttagttcacaacaaaaccatgctaaaagctctattctattgcttctggggcttcaagcttttcagaagttctaagagaaaaaaacaaatgtataactaggtatgacaaagttcttatggtccctcaatcccattttctcatggtgacctccccttttctttcaggatgaagagatattcaacctgtacagcccagattaattacaattttagcataatttgcacattttttccactctagtttctcaatggaagttgtattcaccattccttcctgtcttctttcttgagtcagtgccagcaagcactgttcatagaaatcagatactcctaccagtgctccctggtccaggtcagtacgaatgatctaccatgaaccacagagtccagggcaggctggaaagcaccacctcacaaagaaaacacctaacggggccacccaaaggcccctctatggcagcagtccccaacctttttggcaccagggactggtttcatggaagacagtttttccacagaccgaggaggagaggatggttttgggatggaactgttccacctcaggtcatcaggcattcgtgagattctcataaggagcaggcaacctagatccttcatatgcgcagttcacaacagggttcacactcctataaaaatctaatgccactgctgatctcacacgaggtggagcttaggcagtaatgctcactcacccgctgctcacctcctgctgtgtgccccagttcctaacaggtccgtggcctgggggtggggacccctgctctatggtacaataccatttgcagctttctaaaatccagccatgacatggaatcttccctgcctttccatgttgattagaagtcggggtccaaattcactctttgcaaatcattattatgtaaggaaaggcatatgtatatgtatatgtatgtatatatacacacacacacatacatgccaagggctattactgtttctcatactcaagaaggttcgcttcctaagctccttcctgaaatgaaatcgtttctttgcccgagagatagctcataatttatcctagatttcaaccttttttagtaaaaagtataggaagttacatggaaacaatgaatggaagtgtacttttttttaatcaaacaagaacaggaaactttccgtggtttatggtaaaactacatatttgagccaaagaaaaaaataaactatgctcaacccctttttactctcccctatccaaaacatataagaacatgcacaactgacaaccacaagacaaatctcaacaccagggacaaattaatatttataggcttcaaaaatatacttccccaaattacttaataaaccccttcaaacaggccgacacctacttcttctactattgtatgaccaaaatgagtcataataaaacttaggaatattaaagacaataagtgaggaaattccagaaaatataaaaactatttcagggagccaaaacagaactatatttatttttctatcaaaatgcataggtataaataaacgggcaaataaaacaggcgctcacaaaagtaaacatatacccggctgcagttctacaacatagtcttctaaattaccacctcctccacattagagaaattacttccttcaacaaaattaacctccaacaccctccaaactgtaaaaatctctactatactgtgagcaatttataaaagcaggcatttttgaggccaggcacagtggctcacgcctgtaatcccaacactttgggaggccaaggcaggtggatcacttgaggccaggagttcaagactagcctggccaacatggtggaaccccaactctactaaaaatacaaaaattagccgagcatggttgtgggggcctgtaatcccggctacttgggaggctgaggtaggagaatcacttggacccgggaggcggaggttgcagtgagctgggatcgcaccactgcactccagcctgggtgacagagcaagactccatctaaaaataaaataaaataaaataaaataaaataaaataaaatagggatagtcctgtcctagctaatcctcagggtcatcatgaaaacaaatgagatcatggcatttgagaagtgtttaattaaatcaggaagttctataaaaatataaagataacatcaataagtatatgaaagatcaacagaaaagaacctcctttctcctcactacccactttacgttacaaaaaagaagcccacaggatacaatgggaaccttgggagcacagaggaaagaacactacatttggacctagaaggcctgggttccaggctcatctctgccattaacaagttccttgacttagggcccctctcttggttgcctcacctggagttaatactacataccttgccaaaatgaattaaagtaaaggatagcaaagaattctataaactctaagtgagatccctatagaagagacaaatgaaatcaatctgctgaacaaaaagtttgaactttaatggtttgtgttataaaatcaactgacaaggaaagaagttggctgtaatcagactcttcccaaacaccccaaggaagaaagccaaccaagacagaggagtggagaagcctccacagtgtgaacctggaagggctcagcttgtatattcattacctaatgaaacgggggctttagaagtgggaattctgaacctgtcactgtggatgagaacctctctgaatccacttaaacccatgaattgaaagactgggttggattttttccattcctggttaagatagagccacacaaatcctaattctaaatgtggatgttcaacattccagaataaacagcagctcatggagaaagcaacagaaggatggcaagaggaaaaaatagatcaacaaactacaacagattggtcacttagtaattaaaaaagaaaaaaacgaaaagaaaacaacccatctcaaagttcaactcaaggctgaattcctatcagaaactaccagaggccaaagactacatctgcataatattttaaatctgagcctggtctttgagaaaacatttgacaaagattaccaaaacatctatttttctttctttctcctcatttttctcaattattttccctaatccctacacttcactgaccactcctgcgttctcaactgcagtaagcaaatacatactaagttggataacatattattttgtatctatggtacacagctacagtgttggaatggctcctgattcttcctgggttagcaaatgttcacttaaatcaagtgtaccacctatttcagctattgagtctctttcatctttatgggactatattttgaaaatcactagaaactgcgtggttcccatatattgggctcaactgaaactttaaactcatgcaataactgttaatattcaagtataattttacctagcagtaaagttatattttgcacatcaaaagcaaaatgaagcattaagaaatttagttatatacattctttcatatccctttacataagcagaatacaaagtacttactttttttcccccaaatgaatacaggatttcaacaacattaagacatgattattttcacttactcccatataataggtattcttattaaagaaaacatcttaatgtcaccatatatgaattcatctaatctctgagtactcatttatcatctctacaactacacatttgacagaaccaaactgtggccctaagaaacaagaattactggcatagctaagaattcaagaaatcagaatacagtctccaattatgcatttacttcaaataagaacaataacttgaaactctgtgttaggctttgaattcacctccagcctgactttaaaaagctaccatgaggcctaactccagctggcagtagtaaacatccctggctatctaacaatatttttataaacaaagcatcataaagaacataacgttcaaacggcatggaaactgttttccacggtccatatttgacaatctttcaaaaaaatgttaatattacacatattagcactgtgtaatatataagatgtaaccccctcttcacaccaagatcagttgcaaaagaacactatgatcatatttcagaaagtaacatgtaaggaaaaagaaaaaataaagaacactatgaccttggcaaaattctcaagtgttcagacagaaacttctagaagtgcttgtttgtttgttttcaaattctgctttttgaaattactcacttgatttttaggccagaaaggatgcaaacgtctgaatttctgcagtcacctccctcccactgcttttaattgctctataaagcaatccctgtggatacctatcttaaactgccctggccttgccaggacaaatgttggcccatgtattccagtaaagccatgagtattctgaaggtcaaacaaaatacatattatttccaatcagaaaggaagcctgtgctttctggaataaggccccagctcaaccttgacttggtgcgctatgaggcaaataaaccaagaactgggaatggccttcctttttaatcagtactttctgaaggatgctactgataacagaaaaaaaaaaaaaaagtcaatatacttgataattcacatctccctctgtcttggctggagttttttacagatgcatttacagatatttaaaataatgatcataaataaagctttaagtttagagtatataaatttttatttttcccccactcctgaaaaaggcttgatggttacttagctttttcttttccttttttttctattttaccaaacaagtttccacaagtccttcctacgcgtgtcctcacagccaagcaaagagcagtgagatttctcaccattaattcactcttcatttcacatgttcctacagcaccagctgttagtttatattttcagtctttactattaaaaaaaaatttcaactgcaactgcaccatttccccttagccccagcctttttttttttttttttttttttttttttttttttttttttttaggaaagtttaggacagcagaaaaactgctgagctgtgacacaaagaaaagctgactctgcacatgcctcattgttttctattttcattccagcacagttgtggctggaaaccagccttcaggattccccgtggaccttgccagccctggtccctggtgttttaaaatgttacactttatacactactcatagaggtgtgattcaattgagtatgttccctgtggttctgagtgaggctaatatatatcatgtatctttggagaagtaaccaaaatatgtgtttagggaaaaggaaaaaaataggatcaagggagtattcagagatgtaattacacatactcaagtgggaccttttgtgtgtgtgtcttggaggtgggagatttaatgtaaacacagaccacgtttgtgctttctgttatacacatcctgcatcaccacacactgagcacacatgtgttaaaatgctgacacattcattacaagaacatcatttatcctattacaagttttagagttttgcatgtcttttgttgatggtggggttttttccagattttcttagttttcttcctcaaatacacttgataacttatttttaaatgtgagagcattattataacaccaacagcatcctcctgcaatctatggacacagattattttgccagagtaaaacagattccaaaaggctgttcacaccttctttgggggacctaaaacacagggtccaggaagagctcagaaacaatccttaaatcctgatcatcgccaggtgtggtggttcatgcctgtaatcccaacactttgggaggccgaggcaggtggatcatgaggttaagagttcaagaccagcctggccaacatggtgaaaccgtgtctctactaagaatacaaaaattacccaggcatggtggcatgcgcctgtaatcccagctacctaggaggctgaggcaggagaatcacttgaactcgagaggcaggggttgcagtgagctgagatcgcgccactgtattccagcctgggtgacagagcaagactccgtctgggaaaaaaaaaaaatcccgaccatcatcccactccactgaccttgtaagcgaggccactcctcaaagagctagggatcccacaggctaaaaataaccctttgacccacatagaaattacaactcagaggaagctgagacaattcatccactgagagccattctcctgtttggagagggcctacaggcatcagcagcacctaaacatacagcctttcctggtcatgatttatttcttagcatgacagtaaatccatagcttacaatagcaggacgttgctgtcagacaccaaggtctctcagcatagccactatcctgaagtcatgaatcacacctccaagtccagtgacaggttcagaggctttaccaccccctccctcccctaaatccacaggatgcccactctgcttctctgctcatgcgatgatttcattagttcaaagatattctgccttctatcatttttctccttacagttcttaagagaatgaaccagcttcagaaaatggggaaagaaaaaacaaactgatcatcagatgagggttcaaatcttgaactggcttcttagaagctgtgtcactttatgcaagccacagtctttctcagtcttagttccagataaacagtgaatagcagcacattctttatgagattattataagactcaaatgagagaatacacaagaaaatacctagcacatattaaatgcctgctaaccttttacctatgagcaatcataatgctcaattcatacttttcagagggtgtagtcattcaataataaagaccagtagaaatattttaaatcttttgtaatcttctcagccaggtttgggacagcaactgaactgtccaacctctctctaaaggcattacatcataactgtaattacaccaggctgtaactgatatcaatgtaaatacacctactgtactacaccataacaacatcactgttatggtactataaagtattacaggcatagatgttaactgccacagtatttataataaacaaatactttaaaataaccagccgggcacggtggctcacacctgtaatcccagcactttgggaggccgaggcgggcggatcatgaggtcaggagatcgagaccatcctggctaacacgttgaaaccccgtctgtactaaaaaaatacaaaaaaattagctgggcggggtggcgggcacctgtagtcccagctactcgggaggctgaggcaggagaatggcgtgaacccaggaggcggagcttgcagtgagcagagattgcaccactgcactccagcctgggtgacacagcgagactccgtctaaaataataataacctaaatgttcatcaaaaagggtgtatctatatcatgaaatacatatgctgcatttaaaacactgttatttgtacagacagaaatatcttatgacatgttctttttgtatgtaaagaatgatacaatttattaaccttctaaaactatgtgtatttgtccatatgcatgcacatacatgcatagaaaaaggattaaatggataactctaactataaatggttcttacctaaggtaggggtgatgctagagacgggttggagacacgagaggaactctgactttgctctccatccttctatgaggttgacacaaaagtaattgcagttttttccattaaaagtaatagtaatggccgggcacagtggctcatgactgtaatcccagcacttgggagactgaggcaggcagatcacccaaggtcaggggttcgagagcaacctggccaacatggtgaaaccctgcctctactaaaaatacaaacattagccaggtatggtggcacacgcctataatcccagctacttgggaggctgaggcatgagaatcacttgaacctgggagacagaagttggagtgagccgagatcatgccactgcactccagactgggtgacagagataagactgtctcaaaaaaaaaaaaaaaaaaaaaaaagtaatggcaaaaaacacaattacttttgcaccaacctaatacattcttaatgcttttactgtgcaaatgtgtttttgaatattacttagataattaaaaatttaaaaatatgctctactttatcataaaaataattctgaccaaagccaatgctagttgattggtttctgctctacatatcttattttaaaaatcatatgtggtttaaaggaacaatctcagtgtctctctaggaagcagagaatcctggtttcctccacttcagtgacaacgccctctcatagacctgagagctgtggcccaacttcctcctcctctgtggtcagcaactctacggacctggggccttgcctgggtaggatgctgtagagaaaagacctggctttgaatcctggttctgtctataccatctgaaactttgccttagttttctcatttgtaaaatgaagacatctacactttgtgaggattacataatgcatgcaaatatacgatacatattaaatggtcaataaatggcagcttttatctttactattattaaccaggttagtctctagatttcagtatcaattctcctctgtaaagggagggcctatcatttgattattttgaaagttcccagctctaatagtctatgaacatgtgctatagaagacaatggacaaatatgtgctaaatagtgaagccaggtggctgagaccaaagagaccagacaaatggctaagcagagctttggcaatagtgtgacttatgtgacctattaccatatggggtaagaggcaaagaggataagagaagtcttttcaatcccacctagaagcctttagaatctggagagatgatagacaaaccgccacatttatattcttctactgccaaacagaaaacatttccagtatctcctagtgcccgctgtaggctgagaagagcaaagcattaaaaaaaaaaaaaaaaaaaaaaaaaaaaaagatgaatcttagtgtgaccttcccaaacataaacttcattttccagcctcaccaatcttttagaacagaagatcaagtcaaatccctttagaatcaacgggtaataatatctcagcacatctaatctattttgggggctcagttgaaaccccatctcctttattagccttcccaaatcctcctcactaaaagctatcactctctttcacttctcacagactttgttcttcaactctattaatttctgcttcacattagttatttgcatgcctattttatctcccttacagggccataaacccccttacaaagctgaataagggccgggtatggtggtacacgcctgtaatcctagcactttgagagaccaaagcaagggaatcacttgagtctaggagttcgagaccagcctgggaacatggcaaaaccccatctctacacaaaaatacaaaaattggccagcgtggtggcacgtgcttgtagtcctagctacttgggaggctgaggtgggaggactgcttgagcccaggagccagaggttgcagcgagccaagatcacaccactgcactccagcctgggtgacagaactagatagaccctgtctcaaaaataaaataaaaataaagatgaataatgtcctatttagtcgcccattcacaagccttattgagcacctatctagatggtaaatactatataaggtcctggggatacagaaataataacgcattttccttcttcaaggagctcacagtctaatgggaaagataggccagtgaacactcaatcatcaaggtgttaagggagcctggagggggagcctccctaattcacctcaaagaaggggaagatgagaagggtcaaaaaaaggcttcctagggcaggtgatatctgaggtgattcttaagaattaatataatctacccaagcaacatggataggaaatgatgaatctgtattaaaaccaacataggtacacatactttgaagaactgcgtggcaagttcttataaagttacatacaactcagcaattacagtcctaggtatttactcaagaaaactgaggacatatgtccagaaaaagacatgtttatagaggttcatagctacttaactgcataatactaaaaggaaacaacctaaacatccatcagcaggtgaatgaataaacaaattggggtatatccataccgcggaaaacattcaacatcaaaaaggaacaaattactaatacatgcaacaacttggctgttgattctcaaaaacattttgctgagcaaatagaagtcagacacaaaagagcacatgaacttctagaacaggcaaaactaatctatagcaacagaaagcagattagtaattgcctgggactggggatatggactacagggaggctgaagagaatgaaaggggtggagatggataatagaaaaattctctgtatcttgattgcagtggtgattgcacaggcatatgtattcattaatactcatcaaaatgtacctttaaatgtgtgcaatttgctgggtgcagtggctcacgcctgtaatcccaaaactttgggaggccaaggtgggagggttgcttaaacccaggagtttgggaccagcctaggcaacatagcaagaccccgtctctacaaaaaatacaagaaatagccaagtttagtggtgcacacctgtagtaccagtgactcagaaggctgaggtaggaggatcacctgagcctgggaggttgagggtgcagtgagccgagactgtaccactgcactccagcctgtgtaacagagcaacaccctgtctcaaaaataaatatataaataaataaagtgtacattttaatctatataaattatacttcgatataaagttgattttaaaagaaaaaaagagtatgtagtacagaacacagactctggagccagactgccagctctataatttattggctgtttaagagttaactagtaatggcattaatattcacactgcattaatatttagattataggcaaagatctggaagtaagaaatgacatgatagtatgaggactacaaacagtttggtatttagggaacataaatcaagaggaaagatgtgaaaacagatgaggccagagagacagacagccgaaggctgcaaatctctttgcccccacacctaagaaagagcatctgacatgccatgggtgcccattcaaatgtttattttcattgatgaacatccattgagataccattacacacccactaggatgactaattcaaaatgacagataataataaggtttgcaagcatgtggagaaactagaaccctcatatattgttgctgggagtataaaataatacaacaggccaggcgcagtagctcacacctgtaatcccagcactttgagaggccgaggcaggtggatcacgaggtcacgagttcgagaccagcctggccaagatgatgaaaccccatctctactaaaaatacaaatattagccgagcatggtggcaggcacctgtaatcccagctacttgggaggctgaggtaggagaatcgcttgaacatgggaggcggaggctgcagtgagccaagatcgcactactgcactcctgcctgggtgacagagcaagactccgtctcaaaaaataataacaataataatgcaaccactttgaaaaagagtttggcagttcttcaaagggttaaacacagagtaaccatatgacccagcgattctactctcagacacatataaatacaagagaaataaaaacataaggatgtgcttgactctggccttggccaaagccatacttcccagaaaaaagggaaaaaacataagcccacacaaaaacttgcatgtatatgaatgcccataacaacattattcctcatatccccagacaggaaacaatgcaaacgttcattaactgatgatgaattttttaatgtggtatatacataaaacaaaatattacttggccataaaaaggaatgaaataccaaatacatgctgcaacatggatgaaccttgaaaacatgctaagtgaaagaaattggtcacaaaaggccacatatggcatgactccatttctacagaatgtccagaataggcaaatccatagaaacagaaaatagattagtagttactagggcctggggaaagggaagaatagggagagattgccaatggataaagaggttttttggaggatgattaaaatgttctaaaattgactgtggtggcagctgcacaactctgataacatattaaaaatgattgtacactttaaagaggtgaattgtatggtatgtgtattatatctcaataaacttgttataaaatgtgcaatgaatatactatcaatagtccacttgtggttaggttcagtggctcacgcctgtaatcctagcactttgggaggccaaggcgggtggatcacctgaggtcaggagtttgaaaccagcctggccaacatggtgaaaccccatctctactagaaatacaaaaattagccaggcgtggtggtgggtgcctgcagtcccagctcttcgggaggctgaggcagaacaatcccttgaacccaggaggcagaggttgcagtgagcccagatagtgccattgcactctagcctgggtgagagtgagaccccatctcaaaaaaaaaaaaatccacttgattcaagcaatgtttgataaaagttaaacacaaaggaatacgaagtatcctttttcgttcaatttgctgaaacccatattaagtccctgctatgtgccagctacagtggccacaaatagtaagacagagtgccttggccttaagcagctatactcccagagtcgagagagagtgacaggtggagtcaggatagagagacaggtacacagtgaggtagcacattagagggtcccctagaaggctgccgagggaacggaggaaacacaaacaagggccatgatcgcctcttcattaccttgtccagtaccttatccctaagttatggtcctgttagatgtgcatttcttctattttaagtcccgctcacatttatatttagtaggaggccgctgtggtgagtggtgtgactgattctccagctgactgtcctaagccaatcactgtaactccattactctaccagggactgattcaaggatgggaggaaaagctgagtcaattcagccaatgattgcaaagagagacatactgggtgtctggggaaagaacctctctcgctcttagctgaagccagcattgcccttcctgtttgaaggagcaaaccgatggctcctgacagccattcctaagcaccagcacatccttcttcagctgaagatgaccctatgccagtaaagcaaacagacaaaacaacctaagtattaaataaaattagtcatattcccattttctcccatccactattaaaaaaaaaaaaaaggcctggccatgccacctgatgcctgtctcccctccctggtctggaggcacctacagagcagggggccaggagttccacgggtctcatttcctcccgtcagagcctagcacttagtcaaccactgcaagtcacatattttgcaagaacggaaaagcgatgaacagagagttatcaatctgttgttatactcaaccccaaacatttttaaaagcagattttaacggagaaaaaaaattacctacaggcctttcctattaaaacagatgaacatagttgcctttattgattcaagcaaagaccacattttactgaggaaaactttctgtcccttgccctctacctattcctgtggtgccaacatagaaaatgtcctggacttctagggaaggtaagctcccggggtggggacgccgtaggtgtgatgtaaagtgccaggcatgaggctggcatttgatgttaagcgctgtagcaacgatcacaacaacagaaccagcggggcgtgtacaggctggcggttacgacatggaatggtactggtttctattctcagcatgtgtcactgacttactgacaagacagttaaacataaaaggggtccattatcagtggtaactgggatcaagtccttgggatagcaggaataagaaaaatccagcagtaatccccaaacctcctgtttctcaagagtttcaatttcctgctccaaaccttttcaaaaactgctattaccaaagtaaactgatttaagttgactgttacttcctttccgtgatgtgacagccccaaaggatgagcagggagagacaggcccccattatcctccacttcttaaggcttctttgtatgcacgccgcatgagataattcattaacgaagaaaaagttactggttatgataacacagtccctggcacacagtaagcacttggtaaatgtttactgaatgactacaggaaatatctgagtgctggacagaggaacaaagcctcaactctcccaggtttacttttttagccaacctgttaacaacaataatagtgcatgtcatcaaagagctggaaaggagctggcttcagtaaggctgcagtcactcactactcagtgaatgaatcgatccattcagtttctctgacccccatccagaatacaaggtagttatggccagcacaggcataactcccaacggacttgttattaaccacactgggtaactatgaatggatgcagagacaccagttcagttcagctgcagactgtccggaacattatcttggttaatcatctactccagggtaccggctcttcagatcacgctgaggtctgcttctcaaagcctgacaggatcagaactgtacaacctctcacagtcttctttatcccttccccaagataactcgtcatgatcgctatagaataaacctgaaagggtttacttactaccctaattacaattactcagggtgaagcactggattctcctgcaccatgaagaactttcaaatgtaaccatgcacacctcctcttcccctaactccacacccccgtcaatattttggcttcattaactagtcaaaggaaaaagagtttgccaaatggcaaactcatatttcacacaggtatctcagccaagacaggaaggaaacatcaaatccatagcccagtgtataaatgttcagcactgaaatgaatgaaaacgaacaggacacttgtggttacgctttgacttaaatccttagttaaagggaaactaaagctgatccagttcagtttatcaacaggagagttcataaggaattatcatgagcaaacaggggcagccacccccgaaactgtagttgccttaagcagaaacggaggtgcaagtgaacttagctgtgaaagggtccctctggatggtcacctccacagaagcagcagctgctcaagccccaaggcacactactaaagttaaggagtgaaaggctgctggggtagaggaagaccgaaattcttccaggaaggaattctagtttaagcctgtattactgtcactgcagttccaggaccctcccactgcaggtccctctctcccaattccctggcatctagtcagaccaggaagagcaggtgagggacctcaaggactcctcaatgcagtgagtgggtgtttgaagctttaaggctaaagctgacttatacgtacgtgaaggagtccctctttttctgaccatcttcctgggcatgtgtcctgctggcaaatcaccaatgccagcactctctacctcccaaccccgccccctccaccatgacacctgggccatgacccaagcagacatgcagtaacaaggcacagtgtggctgggcacgatggctcacacctgtaatcccagcactgtgggagggtgaggtgggcagatcacttgaggtcaggagttcaagaccagcctggagagcatggtgaaaccccgtctcttctaaaaatacaaatattagccaggtgtggtggcacgcacctgtaatcccagctactcataaggctgaggcacaagaatcacttgaacccaggaggcagaggttgcagtgagctgagattgccccactgcactctagcctgagcaacagagcgagactcgaaggtcttcaaaaaaacaaacaaacaaaaaaaaaaaaacaaggcatggtgtggggaagagagccacaggatggcatcagaagacccatgcactggctgtggttctgacaaagtgacaccaaagggcacatatgctagaagggtccagccatagaatcatagaacctgtgaataccagaagcacccagaacatagcagtcccctcaaaggaagctctgagattcaaagtgtgctccaagatgatgtccatggctcaccaattcccatggagagttaaaactaccaaggatgctttggacacaagaaaacaatcactatgaaagcaaggactctaaggggacaacaaactccaaactcagttgttccagacaaggggtttttttttgttttgttttgttttgtttagagacaggatcttgctatattgcccaggctggaatacagtgtctattcataggcacaatcccactactgatcaggatgggagtttcgacctgctccatttctgacctggccagttcatctctccttaggcaatctggcagtcccctgggagtccccagggaagtcaccacactgacgctgaacttagtgcagacacctgattggcatagtgcactacaacagcccagaactcccgggctcaagtgattctcctgcctcttgagtacagacccaaatgatcgttacagtttacataaaggcagggcctgaaataaaattttcaaaaagctagatctttggtactcaacactctttccatctaaaaccagaactagaggccagacctgagcaatacaaggctgtgttccaaaaactgccaatactagtaccatgttctttgcctctgtctttctctggcataaccaagatcagctcagcctggcagggttatgcttggtgaagagggatacaggcaatcgggacttggtgctcgtccccaagggcagaatacttcctggctacttgtgtttggtatgtctttgttttggtttagccctggcaatctggcaggcagtcgatttccagggggagctctgtccacggtatggatgccccaggcttgaggtcctcattcattttcataaacaaagcccagttgccacagtgactggtgctgcaagcagctgctaaataacagaggtcacccagagctttctctgggttctacagtctgttcctaggcttctgtgaacagtgagtgggtcaacgggagctgcagtcataccagccagtactttatatgggagtctgccccctgaggagaaactcccaagaaagctgccagatacacaagtgatttcaggtggggtccaataccccacccctgacagatctcggtctggggcacaggaagaatgaagggcataaggagtagcaacttcctccttgtggcttcaacagtccccagagcagtgagagggcacagggtcagagcttggtgcaaaaggaatgatcctggaaaagtgagtgtggagttgggccagtgctgcttctgcaccctgtgtgccgatcagacgctttctccctgtcccacttaggtgggaaacggctctcaccacccccatagcaggaagcacaacacgcctcccacccagtacacacaggtaaaaacttctggactggagtcccaaaggtctcttcaagttagaaatcatcaccattgtgtttccacctccccaaggcaagcctgtccaaaggccacaagatctgctagacctcacaagctggggcacaacctgcaccatgcccacctgcctgggttgttcatttgttaaaaccagtaatagtttgtcttttactctgcaaagtacagcttctgtcctcaaggtagatcatttcagacaaaaacaatttaaaaaaaaaaactgcactataaggcaggtcctcttcgctcttgcaaaaccaagtcaccttggctagagcccaaggaagctgtaaaatagaagtgagcataaacgtcacttagtctttagactcattcccatgttaacatggaataataaacattcttcgaccccagtgccagttccagaaataagtgatcatttaaaacttaagcaaaattaaggtttaccattcccagaaacatatgcttctgtctttatcaaccatgaaccaactaaaccactacaaggaaaggaaaatggaaatgaaaggtccctaattcgcagtgtaactcaaaggtaaacctgcagatttgggtcaaacacgcaaccaggacccaaatgttttatacacaggattttttgtgttatttccaccactgtagtttattacaggccagaagaaacctaaacagttaagaagtttgtccttaggcaaatagttcaataatttagacttcaaagactccatattaacctctgtttacacaaagtaatgtgtttcctttgcctgctgaacatcaaaacacgtaacaattaattacctctatttttgaaaacgacgtaagtcctgtgaaatataatagccaacacattttaagcagagggaaaaaagcatgttcaaaatctgctgcattctctgtagagacaaagtaataacaaaacatccatggaatttaattaacatagaaaattatttaaaaacaaaaacttttctccttaaaattgtcatttttctttctgtattatctatttttttccatgttgccttatgaacacagtgaatctaataatagagcagactggcttttatatccctttacttaaaaattcaacaaagttaaaattccacgtaaaggtaaagcttagataattcaaagttatgtcatgttctaactagtcagctctcctgagagcattcctagtccatcattaaccaataattaatggctaatttcctagaaattaactctatatcctgtatagggaagtgtaaatggaaaaacagctagtggccctaaatgagagagagctttgcaaatactaaggtcatctttgatatacagagacaatcgatattcctttgaatttgtacaggaattttaaatttgcattttttccccattatatgaccctcaaaataaccacatttggctaataataacattattatctatggagtgtttactattgtgcaagggtctcttctaagcatttgacatgtattaacatgtttattcctcacaacaaccttgagatacactattattggccgcactttacagatgaaagaactaaggtagagtgatattaagtaactcactcaaagtcataaaattattgaatcaagtgattaagccaaaccagacagcagggggaaggtagaacctagactagaaggcagtccagcctcctgggttccaaaatcgaagggagtttcttctcagagaaaactctgaatcggggtcacgcatggtggctcacacctgtaatcccagcactttgggaggccgaggcaggcggatcacatgaggccaggagttcaagaccagcctggccaacatggcgaaaccctgtctctattaaaaatacaaaaattatataaaaatataaaaatggtacatgcctgtaattccagctactcaggagactgatgcaggagaatcacttgaacccgggaggtggaggttgcagtgagcccagatcacaccactacactccaccctgggccacagagcaagaatctgtctcaaaaaaaaaaaaaagccaggtgcagtggcctataatcccagcactttgggaggccaaggcaggtggatcacagggtcaggagtttgagactgacctggccaacatagcgaaaccccgtctctactaaaaatacaaaaaattaaccagtcttggtggcgggagcctgtaatcccagctacttggaaggctgaggcagaagaatcgcttgaacccaggaggcggaggttgcagtgagccgagatcactccattgcactccagcccaggcgacagtaggagactccgactcaaaaaaaaaaaaaaaaaaaaacaggcctggtaacccacgcctgtaataccagctactagggagactgaggcagaagaatcacttgaacccaggaggcggaggttgcagagagccaagatcacaccactgcactccaccctgggcgacagagcaaagctctgtctcaaaaaaaaaaaaaaaaaaaaaaaaaggccaggcacggtggcttacgcctataatcccagcactttgggaggctgagacaggtggatcatttgagatcaggggttcaagaccagcctggccaatatggtgaaaccccacatctactaaaaataaaaattaaaaaaaaaattggctgggtgcggtggcacacacctgtaattccagctacttgggaggccttgaggcaggagaattgcttgagcccaggaggcggaggtttcagtgagccaagatggtgctactgcagtccagcctgggtgacagagtgagacttcatctcaaaaaaaaaaaaaggaagaaaaccctgaatcaagatatcccaaggaatatcccagtgagatctgacctaaatatatgtcctaattctatggaaaactcaagtactaacatattaaagaaagaaagaaacaaagaaaaaaggaggtccagatttccttaatcatctgctcagaattctcaatatcattttaactctacacatattttctacattgtccaatattctttgcaaattacctaagaaaatgtttaaagcctccagaaaaaggaactatttggacattatatactggaattttcactacatttttttcctacattgtaatgttttcatggttttttaacaattcatgtttctggcaaacttgttcttttaacactcaaagctaaactcatgtaacacatcatgctggctgcagtttgaagctactatccagctgggctgattttaaaatccaattctgatagcatggtgtctcccgccttcaataagagttgaaacctctcctttctagaaaatcttcacatatcaaaaagacaaaagatacttttctctttatgtatttgaaaattgcaaatagtaacagacgctgctgagatctcatttcctatcctctgacaggttcccctttggttcaggcctgaagaatgggcatgacatatgagtgtttattttcctgcactaaagtgaaaatctatctgcctttgagagttcagagttgatctttaattccatcatttgaataccgaacacctactacctaaagtgccaagttcttgtggctactcgagaaacagcagcgaacaagataagcagtttctcctctgctttcatggagcttccattctatgcaggaggagaaatagacaatgaacaaatacgtgagatggagtttgttttggtttggtttggtttttaagacagagtcttgctctgttgcccaggctgcagtgcaatggcgcaatcttggctcactgcagcctccgcctcctgggttcaagccattctcctgcctcagcctccctagtagttgagattacaggcgcctgccaccacacccagctaattttttgcatttttagtagagtcagggttttgccatgttggccaggctggtctcaaactcctgacctccggtgatccacctgcctcagcctcccaaagtgctgggattacaggtgtgagtcactgtgcctggcggtgagataatttttaaggcacaaagaagctcctcctccaggaaaggacaagtatagcaatggatgggggtgctttatgcaagtggggggcccagagacccagccactgcctatcccctgtctggctcacagccccatcataggctcaatgaggcaaaagtgttcccaactagatcaggatagctctaaccacaaatctgagccttgcttcttttaccaacagggagcaaagtcctctgagctccctcaactttgacacacaccatccggccacttttatacaacacttaaattgtccagaattcatttgcttcactgtcaccattcagatgggttatttgttagacaaaaattctatgtagctctacaaggaagaagtaagggctgggagaggaggttacagccagatgaactgtagcacaacacaaggaagaatttcccaagagtcagggatgttttaaattcaagtaaaggttgggggcttagtcaacaggatattagaaaggtagtttacatatcaggctgagtttgaccagataatctccaaggattcttaaaatgccaacacaggccaggcgtggtgctcacacctctaatcccagcactttgggaggctgaggtgggcagatcatgaggtcaggagatcgagaccatcctggctaacacggtgaaaccccgtctctactaaaaatacaaaaaattagccgggcgtggtggcggatgcctgtagtcccagctactggggaggctgaggcaggacaatgacgtgaacccggaaggcggagcttgcagtgagccgagattgtgccactgtactccagtctgggtgacagagcgagactccacctcaaaaaaaaaaaaaaaaaaaaaaaaaaagccaacataccactagaactctaccatgccctatgaataccaaatcttcccagatgtaacttaccctaaaacattacttgaggatatatgttgttaatgagataaaaattcagatgtcggccgtggttcatgcccgtaatcccagcactctgggaggccaaggtgggcggatcacctgaggtcgggagttcgagaccagcctgactaacttggagaaaccctatctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaacaaataaataaattttaaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacactgtaaaatgtagcaaaccgaggttacacagctactcagtggcagccgtgggatatgcacccaggcagctggctcttaacgtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttactatagtttaccaaattgtagaagttagttcagcttccaaatcttatttccaagcagtagcttcaaaacactggaagaatctggctcaaaatcagttacaacattttgccatgacagtataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacgacaagatactactggcttcccctcccttttgtttccccattttaaaaaactaagccatcaaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttatttatttaattttccaagatagagtcttgctctgtctgtcgcccaggctggagtgcagtggcatgatctcggctcactgcagcctccacctcgtgggtttaagcaattctcctgcctcagcctcccaagtagctgggattacaggcatgcaccatcacgcctggctaatttttgtattttcagtagagacggggtttcaccatgttggccaggctggtctcaaactcctgacctcatgatccacttcagcctctcaaagtgctgggattacatgtgtgagccaccatgcccggctggtaagtaaggatataatggatatgcaacccgagtctacttcaacagagacatcagtggtatatttagaacccattaacaaatttaaatgatttatgtaaatacttacaaatattcacataagtttacacatatacattagagcagaaaaattctcagaaatcatgcatttttaaatttgtgatatacataaattgacaaaaattttcagcaataattaaaaatctttcccttgctcattacagtaaaatctaataatcatgaaaacttctattcttttaaaggagcagtgaaagaaataattttacaggcccaaaaagaaaagtccctggagtccctgcttcacaaatactactgcattatatccttacatataaccttcatctttaacctagcaaatagcatactcgggagattgctgcataatgcccatgctgacaatgatagtgatttgaaatcatgtagtttggggtttaaagaaacttggagatagtacaaggcaatccccctcatctgccagctgagtacactgataattgagtgacttccctgcaaggaccaagagtccttggtggagtccttcattaaatctttatttggtccagaagaaaagattcccctactaagatatctcttctgtattattcagaaaaaaagcaattctgaaactttttgttgttaggatccctttattgctttaaaattactgaggactccaaagagattttgttaatataagtctattaacattttctgcaatagaaattaaaactgaggaaatttttaaatatttattaattcactaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcaaactcggcgcactgcaagctctgcctcccgggttcacaccattctcctgcctcagcctcccaagtagctgggactacaggcacccgtcatcacacccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctctttaaatgtctggcttaatacaagaccactgggttttcccatctacttttgcattcaattttttgcaatacattgttctggttgaaggatatgaagaaatctggcctcacacagatacagtatatgcagttggaagtttcaaatcttaagtttttttatgtttgtttgtttgtttttgagacagggtctcactctgtcacccaggctagagtgcagtggcatgaacatggctcactgcagtcctgaccttccgggctcaagagatcctctcacctcagcctcctgagcagctgggaccacaggcacacaccaccattcctggctaatgttttagtttttcgtagagacacggtctcgctgtgttgaccagcctggtctcaaactcctgggctcaaacaatcttcccacctcaccccgtgaaagtactggaatttacaagtgtgagccaccacacccagccaaatcttaagtctttttatatacttgtggttatttcttctttactattacacctaaactcaacaaataatcatttcttaagtttagttgcaaggtagcatctgaattacataataaatttttcatactccgtaacattaaaatcctttgctttccccaaaatactgcgtaatttcaaagtgaaaaatagtacctttacaccagagaattctggcagacatcactctagccaagtgaccaagattaacgtcactagtaataattcctatcaacataacatatcctcgatttgatgccctgaaaagaggacatcacctctatggtattcttccaaatgacacataacctcaatgtaatcctgagagaatgtcaggaaaaaaattaattgagggacattctccagtagttcccaaagcgtcaaggtcattgaaagaccagggaactgtcagcctggaggaggctaaggagacaaggcgactaaatgcaatgtgagatcctgggttggattctggaccagaaaaagaacattagtagaaaaactggtgaaatcctaataaatattatactttagttaataatattgtaacaagattaatttcttagttttgatcattgtactttggttatgtaagatgtcctcataaggtaaagctgagtgataagcctaaagaaacgctgtactacttatgcaacccttctgtcagtcaaaaattatctcaaaataaaaagtttttaaaaatcacttgctctggccaggcacggtggctcacgcctgtaatcccagcactttgggaggctcaggcaggtggatcacctgaggtcaagagttccagaccagcctggccaacatgatgaaatcccatctctactttaaaaaaaaaaaaaaatacaaaaattaactgggtatggtggcgtgcacctgaagtcccagcttcctgggagcctgaggcaggagaatcacttgagcctgggaggcagagtttgcagtgagccgagaccatgccactgcattccagcctgggcaacagagcaagactctgtcaaaaaaaaaaaaaaaatcaattgttctatcttgtactctcaagatgtggaatattttaccaatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcattggtcatctgaaaaataatggtttactgccaaataagacatatttcattatataatattttaaaaatcacatttgttaatatctcaactgatttcatcagaaaagtatttaaccattgagaaactgtcataatcatggtaatggatgtaagttttccaaaattttaacttgtgtgaaaaacgaaattttattattggcaacaaatactgttgttttccttgaactaacaggttcactttgttcattttcttttttttttttgaaatggagtttcactcttgttgcccaggctggagtgcaatggcaccatctcagttcactgcaacctccacctccagggttcaagcaattctcctgcctcagcctcctgagtagctgagactacaggtgcatgccaccacacccagctaatttttgtatttttagtagagactgggtttcaccatgttggccaggctggtcttgaactccggacctcaggtgatcggcccaccttggcctcccaaagtgctgggattacaggtgtgagcccccgcgcccggctcactttgttcattttcaaaaatgtctgccaaatactgaagtctggataaccatcagttgtctgtcagtcactctttcacatcaaatggtgttccatgaaaaacagaccagatcagctcacaactcaaacaactgcacagtgcttttcctcaagaaaatcattgtactttggaatgcagaaatgcaacatacgtacctcccattttaccatatagaataaggaaaaaacatgtatctgagggtaacaacactcttaaaggaaagtggcagatgttttactgcaagtgtgtgccagtgaagtactgccttcattcctgctgagtcaccagcagttttatccaatattgctcttatacaattagagcagtgttaacccaatcttggaattattataaaaatagttggccaggcgcagtggcttacacctgtaatcccagcactttgggaggccaaggcgggcagatcacgaggtcaggagttcaagaccagcctgaccaacatggtgaaaccccatctctgctaaaaatacaaaaaattagccaggagtggtggtgtgggcctgtaatcccagctactcaggaggttgaggcaggagaatcacttgaacctgggaggcgaaggttgctgtgagctgagatcacgccactgcactccagcctgggcaacagagcaagactccatctcaaaaaaaaaaaaaaaaaaaagtagttttaggccaggtggagtggctcacacctgtaatcacaacactttgggaggcaggtggattgcttgagttcaggagttcgagaccagcctgggcaacagagcaaaaccccgtctctaccaaaaaatacaaaaaattagccaagcatggtggtgtgcacctgtggccccagctacttgagaggctaaggtaagaggatcacttgagactgggagccgaaggttgcagtcagccaagaaatgtgcccctgcactccagcctgggtgacagagcaagactctgccaaaaaaaaaaagaaagaaagaaagaaaagaaaaaagaaaaagctgcaccagagcaaaagcaaaactaacttgactctcacggagcttacattttagtgggggaagataaataataaacataagtaaattacaagcagcttttgaggtgagaagtgctacgaggaaaaacagagcaagataagaaggaataggagtttctgtggttagagagggattacaattttaagtagggtggttagactgggactgagcctagaggtaccatatagatgaggaaaactaccaatacacagcctcaatccacttcacttgggttctcctgtcccccactggtcctgatcctcagcaccgccaccgttcttgagcattcatctttaccctgtaacttccagttaaagaccaagtcactgcctcaaaagaaaacaaggtcttttccatccaggtgctcagttcaaatccacctggctcagccaacagctcctcagccatctcccaaggacattccccaacctgctttttctccattgggagcacaaagctaaacagcaaatgcattctgcccataataaggttgttctagctctctctccccctcttttcctacacatatatattgtctaaataaagattaactttttgaagacctaactactatgtgccataaacttctggctgctttacaagtattttatcctcatcaaatcaaaggaataggtataattagcagtattgtatagataaggcaacaaaagctctgcaaaccacaaaactgggactcaaatctccaaaacaaaacaaaacaaaaagttggggggcagggagagcacttcttatccacaccctctcccaactccatcactcccattgtaccactgtggtatttccactgtactgctctaagtaaaacttacggaaaataaagaaactgggcatcaataaagtctgtttaacagcaacattatatttcaggatcagatctaatttttgtaccaaaaatatgcctgaataatagaactgcaacttaaaagactgattaaatatgtccaccatgtgttacggactgaatgtgtacccccctaaaatttgtatgttaaaatcctaaccccagtgtgatggtattgggagatggggcacgctaacaggtggagcaattaggtcatgaggacagcgctctcatgaatggtatgagtgtcttaaaagagactccagagaactctctagtttgtctttttgaggactgtatccatgtgaggatacaatgaaaagtcatcagtctgcaatttggaaaaggccctttccagaacctaaccatgctggcatcttgatcacagacttacagcctccagcactgtgagaaaaatacatttctgttgtttataagacatacaatctatgtgtgacttatatgtgactttgttatagcagtccaaactaggtaagtactatggtaacattttcaaagaatactatttccagtagtttcattcataataaacgtgatcctctggtttatatgcattatctcatttataatcctcacaagaacacaactgagacaggaactactgatacttcaattttacaaatgaggacactgagcctgtggtcacacagcctatgatctggacctgaacctgtgtgcctgaatccaaaacccaaggtcacaactagtgcacgatcctgactctctgacctttcatatgtctctgtcaagaccactcttgacactgtggtggagaattactttccctaaataaaggtgcagcaacccaacaaagttactcttcatcttgataaagccctcaggtattacccacattcagagggtaaaatctctacaaaatccttttgttacaagtccaaaatgaaagttcactggagtgactctgttccagcgaaactctgctgggaaagcccaacggcctgatggaaaggcacaacatccaatctttgggttccaagactgcctctaactctgacatttagtccaaaggaacaaggatattcattttactacatctcttgctcagcaacactagccttcagccttaaagaacatatctcacagtacacactgagctttgagttcctacaacttagagcaaaggcagccaggccgataactcactttagcaatagccttagttacacacccctgagctcactctccaggaaagtcagagggagtatcagttttcatcattattaatgaagagtagattgaagaggatagcattacagctctaaaacagaggttcttaaacataattctaataagacagacatgatgaatcttgttcacatttggacacactagagtcttcaaaagaaactagtgaaaactacaaaagcagtgctgaaagaaattaaggaaaacctaaacaaatgaatgggtgtaccatgttcatgaatagcaaaacagatactacaggcaacaaattatgagcacttttcattctatcacttgtaatcctaacttctctttctccctttgaaatatttttaaatgcaaataaccatacttattttagaataaccttgaatttagttttatctttttgaggaaaatcatttaaagtcttcaatttaactatcagttgtaatgttattcatgatatctcacaacctaactgggatatacaagtaggtcttgttatacagaattacctctccaaaataaaagcataatgagaccttttaaccataataaagcagcaaagaaaaatcatagtcttttgtcagtacaaaggctttcataattcctcatagctctcagatctgtgtttctatcaactcaaaaagttggctgggagtcatatgacagaaagggttaaaaatactaagctgctactctagacctgctggctgaggagcaggcaggttgcccagggtttcaggatagcccgcctcacacagagtaaacgtaggggatgctgtacacccaggaataaattcctcaaccagtgcatactctcctgaggcattcttgtaagctttttccaagttgagtaataaacagaaataatagatttttgggggcctttcctgagttcagggagatctgacaacatcacgaaatgtttcggcacagtcctctgaaatttttcattagaattcttttcttctgaatcatgttaataaagtaagatttggtctgggatttgtacataagtacttactcacatgttgctcaagcccaaaaggacaagaaaaagacgctgaggcctgtcaacaggaggcagggccaggctcaggaactggaagattactggatggatgttttcaaacagagctacacacagctcccttatataacactcaattggcttttagataagtctgaaatatccttctatactttgatcttcagctgtctccgttgccttcagagtcaacagaaactggcacttggctccaaaagcctcaaatctctctcatctataagggacagggacttctattatttgtctacaatttgtcaagctgagttaattataggtgttatcattctatatgtcaaatgtagcaaaataatgcaaacctgtttacctgtttcttcctttcctgcatgtagtataccctgaccttaaattggcatgcacttgatttcaaatgaagatttttttaaacagcatcttccaactgcagtagcagttggaaaattcactttttgctgacctgggccacctaaacagaggacatgaggaacctgacttgttttattttaagaagaaaaaactatttaaagccctgatcctggctcctttgaacatttaacacttaaaacctgaattgttacactacaaactagagttccttttcctctatttaagaagaggcccttgcgaagaatttatttagttaatgaaagttaaacaattgtgtttctctcacaaaacaaaaataaacaaaacctcttgaagatggtctctgggctctctaggtctgcaagtgtccatatgagctccctcacggagagcctagagcagtacactggcagtttagaaaacaatatagccacaagcacttctccaaaaagaaaagcaactcccctcttggcccaattccaaaacgcaattgagccgggtaaggtccaagctaatctctgtaccgtctctctgccaactttctcctgcaggcattaggtttttcagcatgggctttgcaaataatctaacaattaattagtgcttttgaattcaccccataccattaatggaacactgccagacagcctttgatagggtatttctagagctaattaagcttggcaaaacagaggacacaaacttcctggcactcacaagggccaggctgagacctggcaggtgacagacagtaaagttgtccttacagataatcctggggtgatgaaaatggcaggctgcttggatcaggctctcggagtcctctataatatgccagaccctactctcaaattatataactatcaggcttttcgcatttgagctattctttcaccctgaagacattttttttcttctgagtgaagatttgatacttaaaagtttggtattgcttctagtccacaccccatcctgtcacccccgaaaagggttagtttagaaaaaaacaaaaagttgtatactaggtttttttttactatatcttaaaataaatctcatctcaaaatgtccttcttccaatcaaagagtccttgcataatccaagatttctcactcctataacctcagtcacgtgggaaatctatttttttcactatctaatgtcacacagaattccagactgctccacatgcatggacagcaacataaacacatttttgggagggctagaaaaaagctagcaggggggcaaaaagaaaaaatattgttacattcctcaggacttttctggttcaatttcaaaagcagaatgaccaccacctgagtcttgcggcgagctccagagctgtacataggttgtacgctgcctctccaaaaacagtgatgaggccagagaaagcaaatcagaaaaccttataaactactcaatggcagtgtaaacaaataaaagttagtttaaaacacaacttttcaggcacagagcttaaatattctcagtcttatccccacttataataaatgtggtgtcagggtgcttaataaacatcaattacaacttacagaaatttttcccttctaaaaaatgttaattttttaaaagctctagactggagtgtgattataagaataaagtagggccgggcgcggtggctcatgcctgtaatcccagcactttgggaggatgaggcaggcagatcacctgaggttgggagttcgagaccagcctgagcaacatggagaaaccccattcctactaaaaatacaaaattagccaggcgtggtagtgcatgcctgtaatcccagctactcgggaggctgaggcaggagaatcgcttgaacccagtaggcggaggttgcagtgagccgagatcacgccattgcactccagcctgggcaacaagagcaaaactccatctcaaaaaaaaaaaaaaaaaaagaataaagtaggaagtcaatggggaaacctgagctagaaaattagagccctgctagcagaaatgaggtatacccaacttttaacttttagtccctaactccagagccaccctcgctaacccacctaaagtcccccttttatccactcagcccatatcacctctcattaccgaagagtcccttggccacaggttccgggaccaatgaccccgccctcagtgacccaacacgaatctcctaccttggtctactaagtcacaaggcaagaaatgagacaaggcaaaagaggcacataaaaggaagaaatggtgggggcgggaagaattccttctttaacaactgttaggattatgtcaaggtgtagccccagctaataaagatgcacctggtttctgcaggtgcaccacacttacagtcagagagctaaaggcatctgtggaactcactgcctcaaaccaacttcctctccagcacatggatccctctgacccaaacaagtttaccaaaggtgttcaaggtagctgttgtaaaggcatgctaaaatcaagctcccttttatggcactaagaaattgtctaggtgtttgcagtttctgtgttacaatttgtgcattgagaaaacagatgacctatgctgtcaaatgtggtcctcagactaacggtatcagcatcttatgagcctgttaaaaatctacagtctttgacccatcaaggcctactaaaacagaatctgcattttaacaagatccctgggtgattctcatgcatataagaaagcactggcctaatatttgtttataacctcaaactccaaaagcaaaacttcctattccataaacaagatggtatattccacctctggcaaaaccactcacctctggcaaaaccactatgaatatccttattataaaatatatttaaaagtgattattttctttatagaaaaaaatctgttgtatcatgctccttgctcacatttaatatgtagtttaacttataaaaataggttgacctacaactcagaaacatttactatgtaaaactggatgcaactgtatttcttcgaaactgtaatttacaacactgtaagaagcacttctgcaaaaggtggtaagaccctcaaaactcatgatcctgaaaaccaggccccctgagaaatgaaaagaacaagacttggaaatcaggagggtaagtaagcaaggaaaagagggtttaggctattaagacgatgatttttcaaggacattcattcacaacacaaagagattttctttagatggtttggggaggttgttttgtgttttaagactcagctttttcagttctatagatgtaattatctttaatattaggctatggcacagtattccactgatgtgagaaatacatctttatccactttcctcctcaaaaggaataggttggggaaaaattacaaaagcatcattctgaatttcctaagcatatgactcccaagggtccttccttctaataaggagtcctggtcatcattttctcttgccagtatctccaaatccacctttgcccaacagcctattctcagcccagcagccagagtggtcctgttaagacatccttcagatcatatcattcttctgctcaaactctccaatggctcagtgtcattcagagtgagaaccttatgatggcctgcaatgccttgggctatacacacccgcaccgtctcccacccctcagttaactctctgacttcccattccagcaggcacctggcccacctgctattgcctgagcactgcaagcaaacttccaccacagggcctctgcacttgcttttcctgctgcctggaatgctctttccccagatatccacttagctcacctcctccaaacctttgctcaatgttcctagtgaagcccttcctaatcaccttacttcaaattgcaatccccgctaacaatccccaacctctttgctttttattcgacgaacctgctgatatatgcattttgtttgtttctggtctctctccactagagacatgcttcataaggacaaggatttttatctgttttgtttactactatctctccaacacttggaatagtgtctgaaatacaataggtactcagtaaatccttgttaaatcaatcaatcaacactttaggaaagttaactgtattagaaaaaaatgaaaaggccagcgaggtggctcacgcctgtaatcccagcactttgggaggccgaggcgggccgatcacgaggtcaggagattgagaccatcctggctaacacggtgaaaccccgtctctgctaaaaatacaaaaaattagccgggcatggtggcgggtgcctgtagtcccagctactcgggaggctgaggcaggagaatgcatgaacctgggaggcagagcttgcagtgagctgagatcgcgtcactgcactccagcctgggcaacagagcaagactccatctcaaaaaaaaaaaaaaaaaaaaaaaagaaagaaaaagaaaaaaatgaaaaaactcattatttgcactaaccccaaagtctctcccctttctgtgcctcagaagctagcaaagtacctgaatcttaggaggtacttaacgttgaccagactacaagtcttcatctaaaacatagtagttatttaaaagtataaagaaaaggcaaaataagtggttctgtcctctaattaactcaaaaggaaaagataagggcgggcaggagctatagagcattttgcttcaccatgtagtattataactttaactttcagcaatttaacaacataattgtcatgcacaggtgcatcccactggaaaagttcatcacaggaaaatgctgtagcagtccagcggggtcaatgatgaaaacaacacagcagggaggccaggcgtggtggctcacgcctgtaatcctggcactttgggaggctaaggtgggcagatcacttgaggccagaagtttgagaccagcctaggcaacacagtgagatgtcatctctataaaagatcacaaaattagccaggtgtggtgccacgtgcctgtagtcccacctacataggaggctgaggcaggaagatctcttgagcctgggaggttgaggctgcagtgagccaagactgcactactgcactccagcctgggtgacagagcaagaccctgtctcaaaaaaaaaaaaaaaaaaaaaaaaaatgcagagcaggggctgactccagaggctgaacctctgccctcctttgaggcctatgctacctgtgtatcctcatgggtggagtaggagagtaggaaggaagggaggtgttactcagatggccctggtcaatcttctggactaggacgcagttactcaggcatatgaggacaaaaggaagcaaaacaaagaacacagagcaattttatcaagaccttttccttttgccatatatggttcccctcattgccaacaaacagagtaactttaaaataattttttaaatcaacatttccctttgaaggtagtaaaattttccacattacactgtagatttttttaaagatgtttaagagctggcaagggagggcaggggaatagctgggcttcagtccccagagcacctgctgcctactccttggaaggaacgttccaagagctatggcatttttcagccctctagaattccacctgattgacagtgccctctcagaaaacaaaaatatgactagattgaagttcaggataaatgttttttaggccattctggcagagatcgttttaaagaaaatgaaagtcagtggctgccatggatgtggtgcgggatgggccaatcatgcgcctcggtgctgagcagggtcagtcctaaaggaaggcctcttgctggcacgcttcccggaacacttcccagaacactccctgctcctacatcacttccaaaatcagcgtgctcagagctcgaagctctatggggtgataaagatacctccagagttggattaattaccaaagcaaacaagctgagaaagtctaatttcctatatacacaaccgtgtgcaagggtaagcttttagcaattaaagagctgtgtaggcacatacagataaagctgtgtcttgatggaagtgttgatcactgtaaaacacaccatcactgctgtcctaaaataacccaaatcaatcagaaatccagaaagctgggtggcaattatacagcctacgataaggatgcaaagcaaagagaaacctcgattctcttgacttggctaacatcacatctagcaataatcttactcattcttggtaaacatcctcccctccactatatgcacattcagttgcccaactagctattagtaaactctccttgaaaatgataaaaagggccaggtacagtggctcacgcctgtaatcctagcactttgggaggccaaggcaggtggattgcttagctcaagagtttgagaccagcttggaaaacatggcgaaaccttgtctctacaaaaaatacaaaacttagccaggtgtggtggcatgtgcctgtagttccagctactcaagaggctgaggtgggaggatcgtttgagcccaggaggccaaggctgcagtgagctaccgtgccactgcactccagcctgggcaacagagtgagaccctgtctcagggaaaaaaaaaaagtaaaaggccttgcattaggctatccaccccacctccacacacacacaggtccatacagggcaagggaatctttgagaaatgaactcacctttctctcaactactgcctcaactcccgtgtgtgtgtatgtgtgtgtgtgcgcatgcatgtgtgtgttgtgtttgcacacgcatgcacgcacatgctgtttctgtagaaaaatctaatggagaaggtaggtggggaggtgcttcatcacacttggctgtgcacaatatcctcaaagggaatacactctaaaatgcaggctaccctatccactctgggtctttcttttatttttgagacctagtttcgctcttgttgcccaggctggagtgcagtggcgccatctcggctcaccgcaacctccgcctcccaggttcaagtggttctcctgcctcagcctctcgagtagctgggattacaggcagccaccaccatgccactctaggtcttttaatagcagttatttgctctttaaaataaagtttggcactctggtgataactggtatcacatttgacaatatcctttccttgtgtatcaaaaagcagaattaaacacaaaactggttaaaataaccagctaaaggccaggcatgatggctcacacctataatcctagcactttgggaggccgatatgggtggaccacttgagctcaagagttccaaaccagcctgggcaacatggcggaaccccatctctacagaaaaaaaacacaaaaattagccaggcatagcggcgtgcacccgtagtcccagctacttgggggtctgtggggggaaaatggcttgaacctgggaggtcgaggctgcagtgagccatgatcgcgccactgcactccagcccaggcaacagagtgagaccctgtctcaaaaaaacaaataaaataaaaataagataaaataatcagctaaaaacaataataatcacagaccaaatcaactagctgtgttctaagacctgagggttggcaaaaaaaaaaaaaaaaaaaaaaagaagaagaagaaaaaaaggggagggggctttttttcagtttgctttgaacctttgagcctatccatcttctatccttacattccctggtggtagtcccctgccagcaccctccagccttcctgcccttatgagtattacagcctttgatcactcgtttggcagacaggagataactatggcagaaccacctctgaggttcacaggccgttaactcacatccaagatttctctttcaagtacaggataaatgaataaattgaataatgaaaatgtggtatatatacacagtggaatactatacagccttaaaaaagaaggaaatcctgtcatttgcaacaacacagatgaacatggaggacattatgctcagagaaataagccaggcacagagcgacaaatatcatatatgatcaaacttatatgcggaatcttaaaaagccaaactcatggccgggagcggtggctcaggcctgtaatcccagaacttttggaggccaaggcgggcagatcacaaggtcaggagttcgagaccagcgtggccaatatggtgaaaccccatctctactaaaaataacaaaaattggccaggtgtggcggcgcatgcctgtagtcccagtcaggaggccaaggcaggagaatcactcgaacccgggaggcggaggttgcagtgagctgagatcatgctactgcactccagcctgggtgacacagtgagactccatcccaccccctcccagaaaaaaagtcaaactcatagaaacagtaaaatggtggttaccagaggctggggagtgggggtggaaggactgaggagatgttggtcaaatatacaaaatttcaattagacaggaggaataagttcaagagattgactgtacaccatggtgactatagttaataacaaggtattatagtagccactgccaccactgagcctaagatggccatgacccctgtagaggtgacccccactcacctacccctctaggactcatgccttcctcaaaaatgcctgggccatggagctggtgccagtcatgtccttcaccatgggggccaatactcagcccctaccaagtacaacatcatgaccaaccaggtgacgccctgaaactatctagtgcccttccaaggtggtaggaacatgctgacatacagagccacctccaggacccccagtgcccagcttggagctgccaaagaaactgtgaccacctcactcgacagtgaggaggcccccttcctacagccccctataaaaatgtgaaaaaaaataatatattttacacatgaaaattgttaagagagtatattttaagtgttctcaccacaaaaaatgataagtgtgtgaggttatgcatatgttaaaaagcttgatttactcaccacaatgtagacatgtataaaaacatcatgatgtacaccataaatatatacaatttttatttgtcaagaggtgctaagggtgcactataccaaaaaggtcacaggatttgttggtgcagtttgtctgcaaaagcatgtctaagttctggtccaaccaagacttgaattatctttctaaatcacttactttctctaagccctattattctcattctagaaatgaagaaaatagtgcctgcctacccccagaggctgctgtgaggatcaaatgaaatacctgttataaaaacatttttaagattacaaatacaatatggtattattagcctctactcaaggctgccagcttgtaccattccagaccaagtattaaccagctggtatctcagcttgctctcccacagacacaaagagttcagagctttctgagcaggaaaatagctcagactaaaagcatctcgattttcctgtggactctacctggaattccaggtacatccagtagagaggaaaagaaatgtgtttctcaatagaaatctgtgcacagtttgcaggcgagtttccaaaaggatacatctgggtactgaattgagacagtggaatgaagaagttagccattccaccaagagcccactggcatcaatgccagcagccctgctccagagctcacctcagcggcacccctctcacctggcacaaggggccagtgataactccagcccttccaataaaactgatttccctgaattctccatgcatgcctctttttcttattactaaaactcctggaaacatagccctgcctaatgttggcaagcctcagaggcagcagctaatatcttttaaagatgtgtagaacagttgggaggttgttttgtttttgtttttgtttttgccttttcaagtttttatttttatccattttttgtattaaaaagaaaagcacaattatcacaaattacaaaggaggaaagcagaactagaataataaatgaatcacttcagcctggaaagcagatattttcaataatagtaatgttataacacaagtatagacgagtttttaaag

SEQ ID NO: 352 - DNA, 314646 bp, Homo sapiens
ctctgtgagtgtaaaattgctagattaaaagccagtgtgcatggtcaagatactagatcaataggtacaacacaaacagaaaaaaatacaatgtaagtcaaactcatctatgtcttacagagaacaacaaatcaaattagttccttcaggaatatcacacaatactatttcttggtatttctctagcatttctttcctgataaattcagagcaacttacaaataaatattggactcaatcttatagtgtaattctgttaataaaacattctccatcctggagagtaagcactcacctattattgattagttacttctaataccagcagaactttgagatctctggaggagatactttgcttcatataaatcacattattataactaaatctttagcttccaacagtctgcttatcttcttggaagaggcaacttaacttccagacctagttactatgtttacagtattataccgaagaaccaatcccaggatttctctaatttccaactgtctaccctaaggcagaataaattttaatcccatttcaaagacaaaaaaaatgcaaagagaagaaaattattaggcccaagtcatataccagtgcctgagtcagagagattttctggtagagaaaatactgtcacgtcttaacacataccaataaaaggttgctattgttgttttaaccccaaacttccttgatgaaaagtatacaaaaaaactcaaagttcaggctgacattttattaactttgttcaaagaccctctaatattccacagtcccccaaaataaaaagacttatttcttatactgtgatattccaaatacattgctcatcaatccctaaagcacattacttaaccctaattcctatataacactaataaggggaaatcattgaataatatttgagtttttgaaatcaatgaataatatttgtccactcaataagcatttgttatacaccttgctgccaagctttatgctcaagtctcactcttgcacaataggatcattttttagtctaccaaatattagtactctttattagtactaccaagtataccaatgtgaaagaagctcctgtcctctccctcgtctccacaatcattttcaattcctgcatgtggtttcataagtaattatcttcttcttaatagtatgcatgtttattcatttcttaatttttttttattattatactttaagttttagggtacatgtgcacaatgtgcaggttagttacatatgtatacatgtgccatgctggtgcgctgcacccactaactcgtcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatttcttaatttttaaaaaactgtattatcttttgactacctacaatggaaaaaagattgatgtctctattactaccttcaccccaatcccaacttcctctcatagtacagccccatcgtcattctcttacaacttttttttttttaacattcaatgtggtaggagagggatctagaaatcctgtagctcctcattcaagtttctaattcatcctcctgttttcaactctaggcttcaaaggtaccaggtgcctctgattcctcaacttaaccaacttctctgtcttactgcttctttcagatgagtactggctttccctgctccactaaatcagttaccactgaccatctagttccagatttaaaattttggcttatatctttgctgcagtctactagtctgttcttttgctcttgttggcttatggctttttaaaaaaattcctgtatttttagtggtatatggggagagagtgataaaacataagcaaatgaaatgcttttgatatgcaatgtttaaccagaaaaccttaatattttcaaatacaagttttaccagaattgtattatttgatcctaacaacaattgcaaaggtaggcaggcaaacaaagtattatgtgataaatgaatgagcaatatcatcctcaccttacagataaggaaatgggatcagagacacagttttagtaacttgtcaagagctaaatagcttattagtagcaaaataaagaccagggcttacattttctcgtatctaataatcttctgcaggatgcattcaaaataaatggttggaattaaggatatcctcacggtggctcatcataaagtatacacagtcatgtccagaactacaggacccattcacattcaaaagttttagcagaatatatataacctaagcacaaatctaaatccttcttgccaaaggatgctgattattttcactttcattaatcctatttctccaaggagcaacttctggtatctggcccattgtgagtttaatacaatgcattctgaacaaactaactctcattagttctggagtatgacacaaagacaaaaaaagtataaaatacatacatatatatatatgcatactatgacatgttactttaaaatttttaagataattttttcagacttggcaaaatgatcatgcaacttgtctgagaaaaaaaatacaatcacagccatacaaaaatactggaaaagaaaacaaaaaatgagaaagaaccagcttcatcaaacattgaaagatatcatatgagaacacatggatggggacaacacacactggggcctgttggagtggaggatgcagggggagggagagctaatggatgctgggcttattacctaggtactgggttgatctgtgcagcaaaccaccatggcacatgtttacctatgtaacaaacctgcacatcctgtacatgaatccctgagcttaaaagttgaagaaaataaaactatagtaattaaaacaatttgagtctaggaagagacatgatacatatggaaatgtagtttaccataaggttgtgctaaaccaatgcaggtgacagagtttcatgaatgatgatggactagccgactactgtaagaaagatcaaaactagacccttaatttcgattaaataaattttatagaagtctaagatttgagcctagaagatgggaatagaagttttcaaaggtggcacaggtgaatttatttataaacttggagtgaggaagttccagaagttagaaaaagaaaaagattaataaatttagctgcatgaaaattcaaacttttcatttggaaaaaataccataaaattaaaaaattaactgttaatgaatgtttaggatatgcataggctaattcaattttcatttattcattcattaaatatctgagtgtctattatgagccaggcttgcatctacatgataggctatagtagtgaacaagatagatgagatctttgctcctttagagtttatattctagagaaaggaaacccataaacaagtgagaaaaatatccaacaataatcccaggcagaggattaaaacacactgatgtgagattcagtggttcagtgactattttaggctgagactcaggaaatgtcccagaaagtgggtaaggacttcacataaaccaataaggaaaaaacaaccaaaaagaaaaagggccaagggataggaacaggcagttcacagataaactacaggttgcctgtcagttcaaaatggtcattatcttcactcaaaatcaaagaaatattaaaacgatgagataaagtgtttctattgtattgacgaaaatcagaaaagtttgacagaaaacactctggtatagcatctaaattagtgaaacctaatttagtttttggaagtcaatttagcaataagcatcaaaacgtaagacgtatacatctcttgcagaagtgttcaaagatgtatgtatatgaatattcacagttatattattgaaactgtaaaagttcagggaaacatgttaatgcccaccaacaaaacacttgtaccataagtgagaccatcagcgcaatggaatacaatggaacagttacaaagactaagatggatgttttgtaaggtagagcaggggcctatggagagatctctaagatacattaagtgataaaagataggttcagagccgttttcttaggacgcttctatataaatagaaaatatatacatacattcattttgacttttatatgctgatgtgtatccaaaacatttaatgaaaaactacacaagaaaatgttaactgtaattaacactgggtagcggcgcttgaagtgtgaatgggcaagaaaaggatgctttactatcttacatagtttttgttttttaacttctgaaccatgtgtatatattatttcctcataccatcagtaggaatttattatcagtgtgagaggccatttctgttttcttatgctttcctttatttaaaaatcccaataaatatgtaatttttaacacagagagatataaaagagcgaaacaccacacatgaagctaagaactgttagggaggaagaaaagacgggaagagagcaacatacatcatcctattacggaggcaaggaaaggggagaagagataaagaccaggagggaaacgcggacgggagctgatgaggcatcaccatgcaagaacattgctccagatggccgaagggaaggtgctggcatcgctgcactcaggattattatcctataactagcaaagcatatttactaaggagaggctggtttttcttccgtactaagaaggataatttcagctaattaatttgttctgctgaactgacagccaccgaggatgtgtctgcatgccttataagcatattcttggttcatttactgagatcccacagagaagttcaatatctagagttaagcaaataaaaaataagttgttcttgtttcaaggaccaagctcgggacatgaaaagcatcaaagtgctctaagcaggaggacaatgacatgcaacatctgaggcattgttaaggcctggcctactcaatgcatattgtcacacgccaaccattttccagatacctaggttcatgctaaaggtacagatatcagcacagctccaccctgaaataaatcacagtataatgaggcagacacacccagaaacaactctgacacagggcaaaaagaaatgagttgctaaacacaaaattaagctacatgacatgggaatacaaggaaggaatgcaaacaggagaagggtgttcaacactttgtgtttgtgcacatcttatcactgtgctatgcaaatctctacattcatacagagctgcatacaaacgagggtaggttggtgatatgataaacaaaataccatcctagagattgaaagtatggaacttcctacaaacattggccaagtggtatgtggtaaatgaggacaacactgcaaatagcgccactgcctgtggccacccgatgcagtgctcacccaggagggctgctctgctggggagctgcaggatggcaccaatagctctgcttcgagcccaggtcaataataagaagaggggttgccatttccagcaagaggttgcaaacatcatttctctgggctccaattgtctgatggtgccctgttctacagaagggtcaactatacaacagacaggtgtgtgtaaagctggatgcttaagaaatgtgacaaggttagagggaaaacatgctccaaagcaaagtttcagtgtggtaattgaagatgaacatggggtcattttaaaaccatgtctgaatcccaacagagcatgttccgacatggttcagcttgactgctttatgtaaacatgaaaatgccatcgcctggcaaaacaaacttctcccaggagagcctgttctctcaacacaacaagaggaaagggatagtggaagcaggagagttgagaccatgaagtcatgaagttcaagaatgccttcctttgaaggtttaatacagaaaagctttcgggggaaggaggagagtttaaagaagtcctggttctccggcatccacagtaatacctttgccttgaaggagaaagatggccttggctatcaagaatggggagaaaaggcagaagctaccacccaaaattttcagagcaccaaccaaatcaaaggaaataaatactaatgggtgaagtagagtttaaaaataacacaagtaatgtacactctccccttactattgtttttaatttttaattttttaattgacagtttgtacatatttataggatacaatttgatattttgatacatatgtatgttgtaaaatgatcaaatcagggcacttagtgtgtccatgatctcatgcatttatcatttatttgtagtgagaatattccaaagcctcttatctagctattttgtaaggtacactatcatcttactgtcaaccacagtcactccactgtataacagaacatcaaaacatattcctcttatctaattgtaactttgtatttgctgttgctagttctatcattttaacagagagagaaataaacttccagctacaacaatcatggaatcacagctctatgtctcccacctaaaaatatttcctacacaaaatgcaaggtagacgtaggtttcaaaacttatctgcactctattttatgatctttgttttcattttcatatatgtgagcatatttctattatgttattaaaatgtggtagtaattgctgcatggtatttattccaaactccaaaaccttcaaatcctgtatcactgaacaaactgtttcaaatttcccattaatcttatgttaaaaataaacaaccttgtacaaatatcttgtctgtatctctcattatttcctcagaataaatgtatacctttagatctaatatttttacttttaggaaactcttcagaatttgatgttgccaaagtgcctctcagtttatcctctcaccagtaatagtacttcagtgtttgtggtatatattgacgtctactagtggaagttctccttaccccaacaaatacacaaattattattcatatttttctaaagtttaaatttcattatttttctctcagttgaaatttagaaacagtattttcaaattacctcaaattccattgaaatttattactagaatttcattaaacttacaagtaaacttggatagaactatagttactgaaatattgagttttagcattcgggaacattagccatctctgctttattcgaattgacttttatgtataataaccaaaacagcgtggtactggcatacaaaccaatggaacagaatagagagtccaaaaatacatccacacatgcagagccaactgatttttggcaaaagggccaagaacataggggaaaggacagtctcctcaataaacagtagtgggaaaactgaatatccacatgcagaaggatgaaattaaacccttttctctcatcacatacaaaaaacaactcaatttgacagttttcacaaaaggcgttaaaaaataatcaactcaaaatggattaaagactttaaatgtaaaacctgaaactaggaaagtactagaagagaatatgggggaagctgggcacagtggttcatgcctgtaatccccaccctttgggaggccgaggcaggcagatcactgcaggctaggagtttgagaccagcctggccaatatggcaaagccccgtctctactgaaaatacaaaaattagccaggcacggtggcacacacctgtaatcccagatacttgggaggctgagtcatgagaattgtttgaatcccaaaggcagaggccgcagtgagccgagatggtgccactgcactccagcctgggtgacagagagactctgttatgaaaaaaaaaaaaaaaaaaaggaaaagaaaatgtagtggaaaagctccatgacattggtctgggcaaggattttttggataagactttaaaaggacaagcaacaaaagcaaaaacagacaaatgagattacatcaaactaaaaagcttctccacatcaaaggaaacaatcagcagactaaagagacaatctacagaatgggagaaaatatctgtaaactatacatctaatagggggtcagtatccaaaacacataaggtactcaaacaactcaatagcaagagaacaaataacctaatttttaaaattagcaaaaagggccaggcgcagtggctcatgcctataatcccagcactttgggaggcctaggcaggtggatcacctgaggtcaggagttcaagatcagcctgatcaacatggtgaaaccctgtctcgactaaaaatacaaaaaaaaaaaaaaaatagctgggtgtggtggtgggcgcctgtaatcccagctactcaggaggctgaggcaggagaatctcttgaaaacaagaggcagagtttgcagtgtgccaagatcatgccattgcactccagcctgggcaacaagagcgaaactccatctcaaaaataataacaatttaaaaaataggcaaaaggcctgtgtagctatttcttgaaagaaaacatgcaaatggccaacaggtatatgaaaaaatgctcaacatgactaaccatcaggaaaatgcaaactaaaaccacgatgagctattatctcacccccattacaaggctatcatcaaaaaggacaaaagataacaagcgatggcaagaatatggagaaaagggaacccttacacgctgcttgtggggggtgtaaattagtacagccattatgaaaagaggtgtaagttctctcaaaaaattaaaaatagaagtaccatatgatccagcaatcccactactgggtgtctatccaaaggaaataaaacaagtatgtcaaagagatatctgcacccccatgtttattgcagtactgttcacaatagccaagatatggaatcaacctaagtgtccatcaatggataaagaaaatgtgggatatacacacaatggaatattattccaccataaaaagaaggaaatcttgtcatttgcaacaacatggatgaacccagaggacattatgttaaatgaaataagccaggcacagaaagacaaataccacatgatatcatttatatatggactttaaaaagctgatctcatagaaatagagtagaatcatggttaccagaggctgggggggttaggaggaaatggtgaagtacagggagatattggtcaaaggatatgtaattacagttagatatagggaataaattcaagagatctattgtacagcaaggttaatgacagttgtaattaatgacaataaataatgatcatttattatattcttgaaaatgcaaagaatgttaagtgctctcaccacaaaaatagtaactgtgaggtaatgcatttgttaattagctagacttagccatttcacaatgtttatatacttcaaaatatcatattgaacattataaacacaaataatgttttctgtcaattaaaattggattttgtggattccaggaaagtttttaattttttttagttgttgaacaattatttatatagctgctttttgattagatctttttgtcccataacgtattttctaattaagttttgcttgtatttgagaaagttgttgattcttgtatatattttttaaccaaatctttttttttttttttttttttggaacagagtttcgctcttgttgcccagggtagggtgcaatggtgcagtcttggcttactgcaacctccggctcctgggttcaagtgatttgcatgcctcagcctcccgagtaactagaattacaggcacctgccaccacacctggctaagttttagtagagatggggtttcaccatgttggccaggctggtctcgaactcctgacctcaggtgatcctcctgcctcggcctcccaaagttctgggattacagaagtgagccaccgcgcctggtccaactctcttattaaactccatttgttctcattatttttcagttgattctcttagtttgcacaggcaaattgctcccatgcataaataacaacctacttccaataattagaaaagctcttttatttttagttttatcaagttggttaaaaaatatccaaaccttgttccattcagtaaaaacagggaatttttttttagttaaaaaaataagttttctatcaaataactttgagtagcatgaggttggaattcccagaataatactgggtaacaaccaagtttggtaggggttgcaaacatccttatgttgttcatagttttagtatttcaccactgaatataatgttggttattggtttagaagactacaagtatgttaagaaaatattatttttagttcactgaagtgttttttaattgatagtaaagattaaaatttatcaatgtctttttgtgtaactaaagagccaaatattcttgtcacatgacctatcctattgcagtgataagatataaaaagttttaatatatagctacttatctttgcattcctggaataaactctactttcctttggtaaattgctattaagagaaaaatttcatcagctagaattttccttcagatgttaatctctgtctttataagattggtctatctgtgagagagagagggagggagagagagagagtgtgtgtgtgtgtgtgtgtgcgcgcgcacgcgcgcacacgtgtgtgagtgtgcacatgcttcctttatcagattgtgacatcatggggatagtgaaataaacttctaaaatgtttcatcttttttcttactctgaaataatttgtaaagcatagggaaaaaaaatctgttccttgaaaatttgaaggaacttgcttctaaaattatccaagttcagcctcctgggggaagtaattctcagaaaacttcagaaatcacttgcattttcattggtctttatgagttttaattatgtgagtcattagagttatatattttcctagaaaatcattcacttaatccaaatttttaattcattagcatagcattgtttatagtaacataattttaaacttttccaaatctatggttctagtccctcatttctaatgccgtgtatttgcatttttactaatctcttcttgattagacttaccaaagatgtgtgcatttgttgaccttatcaaagaacaagctgttagatttttataacagctgtttcttagagttttattattaatttctgttcttatcttaattactttcttcaggatcatttattgtttttgttctaaattcgtagatcagatgcttaattcatttctttttttagtattgaatggattaaaatgttgtaattttgagtacagctttacatgacttccctataaaagtctctcactataattttgtatgtgttctataataataattttctctgtcacccaatagtttattttctgactttcagtattttactgattcttgtatatattttgactgtaaaatcaatgactttctaaatgactataaaaccaataaccatgcacaatcaataaatgcaatcagcttatcacatattttaagaagtttctgaaagagagaaaggagacaggttacattaccagggaaaaccaatgtgcaggataaattggagctaagtccacctgcttctgaaggagctccaggagggaatactgggacagtcatttagatgatcagttagaaaactgcactaagagcagcttggtggtgggttcttttccctcccacacttgcactacatagtaggcagcactatcatggcccataaggtaagaagtgaatgagagaggcatggctgggctcagggaaacagggcaacgtcccaagtacctactgactataagagaacacgagtctactccacacagaagacaagctcctacatacctcattcagcagcatatccaaatacatataagaataatcaaacatttgagaaagaattccatgggagataaagattaaaatggaaagaaaaaaacagttaatatggtaaatagaaaacttatgtttgtatagttacaaatatacaaacattaaataagatgagatgagaaagaatattgcacttacaaagcagaacactgctacttaccaaatcagcaatcttggtaaataaacatattcaatatgtgccaaataagcagaatgaaaagtcaagaaaaaatttagtgagcaggatgatctagctaaagctttcatccagaatccaattaaaaaaaaaaggccaaagggataagaagtacaagaaaacaatgaagttatatacagaacagatctgaaatgtccaaagtccatttgatagatgtcccagaaatggagagcaaagacaataagggtaaagagacataaaagaaaattaggaagaaaaaaggaaaagtgaagagagacatgtattttcagattaaaagagacaaccaaaggctatgcaagattagaaacaaaaatagaaacactgtgaaatttcttatagtacaggaagggggagtggagagaagaaaaaaaacagtaaataaataaaacagagaattcagtgtcagtaaaaaaaaagaaaactaataaaaagtaaatcatgcagtaagaatacaaatacatgcaaatatgctactaatcataataaatgagaacacatcaaatctacccattaagagattctgaaactaggtaaaaggaaaaccagacatttctttccactcaaaatctactttaaacaatgacacagagatgttaaaattaaatgattaaagaaatgtcatgtaaatactaaccaaaaaaaactggtagaggaattactagaatcagacaagatagtcaaaaaagaaatcaagctaaaaaatcattaaatacaaaaagtagtatacttcatattgataaaatctatcctaaaatgtaggcttcccttagtctcattggtcaaaactgtatcacatgtccacagagaaaccaatcacagtcaaggagaatggaattctcatgaagagttagaccactttgggaataaatccctggagctggggtagcacctgccttttctgaaacacagttcatgcaaagtaggatggatacttgaagaaaaatcagagctgtagagaagcaggcaatcaaaaatatttgacacatcactctgaaattatcacaacgcctaatttatttccttgcagcattagtattatggtttggctctgtgtccccagccaaacctcatgttgaattgtaatccccaatcttggggaagggacatgatgcaaggtgattagattgtggaggcggattgcctccctgctgttctcatgacagtgagttctcaggaaatatggttgtttaaaagtatatagcacatccccctttgctctctctcctgttggccatgtgaagatgtgcttgcttcccctttggcttctaccacgattctaagtttcctgaggcctccccagccatgttttctgtatagcctgtagaactgtgagccaattaaacctcttttctttataaattacccagtctcagatagttatttatagtaatgagataactgactaatacaattagttactacagattactacaaggtgatgaatcactataaaatttaaaagtataatgttgtatttctaagtctccttttaattgtttactcctcccttaaaatgtaaacttctggagagctggaaccttgtctatcctgatcttaattatagcttcatcaacttgcacaaggctcagtatataataggaactcaatacatgtttgccaatagaatgaatgaatgagtgctgggagagattactctgagacagatcaaccagaataatacagttaaaaaaaaaaataaaagccagagaaggaaagctttaaagtggtgttagtgttacagagttcagggagaagataggaattacaaaaagaccaccaaactgtatgttcagaagggattttacatttaggaagcaatttcagtgacagcatttgtgaatataaaccagatcataaggaattaaggatgaggtgggtaataaagaagtggttacagtaaaattacctttgtctttttttaaatttgctagaagcagaaaaggtaatatctctgaggatagcaaaatcaaggaaggggttagctggtttattttagaatggtaagatgagatgagaagttcacgtgtgctctatcatcttcttcatgacctactgtcaccaactgtggcatatttctgacaaaaaaaggaagcatccaatggagaagaatgtattgaagatatagaaaaaagaggaattacaaataagtttctagaagaaggaagtgaatcacaggtaaaatatttagagtttaaacttgaggaggctccttttgtccccagagccaagagtaattaaaaatgtgaaagtcagagagacacatagaacaaaacttatgtgctgtcacctaaacttaacctagattatttacctaagaattattccatagtaggtatccaataaatatttgcggaatgaatggaataaacaaacacataaatggatgcaatgattaaaatgtgttgtgttttgtatctttttacagtaaacatgatcctcctgttttcttaaggtaaatcattcaagtgataaggaatgaaaggttctacaaataaagaaatgcctttggccaggtgcggtggctcatgcctgtaatcccagcactttgggaggccaaggcaggtggatcatttgaggtcaggagttcgagaccagcctggccaacatggtgaaaccccatctctactaaaaatacaaaaattagctgggtgatagtggcatgcacctgtaatcccagctacttgggggctgaggcaggagaatcacttgagcctgggaggcggaggttgcagtgagccaagatcatgccactgcactccaatatgggtgacagagtgagacctggtctcaaaaaaagagaaatgccttcaatgaacgtttcccaacaacaacacgtcaggcaaaaaaagagagaagcaaaagtaaggtagaatagatggataagtatccttgtgtagtctactgttactgaaatccctaaggatggaattatttgtatattaaagctattaattttactgaaagctacagtaagttaaacgaaataatttatgtaaaaggatatataataaaaatatgttcaatcagtaaccagaaaatatgtgtatatcaatatttatctaagtctagaataaaaacaagattaagaaataaaaagtttaattttcactgtttaaaataactgctcaacctgaaaattaaatcccagatctagtatcctaatttgttaagcattctgtttgtcaaatgttctacttttaacagtttttatgttccaaatatatatgtcaaacttttaaaaacactatttaaaatccactagaagttatttaaaaataaatcatatctacaactgactttgcaacattcaccttagtatgctaagtacctcacaattttatgttaagttaaaagctcatagaagcaaatgaacacttttacgtcatttagcagacatcattaaaagtacaacatgactatgtaccagatttagcttctacttgttaactactagaatcttaccataacattgcctatttgattgtagatttcaagattaggatcttgccaagacaaaaagatatttatttaaaaaaaaaaaaaacactaagggataaaaatgtttcatgattcgtctttcttacacaggagctaaataagtaaatttacaactcgcatgatttctttcaatgatttaatgacaacctatggtgcccaaaacagcctagggacacatttataccatatgctgggcgaaactatgaatgagaaaggggttccacactgttgggaagaagatagcactcaaaagggtcaaattatagcaacactaatgaatacaaatagttcatttttcaatggaatttttacacacaattgttgtaataaattaccttgttggggaaagacaaagaaaacataaattaaaccaaatcaaggaaatcaaaatgggagttagaattctagttaattatagaactgaatatacagatttgagaaatgttctataagaaatagtgacaggatttgtcaaccactagtatgacaagaggaaaagttggaaaataataatgatgggaaagataaatcatttagttagctggagccccaccccactcccttttcttctcgtttaaaggatctgaaataaagtggcactttggagctaaccatgggtctttctcatcattctcatttcatgctgagcagcttctggcctattaaaagcaggtatgaacatcaagtatgccactgactattttcagttaccataccagaaatttcacattgtaatgaagattattctttaagcacttttcttagaaggctctgcattcacttcactgatttccattgctcaaaacatatggaatgcctcacatatttttatacccatgtagtgtaacttggttttactgtatgtgtataactatttttagtgaacatttatgccagtttcataactttgcatgcctactttcttatgcattatcacattctctggataccatctctaatttcatatatcttcggtttaaaaatagcagtgatggtggtggtgttttgttttgcagatgagaagttcaccagtgctctatcatcttcttggtgacctactggcaccaactacagcagatccactgtgcatccatgaggctaggtaccatgaaagttttgaccagaaggagccaccaccatactcttaaaacacatccagaaactcaccttttattttcaatgcttgtattcttgttttcaggattttcatgtgtctaaatatttctgttcagaaattcttcaaaattatctagtacctcaaataaacagttagcaataactagtaggggcttgtaagtaccttttgatgttgttcatccttcatcttttgcaattttctgttttcttctgcctttagagaatctctgtaagcccagcttctggcctgtaaaggtacaaagagaaaaaaaaaaaaaaaaacaacttgataggataaagggttgtcacagtacaccaagctgcctactataggcccggtgctaataactcaacctccgtactgagcatatagtaagctctccatacacacttggttattaagtgatttatgcatatgtctgaaaacgtcccttggaacatataaaaagaaaactagtgtaagcacaatcatcctgcacatttgaaaggatgatctaaatgtttaattaagctttaaaaatatcccctcagagataatcaacatagtttattccttctagtggaaagtttaggacattttcaagaatattccgactagctgatcagtcaatattaaagacaagcaatagtggcactgtctttagaagaacgggcatgtctactgctcattaatgatatctgattaagcagcttgtcaactagtggttgataccatataatttcaaggatgcatattttctaagcacttgcatccctaatctggatgaagttttatttctacctctgaaaaggaaaacaaagcctattcaggaacacatgacaacaaagcctttggcaagccagcacatgagggagaatgcccttcggtgtctctgacccaccacaccagagttccacaccctggcatagtgaccatgtgttctgacatttatggcatttcaagtgttctgtttatttgtcatatgctttctctccttcacattgatttgcagccccagcttctgtaaggcaaagagctaatgcttaggaaattacatggatctcataaaaaactatcagcagcttcatggcagcaggttacatatttcagacctagttctcaggactaataatccataaagttcaggtaggctggttccccctttttccagcctacgtgaacttttatgtaacttttctcaagcacttcttagttcattctggcatttctgtcactataaaaacccatatcccatcaaataataagaaccacttcccagaaaaagagagaagctttcaaaatggtatcatctatggcagtgccagttagaaaactggagcttcctgtgttcagaaatccctggtttatccaaaccctgctgcattgggcaggtaaacatacatcatatgactttctcttatttgcatcctaaactcaaggggactgtgctaagacatagaaggggaaaagtgattctctgacaagcctttctttttatctctgacaaccccttctttttatattagagaaggctagcctttatcacaaatattccatataagacctagtgaggaagggaagaagggagggagggaaggagggtgagaagagaggacaggaaggaaggaaaggagagaagaagaaaggaaagaagacagcttctactcaagatattaaaaggtagaataaaatatttagttaaagcaaaattacaacttgaatgagagtatctaaattctatttgaatagcctccctttaaacttgtcattttgttgttcttttattagaatacatgtcttagtttttgactcagaaaaaagtggttattaaataccttattattaaataaggtgccttataaaggtccacagaaactgggaagtcacatggcatccaaacttatgaaaagttcagttacttgcaatcctaatgtttgcttacccagctgtgatccctaggcaggataggaagtttctgttcaaaaataatagaagggaataaattgatcactatttttcttagctctaaacaccagaaatttctaagtcactgtattcacataatttgtctaacattgaaatattcatttaatacaataccaatgctatattttatcattcaaccaaaatacacctttatttatcctccccaaaagctatgcttataatgtactcattctattaacagtgtttaaggctcctctgtgcaagcactgtgtcaggacacgatcccaggcctcaagcatttacagcttagtgtgaaagtcaaacgagaagactaatggttacagtacagcatgataggtgatatgatagaggaagccaaaaagaaggatatttaattaaactagattgaggagactttccaaatcaagtaaggctaagttatatttcaaagagtgagtaggaatcagactataccgggagaagagcatcacatgagcaaatggaaaatagcagtgcatgagtttgctagggcttccataacaaagtattgtgatactggtggcttaaagaacagaaatttactatcttatagttctggaggctagaagtccaaaatcaaggtgtcttcagggttggttccttctgagggctatgtgagaaatatcttttccaggcttctctttttggcctgcagactccatcttcatcatgcatctcttcacatcatctcccttgtatgcatgcttctgtgtcccgatttcccctttttataaagacacttttcataatgaatttgaacccactctaggagcctcattttaacttatttcctctgtaaagatgctatctctgaataaggtcacattctgaggtgctaggggtcagggcttccacataaattttgagaagtgtgggtctcaacccatgacaagcattaagttctcctttcaagatggtggagtaaagatgttcctgttccattctccccaaaattaccctaaacaaagcagaaaatgaaatacacacaagctctatcttccaaaaccaagagatccatattcacagagggaaatctatgaagaccaagtagataaagaaacagtaagtgacttacagaggaaaagagcaaacctgaagacttgctggaaggggctagaggacacctatggggagccagttctctccacagagcaacatgagggcccaagaaatggatgcaccagctattgaggaagacagatggataataggcaggtaaaaaggaaggaattactagatagtctcagtagaagcccttcacccccatatacctgctcctgctttgaaaatgcaggtgctaattcaccaaacaccaacaggaaatgaaaagtgtattttctggataaactaaaccaggcatatgtgtaaagacagcagcagtggacaaatgccaggctgagaatgaaatgactctataaagtcctgcatactgaccagtgagcctctgagtccctctctttgaagtttttttctgcttcctgtactgtttcttctgagaagtaagaagtgatatatatatttttaaagtaacaaagaaaaaaggaggagtttggagacatttttttaaatctccccttcttccccccaaaaaaaccaaatcagtaaaatatttagaagataaagtcaagaaaatatgccaaaatatagaaaaaaggtagtcacagataacttacaggagaaaatctctaaagttagaagataaatccgggaggtctacaatttgaataatagaaattccataaagagaaaatgaaaggatataagtcagagataacacaagaaaatcatctagaactagagatgaatttccagaccgaaaatgaattaaaaaaagactttcacactaaatcacatcattacagaatgccagaaaaagaaaagatgatattaaaatattttcaggggaaacagagaaaatccttcatataaagcctgaaattcaaatggccttggatttctcaggaaccagtattcaaagttagaagagcaatgcctcaaaattctggaggaaaattatttccagtttggaatagtcatcaataaaaatgcaagcaaagtatgagagctgaataaagatagtttcagacatggaaggacctgaacatgtttaccttccatgtgtcttctcttgggaagccactaagtaatatgctccaccaaaacaaagaaataaagcaagaaaatagaagaaatgaggcccagaaatcagagaacccaacatgggaaggcaataaaagcaattcccaagatgactttaaaacagggattctcaaccttggctgcacattagaatggcccggggagcttttttaaaccctgaagcccaggtcacaatacagcaggctctctggaggtgcaacccaggtatctgtgatttttaaagctccctaggtgaatccagtgtgcagaggaggctgagaactactgtgttaaaggaaagtcccagaacaacagctgtgcgccaggcttacaaacacccaggacaggttaaagcaggaggaaagagggatccaggagggagagaaaaaaaaaaatccacaagttatctgacaggcataagttggaaaattgtttagaaatttgcgtcaagaggcattttgtagaacagtcacaaaagctgtcagaagacagtcaaatgttcaaaggaaactaagaaaacgctaaaataaaatgtttaaagagttgtacagaagatataaccagagtataccgactggcttggcagtgagaaaacgtgtatatagtcataatagggaaagctcaaattactgaataattataagaatgagaggaagaaatgagttaataaggtctaaaattgattagtcaagagataccaacacatattaacagatattcggagctaactaagaaaagaaacaggtggtgggttgcataatggccccccaaagacgtcccaatccctggaatctgtgaatgtttctttatgtgacaaaagggactttgcagaaattaaggatctggaagtggagagattagcctggatagtccaggtgggcccattgtaatcaaaagggtcattataagaggaaggcagaaaggtcagggagggtgcagaaggttgggtgagatggaagctaaactggagccatgcagccgtgtgccaagggtttgcggggacaggggacagatgccccccggaagcttcaaaaggaaccattcctgttgataccctcattttagcattttaaaacccatttttattgctgacctccagaagtgttaagagaataaatttttgttctattaggtcactacattcgtggtaatttgttacagcagcaaagggaagtgttcaaatgttgcggtggaagtgggattcaagcggcgcaaagggacacatgttaagtactttatttgacttcttaatgaatgagcatgtgacacgtagataaaaattacaataatcaacctgcactgagtgctcacagtagtgtgagagaggagagctggagaggcatgagctatagagcttggcccctcagacattaacgtgcacacacatcttccatggactgtattaaatacaagctctgattcaggaggtctgcagtggggcctgagattgatctgcatctaaatctttgctcctgatttcaaaagctttgcttccccttaccttgcttgcaaaagctttgcttcccctcacccctttgcagaagcaaagatttagactcgaggccagtcctccagaccccagaggactagaaaggggccattctaaagaaagagacagaatctagaattaaaggagagacggagggacagagagaggaaaggactttgtgcctaagctaagacattttgattttatccttgaagatatgggggaccactgaatgatttggggaagtgaaacaccaggataagattttttcacatcgttattcttcgttgaggaagtaggggcataaggccgggtgcggtggctcacacctgtaatcccagcactttgggaggccaaggtgggtggatcatttcagcccaggagtttgagatcaccctgcgcaatgtggcaaaaccctgtctctacaaaaactacaaaagttagctgggcgtgggggtgcgtgcctgtggtcccagccacttaggaggctgaggtggcaggatggcttgaacctgggaggtggaggttgcagtgagccaagatcatgctgctgcactccagcctgggtgacagagtgagaccctgtctaaaaataaataaataaataaaaaatgggggcagcaaaccagagactagaaaccatttcatatttgactagaaatatgcagcgatggtcgctgaggaaggtctgatgatgctggtacttctgcctacacacacaatacagagaactatattaatccacatgtaaaagtgaaccctgtaaatatctcttgtctgaagtcctaagccaaaaggaattttcttgtaaccactaaaggatttttcttgtaatcttttacattgacataattttctagtatttattaaatccccatctgccaatggcagatccacttttaaaggagaaaagtacaagaggaaaaatcttttcaggaaagttacattaggtagtaaaattaaagtattaaaaattatatataaattcttccagctcatcacatcccatatagatggcaatcacatagtgttcacattctataagttgaccatagctaaagtaaactgcaggtgtcctctttttacaaagaaatgttcttcacagaagtgcaatgtacatatttgattttcctacaccattagaaatgattctgcaaagcattctcagaagaattctatgcatatggatgagacagaatgagaagagtataatatgggtaaaaagtcaattaaatatattgaacactgaaaccgtattaatagtttggggtcaaaatcggagcagctattgcgtggagtttataaggaaccgtcctgggtccaatctccctccatattttctattaatagctctgaggatcctatgacaaatgcactaatcaatccacagaaaatgcagctctgggaaacattgctaatgctttggatgacaatattaaaattcaggacgatcttgttaaattgaagaaatgagccaaaatcaatagagcagcacacgcagttctgccaggtgttccacattgcaggatacagggagccctcgaacggaaaggaagaccagcctggtaggcgaaactccagctggtaaagctatccaactcctgttctccctctccctccctgacagccacaaggatatccagacaggtgtttagggctgtcatctacacatgatttaactccactgcctacagcttctcaactctttcccccagagcccagcagtgagggaagagagatgatgaatttcctttaatataagttgtagggcccacactgatgaatttagactttagaacatcacattagaagcagaaagaaaaaaattaggaaacaactaaagatttctaagtaggagtataatgacctcttcctaaggagtgtcataatatcttcctgacatttaaaaacatggtctctattgagaaaggggtaaggggagatgaagatgagggttctttaacaactcatttagctacccaaactctgagaaacctgagactttaagaaacttaaattcatcttttctttcagctacaacccttatccagagtcatccttaattacacttactttcttgtccccagttagcaagtcaataaacaagccctgccgctttcaccttctaagcagttttctgacctgcactctcttctccatcctctcccccgctgtcctagctgaagtcttcatcattctttacccagactgatacagaagccttggggggcctctctgcttctctattcctttagagccctccttcacaatgttgccaatgtgatccagaatgaaaacacaaatctaaccttgagttttccctgtttaaacatttccaataccctcagtgctcacagaatggggtttaggttttccaaggtggcatgcaaatttctgtggtggttttctaccaggagcaccatgagcacgcagtatgcggggcatttctacatgtctcattggtaagcactgtgtgggggcatttctagatgtctcagtgtctgggtggcgctactggcccttcatgcccagggcctagggatactaagcatcctgcagtaatcaagacaactcacacaatgaactgtcccacctgaatttccagaggtaacaccattgggaaagggtcctcaccgttcctgctcatttctatatccttctagctcacttttctgcactgcagctacataactcttcttccgcaacacaagccatgcttatttcttgcatttataccttaattcttgctctatgtgtctttattaattctgatacctggaaagactcatcactttactgattcatagtttaagcttctgctctggtgtcatttcccaagaagcatctaacgcacatggtctgacttagatgcttcttcctgataaggcagtagtgctttcttattgtgatatgctctgtgctcagcagtttgctttaaaaccattagtgttctcctttactaaggttcattgggcagaaactgtaggcacttagtaggccttatatagacctatgaatttaaagaatggaaggaaggatggatggatgcatggatggaaggaaggaaggaaggaaggtaggaaggatggaaggatggaagaatggatgggtggatgggtgggtgaatgaatggttgggtgagaggaaaaacttctctgaggctgttttagtccaggtgcccataaaataatacaagcattattttatagctcaggcaacagttgaggtcaaagtttcggatcaggtcatctgtctttagttccagcattctatgatgtacaagtcactctatatccctcatcttcagtcactaaatacctctataaaatgtgccaggcagcaccctgcaaagtaattcacttacccatgttgaggattgtgggccacaaacagcactttgacaggcacttctgtctggcgattctgtgttcagtttgctcaagaactcagcggttttgctaccagaaacacaaacaggtgttagtgccttcacaaaaatatgaacataattctttatttttcctttggatactaacctagacttatttgggtgatgattaaaattatcttcagcagaacagaaagttacgttgagaacaaggtgtagcagaaatcaaaacaaaatgctattgcaagattgcattcttcaagaacaatattacaaaattataaaactagctttatgaaatgtgagcttatgacctcattttttccactttatattactgacataaatacaagtcctctcccagagcacattccacagcatgcagccctaatttcctatctgaacatttaatgcttaacactcagacttcagggtggagctgtggaacattcacgccctacaacatcctgcttcacaccagttttacattaagccctttaccctctcatctgcctcatggctttgaccactgttaggacacagagaccctctaatccagtagctcttttccatttatggatcatggagcccttttggactctgaaagcaaaagtgaaccctctgttaacagacacacacacacacacacacacacacacacacacacacagtcctttgcattttgtttcagagagaggataaaccctccatagggtttatctatagaggttaaaaagtgctgctgattctagactgcatttctaatatctctttttagctctgaaaaattgacctagaaatgtcctcagtttaaataagaagttctctgtttttaccttaaaaatccaaaccaccaccccaatttcccctctcacttatgccaagcatagaacactggaattgtttcctagtccttacctcagtgcctggcccattctgcctacccttgattaatttctacgcctttgtccttttctcatgtaatttgtgtgatttttatctcttcattgcacattcacagccacatacctcattgagcactgacttactttgcaccagacttgcgcagcctgttcccatctccctccctcctcctgctagccctctgcttccccctaatattttaagcccaatgctaagatctgattcatcaagtacttaggacatgggcatcaaaggaaacacaaagtatctggtagaacaaatggcatccagtgtaggagcaaaacaaggaattagaaactaaacaggtgccagcatcacttcaaatattacttaggtagaacatggcatttgaaaaaggtcagaagcttgatctggggaaggaagaaataaaagtgaagcaacatacagaaccctgagaaacattcagcagttgagacgagcagcctttccatttgtcttagattacttatcttgcccagaatagacaaggagactaatgaagtcacagagtgtggaagctgccccattgtctggggctttatgaagtcatcagtcaaaagtataaaaagaagagtgatgccagaagtttggatgagatctctgaatatcctaagccaagtgcaggccataggagaaagcagtgaaaaagaaacactgtgacaagcaaggaagaaacttcagaccaagttgacaggcagcccttcagtttactgactgccgcttcttacctgccaacgccaagcacaaagctgcctgcagagccagcctctatctgtggtccttgtgccaattatcactgccccactcatgccgcaggatataaagcagagtgacagggtcacaggactgccagaggaatacaggtaggggcctgcagagtatgcggattactgccaagtgatcaactatacaaaggaagtcccatgttacgacactaactcatatttttctactattagcattagtccctggtatataaaatttccatatattggctgaactgaagtgggatccctgtaggtaactctggttatatttaacaaaaataagatgtagaacctgtttgaggggcaaacgaaggaaaacatcctcgtgggaagtccaactggactaagaaccctggactctagcactgttttcaccttgcccttgggggttcttggtattatcactaccgtgactctactgcctgttggagaggggtggtcctcttccactttgtcactctgatccaagcatgaaagatttcttcctctattctccatagaacaaaataaaatttacttatgtccaacttaggatctttaagggtccttcctgctcattcttaggttgatttctatggcatatcctgaaaggtcccttcaggaaaatctcgcctcaacagaatacagttgtagcagactgctaaatggtcatgaaaatttacattctcctcttctggccacacaacttggctacatttcctagcctcccttgcagctaaggttggctatatgattgagtcttgaccaatggaatgtgagaagtgttgaatgccacatccagtactaacttattagaaaattcccatgcatgtgcctccatacattgttctcctggctggaacagagacagccctcaaggaaatgctggaagttgtgcattgaaggtggtggagtctctatcagttttggttcctaaatacctgagtggaggaggctgcctttcaaattatgacacaatggtattttaaaaagcagtctatgctttttgtgaattcacttatatgtagtaaaattagaaacacttgccaagtgagaagagcagctcctggcatccaggaactgatctgatgctcacgtctaaatctcagtgttattataaactgatttgatctgacactgaagttaagccttgttccactgttggatgtaaatagtcacacagaatatctacttcacacaaggtcatcatgcaatctacaaagtaccaaacatcatctcctctaagtgaatgaccactacttcttcactaattacagcttcgtagtcactctaggtccttcctataggtaagatttattgagatacccaatcataaaactgtccccacattctgatggcactcaatccagagcaactccctgcctccgtagaccctccccaaaattacccaaccaaagcacaaatcctgtagtagggtctttctaacactttctccctgagataactcaccattccctatggtatgcattttcctttgctgcaatgagtaataaacccaacttgttcaactacaggtatattcctggtagtttttggttaacgcacattgacaaatattacataccaggacagtggttactgctagagaaagacagagaaggaagggatgagggtggagggacagctagctgtctctgtaatatttatcttttttaattaaccaaatataagtaatatcttaacaatatgagcttagtggttgatgcatattttctgtgtgtttgaaatgtttcttaaataaaaaggggataaaaaaccccacacagactatggtggtgtttactagggaaagacttggcagataccattccagatttcatagaacaatagtttccagaatgccagtgggaagaccagtgtggggctggctatatgagaatcatctgtggtgcttcctagaaattactggactcaggcctctgactctaattgagcatgtctggagtgggatctgggaatctgcgtttcttaaaagcacccctggtgatgttaagaactactacagtagtacagatggatattcaatatgcataattatcttaagtctacatgactctgacttatgaataattcatgttatacaacacatttggaaataaaacctcagcgtgtcttaggaactgtctgtataagtacaatctaataatgcattctacatgtattttgcaatagcttcacaaacctgaactttgccaccatgaggtttaggtaagtaatcattcgtacatgcatgcatgcattcatgcaggcaacaaatatttcctgagtctctgccatgtgtttagcaatatgggttataggacaatctaaagaagtattattttgcttaagtcagtttcacataactgggtatgagcaaatgacattcacacacctataagcactcacagagcctatgtaagtaagagagtgagagataatctattgggatacacaaaacccatttaagaaatcacaagaacaagatttacaaaacaaaacatgaaagtgagtagtaatgctgggagaactttgtgcttaatcaaagtaatcaaactattgcatacactttacagaattctttcccttcatttatctggtctttaatgatttaatttttaattgcaaaagcaatacataaatacgagtcagaaaatagaatagaaattagataaaaatataaagaaaaaaagtgaaggtcctacttaatacctctctcaacctgactcctttccccaaaggacaacatcatgaattgtcaggtatgtatcctgattttctattaattgataaatatctatttaaaattacatacaaatgaatagtggtttactttgggggaggataattaggataaggcagagaaggccagctgttctctaaaatgtgtttctctgcttcctgcatatatagctagactacgtttcccagctcccacgcaattagatgtgacataggagcatacatctgcattctggccaatgaaatgtgagtaaatgtatgggccaggctgaagtgatccacatcaataacctctcacagcattcttaatactctttcctccttctatctgatgatggtatcttaagtgagcctgcaaggcatttgcaaaggagagtagagctaccttttgcctacagctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcttcccaaagtgctgggattacaggcgtgagccaccgcgcccggccttgcctgcagcttttaatgccagggggcgaaagctaacctgactcaaacatcagccctggatcattccacaagaaagatataaacttcttgttctttaagtcactgaaattttggtgtttatgttttttaactacagcttttcctaccctaaactaacagacttttttctttaagtgggatactatattttgttctgaaaatagatttttgtcatctaaccacatctttgagatttttccatatttataaatatatatcttattccttttggcagctgaatagcattttatgatatggatataatacatttaacattcttatggatggatatttatagttttttccagtgagcatcctggtatatacatcttgtgcaaatacataaatattttttctaagatatacacctagaagtagaattttattctaatataggttcccataaatagatatgcaattttttgtttttgtttcttgagacagggtctcacattgttgcccaggctggacagcagccttgacctcctgggttcaagtgatcctcctacatcaacctcccaagtagttgggactacaggagcacaccacaatgctcagctaatatttttttagaggtggggtcttgctgtgttgcccgggctgatctcaaacttctggcctcaagtgatcctcccacctcagcctcccaaagcattgggattacaggcacgagccactgtgctcagtctattcacgattaaaccatgcttaatagtgccaagctgatctacacaaatttatattttcaccaaaagttaactttatgaaagtggcaattcagaaccatggctaacctcctgtaagtactaattctatcctgtcttacacattcctatttatctcggtcaccaccgagtgttccagtctcacctatcactcaatatgactcagtctctcaatcccacactgccccatatatctaccacttaagcccccacacctccctctagccttccaaacctttccaagggggcaaaagtctctcgatctttatccaagagttaacaactcaggattcttaacctcatatcagaaagtctccctcaaatacaaaatcaccattaggcaaacatccaggtaaaaaaaaaaaaaaatgttggcaagattaatttacataggctaaaatcactgggcaaaagtttgcagataacaggatattagtatagtcttaaaatatctcccccaaaacattcatcaattataaagagaaaaacaataacttaacagtggagaccaccttaccaaatgatccaagtaaatatcaccagtgataaggatactgatcatcatgtaccctctgatgcgatgcactgagaaggacatggcatcacttctgtaattttcttgttggaaattataacttcaagctattcatgagaaaacatcaaacaaacccaaactgggggaagtctacaaagtaactatccattacccactgaatgtgttaaggtcatgaaagagaagggaaaaaatgaggtactgtcacatattggaggaaattaaggaatcataatgactggatgttttatgtgatcctgaattggatcctgaaatagaaaaggagcactggagggaaactgatggaatatgaataaggtctgtagtttatattaatagtattgtaccaatgttaattttctgattttgatcattgtactatggttgtataagatattaatgttagctagatgaagattttattggaaactatttttctactatttttgtatcttctctctaagttggaaattatttcaacataaaaagtaaaaaaaaaaaaaaaaaaaagagtctgcctcattttcccacattgtctgaaacctgaccacctcttgagaacagtacttcccacaaccccccgaaatggaactattttacttccatatacatattccttggtgcctgaaaatgaagcagacatcctgtttgctcccaatctacttccagaccattacttcccccatcatttgcaaaacatgtttgcttctgtagtacccacaacacagaatacaccatcctctttgccattgtcatccttcaaccttctggtcaaccatctctcatttgtttaagatttcagcctttggtgcacccaggaggtgtgggtatcatgtaattggcagttggtcaaagctggtgccagacccagcctcctgaaggaaccatgtcctgcagctttgggtgccactcgtcatgtcaggcacacactgctgcccaagcggagctgctctttgaattctctgtgaatgctgggaggaggaacaccagagctgctggctgaaaattgtccaaacaagaggaatacccccctgcatggacttcctggttctcttcctgctctactggctttggtgctagttggttatgttatgacctgtttttgctagaaaactcatgatttgaaatgcctggtcagggcaggggcacagatattttcctgtataattccagaatgtcttcagaaagccatgtaaagattgcttcactacctcttccatacatgaaaccataccttcattatccttcacctggtcttgcaaggaatggtaaatactgaatatacctgggaaatactgggctaccgtcaaaagctagttctcctgtattaccttcttctgccctgtctgcttctgattgtaaacccgtttatttccaccctaacttgtgtaactgattctggcattataagaaaagcaaatgaattatttcttcaagtttatgaattcagtgatgtttctaaagaggtgaggtgctctacttatgagttacgaacaccagctcgatcaaagcactgactgcagtgtgtgcaccgttttgaccatcgttaggtttgggtgaacaactgcatctgggcttggaacgccagttattaatactttctcatctacctcttgatgttgacggctttggctgctgccatggccattgtgagcactgcgtttctggtcgatttggtggtattgttggatttgtactagacttacactgatgaccttggacacttccagtttatagacttgatttttcttatttagtacctgttcctgacctttctaacaattgtcttcatgctggggttgtggttggggggacgttgtaatggtcctgagctttctcctgggtagctacctgtgctttgctctgtacctggttgccatcaaccagactactaatgagtggtacagaggtgactgggccccatgccagcattgccccctcatggcctggcccccatcaggaaagctccaaatctaccagaacattcactcccatgggctctggagcaaactttgagagatctttctacctgccattccaaataatgagagaaagaagaaacaagaatggaagaagtgtcactgccttttaaatatagtatgcatttattatttaagaaaaaaccttcagccttcctccctatcttgactactgtcaacatggatatcctatgtgctgcccccccacaggctgtgtttcttgatttcttggtctccagtagctcttcttcactccacctcagccacactgccagggccataccctggacattgttgtcatgaataaatgtcctctctccaaattatctgacaaattccattcctgaatacagctttctgtcattccatgttcttctttcaagtactatcaatataacaacattccagtctctctgggatttctaaaccactgattccccacctctttctaaccatcagctcccatctattttaattcttgcgcagcttagagcccatagtccattttttaaatctttcccttacaaatgcctttcttcctcttctccctgcttccatcatatatgtctgtaaaaatctcaaacctagatcaagtcaaccatctgctttctctgagtctgcaccagaacaagtaaatcaaacttgggaaaaataatacatctggtgtttggggatgggaggtatgaaggaggagggagtggtaaagtagactggcttcaaatgaagtccattaactctagcttcatcctaccgaattcttctactccatttcactcataaattcttttttttattttttatttttttgaggcagagttttgctcttgttgcccaggctggagtgtaacggcgtgatctcggctcactgcaaactccatctcccaggttcaagtgattctcttgccttagcctcctgagtagctgggattacaggcacctgccatcatatctggctaattttttgtatttttagtagagacagggtttcaccatgttgcccaggttggtctcagactcctgacctcagtgatccacctgcctcagcctcccaaagtgctgggattagaggtgtgagccaccatgcccggcccactcatgaattcttctcctgtaccttttgtttgttctcagttctcagctgacaatctcctcatacttcattgagaatagagaaataagtctttcatcttctcaacacgaaatcttttaagtcttcctatatctgtacctatcttcctttaacaaaaatgtaaagactgcttcctcaattataaaaggagaagtactctccttttaatcattgactaatcattaagcattggttatgtatactcaggaacttattcatatattctttctcaagtttatttcttctgtcatccccttgtgtctagtcttcccctcctctcctggatcatttctatcagcatacaaacatgatcaatttaagaaaacttttgattccgcagcctcatccagttactgcctcatttcattgttctcattttcaaattattcaagagttactgataaatgccaaatctattcccatatctccatttactcgtaagtccaattcaatcaagctccagccccatcatcatacccaaatcatttatgtcaagatcacagccactgtcactggtccttctctcatttgaactttcaacactagtaaggaattgactaatttctcctttcggaaatatgtctgtcctgttttccatgataccacactcttaatttgcccgacttctcggatgtcctttcgtatctacccgaactctacatgatagagctcctctgtatttggtcctgggccctcttctcaaacctgcaatttcatcttaagtgactttgtccacttttatggctttatatttacatgctaatataattcctaaatttatatttcccacatatctgctcagtgagaccaaattcgtgtgtacaactgcccatttgatatatccaaaccatctcaaacttaaactcttgatatttttctaaatatgtaaacttaaacttaacttaaactcttgatatttttcttcccaaaccttggttttcacctagtagcccccatctcagtacatggcatcactacacctccagtacttcaagtcagaaacttgggagtcatccttgattcttcctccttcttcatccccaatatcaatatgtcctattgaacttacatacaatatgtagttatagtcatacgtcagagatattgtgagtttggttccagaccactgcaaaaaaagcaaatgaaatattgcaataaagtgagtcacataaatttttttgttttccattcatataaaagttgggtttacactagattgtagtctcttaggtgtgcaatagcattatgtcttgaaaaatgtacactttaatttaaaaatacacgttgttgctaaaaaaaatgctaacatctgagcctttggtgagttgtaatctttttgctgctggaggctcttgttgataacctgctgactaatcagggtggtagttgctaaaggccagagttgctgtggcaatttcttaaaataagacagtgaagtttgccacatcaattgactctttctttcatgaaagatttgtgtgtagcatgcaatgccgtttgacagccttttacccatagtagaacttcattcagaatggaagtcaatctcttaaaccctgccaccactttatcagctaggtttatacaatattctaaatttcaagtcatttaatcaatgttcacagcaacttcagcaggagtagttcccatcttaagaaatccctttctttgctcatccataaaaagcaactcctcatccgttgaagtttgatcataagattgcaacaattcagtcacatcttcaggctccacttctaattctagttctcttgctatttccacatctgcaagacttcctccactgaagtcttgagtccatcaatgtcatccatgagggctgggatcatcctcttccatattcctgttaatgttgatattttgacctcctcccatgaatcacaagtgttcttgatggcatctagaatggtaaatcccttctagaaggtttttaatttagtttgcccagatcaatcagaagaatcaccatctatagcctttaaaaatctatttcttaaataataagatgtgaacatcagatttattccttgatccataggctgcagaatggagactgcgttagcaagcatgaaaacattaatttccttgtatatcttccaggcatctcaaagttagcatgtttgaccttgaacttttgatatttttcttcccaaaccttggttcttggttttgatatttggtttagaaatactgccaaatatcctaataggtattagaaccaaggtttgggaagaaaaatatcaaaagtttaagttgaaatatgctaactttgagatgcctgggaaatatacaaggagattagtgttgttttcatgggtgattaggtgcattgtcaatgagcagcaatattttgaaaggaatcttttcttctaagcaggtcttattagtgggcttaaaatattcagtaaaccatgatgtaaacagaggtgctgtcatctaggctttgttgttccattcatagagcatacacacaatttagcatatttttttaagggccctaggattttcagaatggcaaatgaacattggcttcaacttaaagtcaccatctgcattagcccctaacaaaagttagcctgtccttagaagtaggtattgacttctcctgtctagctatgaaagtcctagatggcattttcttccaatagaaggccgtttcatctacattaaaaatctgttgttaggctgggtgcagcggctcacccctgtaatctcagcactttgggaggctgaggtgggcggatcacctgaggtcaggagttcaagacaagcctggccaacatggtgaaacaccatctctactaaaaatacaagaaattggccaggcatggtggtgggtgcctgtaatcccagctactcaggaggctgaggcaggagaatcactcgaacctgggaggaggaggttgcagtgagctgagattgcgccactgcactccagcctgggagacagagcaagactctgtctcaaaaaaaaaaaaaaaaaatctgttgtttagtatacacaccttcatcaatgatcttaactagatcttctggatatcttgcagtttctacatcagcactttctacttcacattgcatgtttatattatggagctggcttcttcccttaaacctcatgaaccaacctctgctagtttctaacttttcttctacagcttcctcatctctctcagctttcatagaattaaacagtgttagggccttgctctagcttaggctttggcttaagggaatgttttggctggtctgatcttctatccagaccacttgaactttcttcatattagcaatacagctattttgccttcgtatcattcacatgttcactggagtagcatttttaatttcctttgagaacttttcttttgcttcacaacttggctaactaatgcaagaggtctagcttttgtcctatcttggttttcaacatgcctccgcacagagcttagtcatttttagcttttgatttaaaatgagagacatgtgatatttccttttacttgaatgcttatgggccattgtagggttattaattggcctaatttcagtattgttgtgtctcaggtaataggaaaatccaaagaggagagagagatagacaggggaatagccagtcaggggaacagttagaacacacacaacatttattgattaaattcactgtcatttgtgggcagggtttgtgggtccccaaaacaattacaatagtaacaacaaagatcactgatcatggatcaccaaatcagatgtaattataacgaaaagtctgaaatattgtacagattaccaaaatgtgacactatgacacaaagtgggaaaatggcaccaataggcttgctcaacacaggattgccacaaactgataatttataaaattttaaaaaatgaaatatctgtgaggtgcaataaagcaaagtgcaataaaacaaggcacgcctgtacttttctctgcactgacatcacttaagctgagccaccaccaactcttatctggactactgcagtaacatctttagtagtttctccatttattctcttgccttctcaaatctattcacaacacagcaactagagtagtcatttctttttgaaaaataaaaattttctacaggttatccctgtggcttgaaaaacatgcagactctgtgccatggcctgtgtggtccacttgacctgcctagctcctgcctgtcttgtcaacttcgtcatctctttttttcacttcagcccgaacataccagcttcctttcaggttgctgagtaccctatatgccattgcctcagcctagaactttctttctggttctcagtatggctggttccttctcatccttttatcttcagttcaaatgtcattttcttggaaagtcgggtcctacctatcatgctaaggaggtgttgccttcctagtaccattatgttctcttaccctacctctaacactatgttccttcataggaattgttcgaatcctacacagttatcctacacagttctttgtcagcttgtctattttccacatttgctcatggagccatatttgctttattcataatagatgcctagaacctagtatagtgcttgacacacatttatcggtgcttatcagtctagaggatttttctgtttggggtttttaagagacagggtctcccctgtgtcacccagcctggagtgcagtggtgtgatcataactcactgcagcctctaactcctggctcaagtgatccacctgcctcagcctcccaagtagccaggactacaggcacgtgctaccacacctgaatcatgctcattgttgaataaatgaaagctcctttcctaatgtgaagtattatcaatccattgatatttttgccactgaaataataaaatctatatttgtgtttatctaatcattagtgaaactgaatattttgattcctatttcctcttttaactgcttgttcaagtaatttgccaatttttgagttgttattttcttattatcctataaacattctttgtgaaattaagcctttatccattatgtttgaggcaaatattttttcctagattattatttacttaaaacattcttcattatatcttctatcatagattttaaaatttttacgtacttaaagctatggtctctctttatggcttctgagatttgtatattgcttaaaaaggagtttctaccctcaaagtataaaatcatccttcactacatttttattgtgttgattcaatacaaattgtcaaattgtctattcttttgacattggtttgaaagaaatactttcattcatagttgaagtcctaaatactgaatttttatataaacatgggtctactttagattctctatagcattcaataattcaattcatagattgattacaatgccaataacagtttgttattccaaccagctttaaagtttttagtcttttatctcaaagtaatttcagttttggttttaatttttccccaatagtcatttttaaagatagtttaaattttttaattaaaaaattagctgggcctagtggtgcacacgtgtagtccccctacgtgggaggctgaggtgggatgattgctcaagcccaggaggtcaaggctacagcaaaccatggtcatgccactgtactctagcctgggtgacagagcaagacactggaaaaaaaaaaaaacagaaaaaaaattttttaagtaaacagactataatttcatattgcttaatttctaattttactccatttttctcaaggactgtggctttctaggatttggggtgttttttttttggaggttaccaagagtctttgaggccttgaacatggccaattttgtagtagattttagtcagtcttcttaaagtcagtatttataaagaatatgtgttttcatatattgggtacattttatgtctatacaattatgcttagcattgttattcaaatcctcctttctttacagagttttttggttcacttggtctgttaatttctatggagaattagttaaataaaaggaaaatttggcaaatccatagtctatattagagacaaatagtttttgtcatatgtatttcaaacctattttgataaagatttgtgacttgcattttcctttggattatatattttatctgcataaatatcttttattgtgttgaatgtttttcaccttgaattcaatttgtctcatactaatattgctgcttttgttaacatttacgtgtataactttgttttcaactcgatttatagatattctttgtaatcaaatatagctagatttgtatttttctaggcaatccaagagcttttattctaataagataatttagcctgtatacattttttgtgaatgctgacttattggacttaatattttgcttgttactttttattgaaaaattcccccttcttttctgccttttattgtaaaggcagaaattgacgatcaaatttttatttgttgtattatacttatatgtttttgtgttatttatcctaatttgtacatataattagcatataattaaacatataataagcacatttatttttctatcaatctctggaattgatatcaatatccaacattcactcatacaacaaaggaaaaaaacttattgtagttcatatccctgtctcttccttgtgcctcttctagtgctaaaatcctccatgattttaattagatcctgttgattctttttttttttttttttttttttttttttttttttttttttgagacggagtcttgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccacctcggcctcccaaagtgctgggattacaggcgtgagccaccgcgcccagccctgattcttatttaaacagaaaaacaagcacatatttgaccaaaaatgtcactgtcttctttgttcacaattgttctggtatctatgccttcctctttcttggatttactacttgtttgactagcattcattttcatgtaatttttaaaatacggctcttagagctcacatagaagtgatgaagttggctatgcagatggcttgtctccagaatggggaccacatattcccccaggtatagcatgtttaccagaagcactttctgggccccagggccttcttagtgaatcttatgcatcaagaagagttctcaggctctattgttgggggtaaaggctggagttggctgctcactttccttcacttcttcctctgctgtccttgttggagttacactgtattcagcgtctctttccaaacactatcctggatctcttatgtggattgtatcagttaatcttcttctgagttagcagttattgttaccccctaccccaggctatatgtgaggaaacgaggccccaagaggttaaataatgtcctattaatgaggaaaaatgttataatttaaactcaggcagtctaacccccagatcccctgccctcccaaaaggagaacatggatggtactaggttccagtgataagaaaaccaagtgaaactattttgtaaaaaaggaactagtcaacttttatttttttaccaattattaattgcatacagagaaagacaaaaactggcctggccaacctacagaatgggagaaaaatgttgcaatctatccacctgacaaagggctaataaccagaatctacaaagaatttaaacaaatttaccagaaaaaaacaacctcatcaaaaagtgggcaaagcatatgaacagacacttctcaaaagaagacatttatgcagccaacaaacatatgaaaaaaagctcactatcactggtcattagagaaatgcaaatcaaaatcacaatgagataccatctcatgccagttagaatggcgatcattaaaaagtcaggaaaaaacagttgctggagaggatgtggagaaataggaacacttttacactgttggtgggagtgtaaattggttcaaccattgtggaagacagtgtggcaattcctcaaggatctagaaacagcaatatcatttgacccagcagtcccattatcgggtatatacccaaaggattataaatcattctactataaaggcacatgcacacgtatatttattgcagcattgttcacaatagcaaagacttggaaccaacccaaatgcccatcaatgttgggctggataaagaaaatgtggcacatatacaccatggaatactatgcagacataaaaaaggatgagttcatgtcctttgcagagacatggatgaagctggaaaccatcgttctcagaaaactaacacaggaacagaaaaccaaacactgcatgttctcattcataagtgggagttgaacaacgagaacacatggacacagggaggggaacatcacacaccagggcctgtaatggggtggggggctaggggagggatagcattaggagaaatacctaatgtagatgatgaattgatgggtgcagcaaaccaccgtggcacgtgtatacctatgtaacaaagctgcgcgttcttcacatgtatcccagaaattaaagtatgataaaaaataaaaataaaaaactggcctggcactcacagctaggccttggtgttctcctgttgaaagtaaccaatgttacataatgtcaatatcagaagaggtcactgtgactataatagctcataacaaaaacaagatcactctataacatgtctgaacacagaaaaatacatggaccttgtagaaactataatagtgaccaaagatcccaaaattatggctaatatgagtgacttctgcttctttatcaattacagcatgagtctcactctggtcttccttccttctagatagaattgattaagacacctcatcatagacctacccctgcttcctgataagatccaattcagagcaaagctctgcttccttaaatcttcccctaaatcacctacgtattagtctgttctcacactgctaataaagacatgcccaagactgggtaacttacaaagaaaaagaggtttaattgactcacagttccacatggctggggaggcctcacaatcgtggcgaaaagtgaaggaggagcaaagacacatcttacacggcggcaggcaagaaacagtgggtgcaggggaaccgccctttataaaatcaccagatctcatgagatgtattcagtatcacaagaacagcaatgggaaagacccacccccatgattcaattacctccggccaggtccctcccacaacacatgggaattatgggagctacaattcaagatgagatttggatggggacacagccaaaccacatcaacctgacacagacccaaatgctataagtcctttctgacatctaagatggcccatggttccccacggtgtggctaaggagtctggaattcattttataggcagtaggaataggagataatcaaatctgtttgaccagtagagtgacatgactaaagctatgttttagaaaactaaacttgacaaaacatgtaagacaatgaagagactggttgcaaagatagtaacaaactcactgcagtagtccagggggtgacaagaaatcacaaaagacacaggccatgattcaagtggcatgtgataatactgacatcagggcagtggcagtgggaatgaaaatgaggtagcatacaccaggatatctgcagggagaattgatagtgggtagagattgtgatatggttctaaccatcaacataattttacattcaataggtaggaattcctctgaccagatttttcataagctgttcagtcttattctgaacaaaatagatatgagatttttgtatctataagttcactttattagcataagatagaaagttatgaataggatgactttctattcaccttacctggattataaaattcaaggctggatttaagcctaccatatgggtaagggatcaactgagcccttaagtgtctttcagaagctcccatgaagggcattagaagttttgtgagcatattggaaggcaaacttggtgcctatgtgtgcatattcagctgacttgcctggattctcagctctaggagactaaaatagatgaagatgtgccccataggaactaatcacactattattcaaatgcaagtaaagaagatgcatggtttcaatggcaaaaatgaagaaaactttccaatattacaatcggcaggctgagctcaaggtggtgcaaggcaatttagaaataggaagaccctattttggaatgcgcttggttccaagagcttttccaactgaggtttttagaactgagccccttgtcccctagaaacaatgttggaaattgtacgtaggaatagagtgcagccaggagaggtcacaaaagcccacctaccctacagtaagtttaattacggtactaatccatgttgggtctgggaagaggaggtcattcatatatgctgatcccagagaaagcagacacatttcctctctttacttttgcctattctagcaaaatccagatattggtaggaagaaatagaagtcaactgcccaagtctttctctctgagctgtctgtcccaccctctccaatagtcctctccacaggtagcctgtgtttctacagtgctcaccacccctatgtattttgaaggtcaggaatatctgagcaccgtctcctgtcagaacagcagcggtattagaatctcataggagaacaaaccctattgtgaactgcacatgtgaaggatctgggttacatgctccttatgagaatccaactaatgcctgatgatctgaggtggaacagtttcatcccaaaaccatcccccttgccccattcatggaaaaattgccttccacaaagccagttccctgtgccaaaaaggttggggaccactgctttatatacactataaacacagataagtaaaacactactcacagatgtaagggacaatagttactcttgcctcactacaggcacacgggcatagactctttccacttccccctcctccctcctcccctgaaacacaatgttgtattactcaagaggtggtttggccagtccccactaaaaacaacatttcatatgaatttcaacaaaaagatattcacaaaatgtgttattttactacctgtacttttaacacatatcaggcacttcagaacatctagaagaaagcccagacatttcaaaaaaaaagtacttagtattgccaaccatgtatacagtagtgaggaataaaatacacacacaaagcgatggttaaaatatgaaaatgtctcctaaatatgatcagtctagcatggagccttcttctcctccttctcaggtcttccaccccaagtcctcttatccactgaacaattgtggacatgtcatccctgatgtcacttccagaggtggtctcacaaatccatttcaaaaagtcatcccagaagacattttatatgattttttttaagaggtgagcatttgcaagatgtgtgattttatgactcttttatcataatttggcaaaacctatctacatctagaagggctagatgtagcaagtgctcttttaaaaccttggggaggtcagttgagagcagtttttcctatgacgtacacagatcttctacacagggcctgtacatttttccaaagaccagtgggcctttctgttgcccaaatgtggcttatctcctactgtttctcttctgatatgaaggtatgatagatgggagatcaaccccgcctggtggcttctagcagtttcatccgtcagggctctgctcaccttctggaccgttaaggccttggtccattgtcatcaataacgaggcaggcctcacccaactgggacagagtggtcaccccaggccccggtcctgctgggtttcaggccaacagaggtggcggagttgggtccgtctgcagacccaccttccaggcctcaccccacagcgctctccacggtgttcccgcagctgccaggcttcccaccctgcacaccggcgccacccaaagcggctgcatcctgaaggcttcatctaggccaggcagggttaggccgggaggcccagcagccagctgggtctgggctcagagaggcagctgcctgatggtcaaagaggtggagtggagagaggggccctcctctgcatcaaggcctgggccctgccagtgcacagccatggcaagggctccaggtgcctgcagagcagaggcttgcttgtccttggaccccagctttcctgggagggccataggggaagtggccatgcttcacttctcaccaagctctctgcaggaactccagagtggcttgttgttttttttttttttttgctgtttgtttgttttttgtgtttttttttttgtttttgtttttttcggtgagacaaggtctcgttctgttgctcaggctagagtgcagtggcggcatgaccatagctcactgtaacctcaaattcctgggcttaagagatcctcccacctcagcttcccaaggagctgggactacaggcatgcaccaccactcccagcaaatttttgtattttttgtagagatgaggtctccctatgttgcccaagctggtcttgaactgctgacctcaggtaatccacctaccttggcctcccaaagtgctgggattacaggtgtgagccacagcacccagtctcatagcagcttcttattactttatttgattaaaagaacaaagcactttgtattttaaaaccatatgaatatataatctgttacatttaatgtgtaaacaggagataaaatcccaagccccccaacagacttaatggattcccttgtagccaagtggattccagaaagaaaaactaaattccaaattctaaatgccccctcccttttggagtttaggcacaactaaccagcacattaaaatagacgtcatagactgccctaacactaacagactctttgtggcaataagataacaaattccaacctgactccagtacagcatcacacgacagatagcagaccctgaaggaaataaaaattttttaccccaaaatatatttctttggcatattttgaaatggccctgtaaagctgtcttttgtggggaaaatttgcatatgtagagacactcttaccccttccaggtcttccccagatcaaggagagataagtgagaatctgttatctttaagggttgaaaagagaggctttggcccaggcacgtggctcacgcctgtaatcccagcactttgggaggccgaggcaggtggatcacatgaggtcaggagttcaagaccagcctggccaatatggtgaaaccccacctctactaaaagtacaaaacattagctgggcatggtgttgcatgcctatagccccagctactggggaggctgaggcgggagaaatcgcctgaacccaggaggcagcagttgcagtgagctgagattgagccactgcactccagcctgggcaacagaacaagactccatgtcaaaaaaaaaaaaaaaaagaaaagaaaagagagacttttcttttttggtcatcaagtggctgttagacatgaattttaaattgttaatgtttaaaatgtagccaattcttatatctcgagaaaattcttaaaagaacactttttcctaatacccgcacacaaaatgaatctgtcctgcttcactcacattcctaccctagctgaaattcaaacctctcttaacactcatccaaaaaaacacaattggaaagatgactacaccccgcccccaccaccaacaaattaccaattaaaattttaaatgctgagatttattttacccaatgttttaaacaacctaaatcataaaatcctatcattgttttttaaaaaaggcttatcaactgttacttcacgtcttccatctaatagaaaagtccacccaaaggtatcacacatgaatttttataagtagtaaataattacagagactaaaaataaccttgaaagttagaccaaggctaactgccgatttctaccctctgttttcaggctcaagaatcctaaaacgaattctaaattatgaaattggagtctgtccctagccagagtagcagacttaatgcaccattaatctgttctgctctcagccgctcattgaaacagtcacagtcattcaatttttagggaaaagacagtactgcaaaagtacattccagaggtcttttcataaaaaccatcctgtgtgctccatctgcatgtgcaatctgcttgtgtattttcagccagcttgcacgggcagattaatgcgtacaattagaaagcaacctcacaggcattcaataaactgccttcattattacactcaggagagtccctttggatgtcaataaaagcctagttttctgcctgttagctaaataattgacaacactaaaaataatcagaagcaaatgaacgaagtcaagaacaaggtgttaagaaagagcacattaagattctcatggtggtgccccaggttgctatcatgagctttttctccagcaacttggatttatagtccgctcaagtccatggttgtcctctctacagaaaaaaaataccattcctggtttgctgtatgaatcacacattgcagcatggtgaaactagcaaagtattgactggtttgaaagaatttcttatgtacgtttctattttatgttccttcatttaacagtttcaggagaatctaatttgggaggtgggggtaggcagtctggttggtctggcaaaacctttgtgctgttaaaaatccaaagaggtggctgggtgcagtggctcacacttgtaatcccagagctttgggaggtcaaggcgggtggatcactggaggtcaggagtttgagactaccctggccaacatggtgaaaccctatctctactaaaaatataaaaattcattgggtgtggtggcattcacctgtaatcccagctacttgggaggctgaggctggagaatcgcttgaacccaggaggcggaggttacagtgagccaagaccaagccattgcactccagcctgagcaacagagcaagactccatttccaaaaaaaagaaaaaaaatccaaagcactttcctagacattttttccaccatacactgattctaaggaggtatgacaaaaacttgtcatatagacgatccatcttttataagtctcttttatatttctaactacatactcactgcttatttcatgagttattggtcttttaatttcaaaagtaattcaaaacataatactctttcaaagaagaacctcacacatatacctcttcttgtgtttctcaataggctttaaaaatcaatttgagatacttctcaattttagccaaactctgtttttcctggttaactgggacttttacaataagcagaagaaagagcaagagtgaaatgtgtgtgtaattgaattcagctccactgatagcaggccaggtggctgagggcaaacttcttttttctttatagaaaaagggtgattgatcttctgtatttagtaaaacacaaactcaagaagctggaactataaaagaaaggaggttggacgcacagcttctaatgtcttttaaaacttcaagaatctcttaccctttactttgccatatttagaactctccagagaatgaacccattcaactatccagtcctgtgcccaaggcccctcactgttaagtaggtcttccctcttccaatgtaaaactagtatgccacaagacaatgacatttgttctcatttgtgactctaggctactaaagttgagaggtgaagccagctggacttctgggccaggtggggacttggagaacttttctgtcttacaagaggattgtaaaatgcaccaatcagcactccgtagctaggattgtaaaacgcaccaatcagtgctctgtggctagcaagaggtttgtaaaatgcaccaatcagtgctctgtaaaaatgcaccaatcagcgctctgtgactagctagaggtttgtaaaatggaccaatcagcactctgtaaaatggaccaatcagcactctataaaatggaccgatcaacgggatgtgggcgcagacaaataaggcaataaaagctggccaccccagccagcagcggcaacctgtttgggtccccttccatgctgtgaaagctttgttctttcgctctccacaataaatcttgctgctgctcactctttgggtctgtgccacctttaagagctgtaacactcaccgcaaaggtccatggcttcattcttgaagtgagcgagtccaagagcccaccagaaggaaccaactccagacacaaagccaccagcccagcccctaatctctctcaactcttccggctgagcctcaaaataaattctcattcattctctacccatgaaaggagaggcaatgatacattcacagtcttcatctggtgcctccctcccaccatatctctctgcaagacagacagtttctcctggtacttagctccttagcttcccaccagctcctcactcaaatgccttctttagaagaagagttgggacagacaggctaaggattctgtgatgaaaatgagagtgatgctccttttagctaaggaggatgacatcacttaccaacactttcatcctaccccataccatctcccatctattttctggcctgggtagcagaaacacagtacctaacttgctaaggagcaaagcagagggttgagaaacgtctcttccattcctgcctctgaatcttaaagcaagaaggagctgcttatgatagaggcaggataattttagtggcatgagaaatcagaagatactgtgcttagagggggaatatgttggaggctgtcacaaatatgctcaccccaacatctgagtgatcttaaattctgcaaacaaggaacaacaatggagtgagagaacaggcggcaggcagtgaatatttcatatgaaagtggagggcccattactggttctggtgggaccagaaatttgtgtacagcctccataaaataaaagttatatgatcctattcaataaggatctctgtaagaaggatcatttcaagtgcctgtaatagtcaggcacttttatgtcatttacatattttatttaattcttgcaaatggcctataagatagatattatctgtatttaagaaaaaaaaaaaaaaaacactgacattcaaagagttttagtgagagctaggactttgaacccagatctgcttggttctatttctaccacatttagaattaatgtagggccagaaaggacatgagcttatccttaaagcctacataacaaagtagattacgttataaagcatgtagtagttgccctgtatctgttagctgctgttgttcacaaatcatactgcaaattaccttggtgtatgaccaccagttgagacttttgccaataactactaaatgatttctcaattcttgtctagaaaaaaacacaagtgtatagtggtcctcagtccatcagataaatccctggtcagtttagacgctgcttaggcacttcagtgcaaacaccctattccttatattggtatcctggacgtcaacatgagcagaagtaccttggatcaccaaaggatcaagtcttccaagttatttataatggggaatttctcaaatttagtgttattgactactaaaggatactttggtgagtagacatgtctctcccaccttacttacatggtgaaagagttcaattacataattaatacaacagccaataatccaataccaggtgttttgacaagttagcatcacctgaatttaaaacctctatgaacaatctgcctataaaggcacgaagttctgaaaacattaacttactattgctgatgctctctaaatgcttctcttctaaggttttcttgaagtctttttttctcctccagtttattgctctgaaattgcaaatatcaaaacataacttattaaagatgctttaagcagagtcatgatgttaaagttacccaaggtccaaaatcctaaggttcaactggccttgatagtctaatacagtatcctgctagaggctccaagatggtactccctgtcagacccatgggcactgcactgaaagccaggagctccaagttctttccacagctcccctctcccaacttgattggtataatcacagaaccagcattttgcgtttttattctttagttcaaatgatagcaacatttattttttaagcagtgctttcaaaatgttttaatgaaaacatgaaatttccataccaagtatgttaaattaaaattataataaatggttaaacagctcatacaaaatttatacatacactcaaattctactaaagtatttgagaagagattttcagtaagacaacccaactcccttctgacttagtatcagatacttaaagctgttgagggactgaatagcacatgtcataaaaaaagccatccacttgaatagaaaatagttcttttttttaattagctgtttggagagcctggagataaaggccttcatatttgatattactgtcaccatggctctggcatattttaatccaatttaaataacccaggaatgtttgctttttgctcaccatgacacactgtcattttttaacttgctatgacctatgaaaaacaagtaaaattcctagacaacaaatttaatggagagttgaaacacattctactatccaggaggatcatgaagttttaaatgaatccaagagagacagtaaggagctggggttgctttaataaaaattggatttgcccagaagaggaccagtgaaaggagaatattggaaatcatcactttcaagcccaaacataagtctggttccatctttcaaagaaatgaagaaactgcttgtattgttcatttccatgaaagtcttcattcactcaaaactaattactagtcccattttgaaaggcaaaatggatgatgatttcagtttcagaaaaaaactaaaggaaatttactacagtcaaagaaaatcaattataaggcaagcaactggattattaatgaaacacagaattctaggaggcaaactaatggaaaattgtaaaaccaaataaacatgattctagtctaggaaaaaatcctgactgatgagcacaaaagtgttcaattgtgatgagttccctgccctccagggtggggactggggggtcgtggtggatctaaaagggtgaaagacagcaagcgagcagtaagtgttgattaaaccagtattcagaatgctactcagagaacagtgagaaagccaaaaacagctagagacaaaaggctggatccctttagcaaggttagaaattgagaccactgattttaaccttttcactaatagattccaactcacaaacagtcatacagtagctaaattttatccaacaaaagtctgtttatggcaggacgcggtgactcacgcctgtaatcccagatctttgggaggccgaggcgggcggatcatctgaggtcaggagttcaagaccagtctggccaacatggtgaaatctcatctctactaaaaatttaaaaattagccagtggtggtggcaggcacctgtagtccaagctactcgggaggctgaggtaggagaatcgcttgaactcgggaggcagaggttgcaatgagtcaagatcgtgccattgcactccagcctgggcgacaagagtgaaactccatctcagaagaaaaacaaaaaaaaacaaaaaatgtttgtttatgcctcagcagaagttgatagttgatgaagaagtatttggggggggggggaagtagtagtagtagtatttctggagtagttgaaaaattgtattcaatccctattcatatcaaatgcctgttatatgctcggtaccatgttagatgctgggaatacagctacgaacagagaagtgcccattctggaaaatgttacagcctcgttggggacacagacaaaaaagaaatgatggcagtatgctaaacacattaggggacagcagtttgcaaataacagtaagaatgcagaaaaagcacttatatggattgtcaggaaatgctctcaaaagttccacagtaactcaatgcctacttaatgttagactccatcctgagcacgagagccaagaagcggaataacactgggaatgtggtttctaactttgggtaagctgcatgttatgagggtgcttctttctatggagagtggactcacagctttcttcatattccccaaagagctgatgaccaaataaaaggataaataccatggctctaatgagagagagaaattctatatccaacccaatcttaagcaagagtgtttcaggaggaggagaaggtaggaacagggttactacactccattatatgggttgttcagcccatggggtcccagcaggcaggaggggagtaggaaaggaaaaatagagccagtgttcagctcaccaagatttgtactgcagcttgtggctgctttagcgcagaggaggtgtctttttctgtgtctcacaaaggcactatctatcaccagtctgagcacccacagaattgaccgcctggatggagaattggtctctaatttgcacaaaggcaaccatgggctggtagtaaccctggacaggaaaggggcattcccagaacttaacgtttttaatatacaaaggtacaagagaatatgttagctcaaggaaacccaagaagctcatggataaattgaacaacgtttatagagaaaggagtagaagataaggatgagaaagtaagaaggaataattatataggaatgtatgtgccaagtaaaggagtttggactttatgaaacccaacagtaagccattatattaagcaggaaaggaagtggctcactcttatagcaacatggaggttaaactgcagcaagggccacaaatacacgagaacccctggggtgattctcacagtaatctaggccataaattacaagccccaagttaagtcagcaggtacagggaagaaagaagaaaggacagtcttcagaaaaacttaaaggacagaaataataggaagcatgatgatagggatatgggatgagtaagaaaaggaggaagagtctaagattactatcatttaagagcaccagaatgaacatatgagttcaattttgaatttattggatttgaggtatacttgtggaatatttagggagaaatatcaagcatgcagcaaaatatatggttctggaatttagaaatatggtctggcctgaagatatggactgcagaaatcagtacaaacaataactagatccttaaatgtggaatttttcatctaaggagagggggcctaggcccagcagtatcagaggagaccacgggatgggatctggtaagcatcaatagtggaaaaacaagtacaaggaaaggatcccagagacattcaggaggtggaatttgaaggacagagtacttaatagttaattttaaattttaattttatttatgtatttatttatttgagacaaggtcttgctctgtcacccaggctgcagtgcagtggtgccatctgggctcactgcaacctctgcctcccaggttcaagtgatcctcatgcctcagcctcctgagtaactgggattacaggtacgtaccaccacacctggctaatatatgtgtttttgtagagatggggtctcaccatgtttcccaggctgctcttgaactcctgggatcaagcaattggcccgccttagctcccaaagtgctgggattgcaggcatgagccaccatacccagccttaatatttaattttacacagagcaaaaataagtgaggaatttaagaatctttactgggatcttttctttctttctttttaagagctggggtttcaccatcttgcccagactggtctcaaagccctgggctcaagcaatctttccttcttggcctcccagtgtcctgggattacaggcatgaatcactccgcccagctggatttttcagttaagaacaccgttggtgatcttaggtagattagaaccagagaagcattagaaacaaaagccaaattcagcccaccaacaaatgaggaatcagagaaggaaaggaatcagagaaggtaagttcttaagctagctgatccacacatctcctggggaacatttttttttttaaatagagattctttggttcaggtgattgtccacagactgacatttgggaaccaaatatggtagaggagtctttcaagaagttcgaaccataatgcttgggacagaggagttgaaagcagaccactatatggaaaatttgtttttaaggtgagagatttgagtaagattaaatcctgagaaagaaaaacaaaaacaaaacaaacaacaaaacaagaaagtgagaggagaaagggagcttaactgatagagaagcaaggtccctggggagaccggagggaagatgaaatggtgaacacatatggaagaatccatggtaccaatgaggaaaaggactttctgattcctcctgagataggatgggggtaggtgcagcaaagggagagtaagaaaagagaaaaataaagatacttaaggctggcaacctttatttcctatgaagtgagagacaaggtcacgtgctgcaaatgaaaggagagcataagaacataaagccagcaaggattttggtaattgggtttggttcccagttacaatgcaaagaaaaaaaatgctgggcattgggcattgtgaaagacccagctgagatcaaatctcagaaatgtagtgtggcaaaagaaaaaacaaaagtcacatatgtttttctctccagcaacttcattcatgtgggtttagtagaaatgaaataattgaacccatccaattcatgcataaaaataataatactctctacgccccccttccaagaggttgatataatagattccaacgagatagtgttaaagcacttctttacatttataattaggttagggtactttactgagtgcttaccaagtgctaggtattgtactaagggctgtgtatatattgcatcctctagtcctaccagtctcactattacattattatacccattttacaaataaggtaagtgaagcacagaaaagctatcagcctacactcttagtaccacatgtttattttagagatactaacattaccacattatggggttaattagcgagatcctattacatttcaataaccaaaggcttaatgcttccaccaagtcatccacaaagaaatgcatgatgtaggagccacatttcttggaaacactgatgttccctgaaagttttcagaaatggaaatgtttcccaatttatataaacaacattgaaataacttcctcaatgttgagtttacccctaaaattgttcttaaactgttagcccttgctactacttgcttcctagaaataagaaagcaacaagtgtgatcccttaacatgtacctgtatgcagctctgcatctaatatgcataacttattttctaccagttagttcctacttcaccgtatagcattaaaactaactgtgcttctcagtgtctgcatgaaacactgtgacttccagtgcttcaaatgactttcacagccatggcttactggaaagagcaaggaaaggtgttggaagccactcagatctttagctggtttcctgaattctctgaggttatgataccaagaggttggggaatcaaatgaagtatagttggtcctccttatctgtgagttccatatctgctgactcaaccaacttccgatggaaaatattcaggggatgaggaatagacggttgcatctatactgaatatgtaagactattttcttgtcattattccctaaacaatatagtataacaactatttacacaacatttacatcatattaggtattataaataatctagagatgacttaaagcatacaaaggatgtacatatgctattgcaaatactactccattttatataggattttggtatccattgtgttgtggggggagggggaggcagcaaccaatctcccatatctaaaggatggctgtatctggaaactatataataccgtatattatctcaaacatatgtagatcgaaggcagaataagatgaacccaggaaattgagagagtctttaaaatggagttagaagattttcatattttaggtttgtgggtattatgaaagtctgggaaaataaaattattatttatcatgtgattatggggggaaaatgtgatttactcccatagcactaaatttgggtgaaatgcttgctgtggggagttaggaaaacctgtctatttatactgaaagaaccagtggcaaaacacttgcatctggtagactgcttttttactctaatgctctaatgtcttagagacgttgtctctgctttatagatttcttggaaaagaaattaatgcatcattataaaaccacatgagtagtattagtttcctattgctggtataataaattaccacaaagttaacagcttaaaacaatacaaatttattatcttacagctctggaggtcagaagtacaaaacgggtatcaatgggctaaaatcaaggtgccagaaaggctgtgttccttctggaggctcaaagggaaataatcagtttcctggtcttttccagcttctagaggctacccacattcctgggctaatggccccttcctacatcttcaaagccagcagtggtgggctgagtctttctcctggtatcatctcttcattctctatctccctctcccaattttaaggacctctgtgattatattgggcacctggatattgcaggatacgctctctattttaaggtcagttgattagcaaccctaattccacctgtgaccttaatccccttacccatgtaaggaaacatgttcctaggttccagggataaaacgtggacatcttggggtggagcattattctgcccactacatgaattataatctatttttaaatcaataaatatcatacacacaataggccagctatttccccaaatctttactctccctagccctctgaggtttggctttagaatatgggtggtaggggagggtaagaaaatacctttttcatttagtgctaagcagtggtgtgctggtcaacatttaatcaggtctagcaggtaggagcaggaggggaaattaatctgtagcatttactgatttccacatcgtaaatattttccaccacagtcggtttcaaactgacaatgatgaagccaagtagctcaaaaaaatcctgaaaatgtgacaattcccacagtacaaggcagtacaaggaagctacagaacatcactagaagtatatatactgtgacagactctagtctagggaatgcaagttacattcctgaactgaatacaactcaagtataccagtgctgtctccaaatttccctttgtacccataggattaactcttcctgggccccactgacatgactggatactaaagagctggttgactttcacacctgtctgtctattaaggatcaaagaacatgcacaaatgctggcaaggaatccagtctattcttccctcactaaatgctgcacacagagatgacgaccaatcagaatgagacccagtgtcccctgacttcttttgggagagaaggaaatgaagggcagaaggggaccagcagccagtgggggaagaccagagacaaggctagaggctcttgggtggcaataggctgcttggattctacttggctcagagtttactgggcagcagccatttgcctggggaggagggcagcgtgtttgcaggctgatgtccatgtgtgtgtttgctgtgcattttaaaatataagtgctccataagcacagccattatcacttccctcggccatttccacactggcaatgtgaaatatgtcatttctagatggctaatgttcatttttcttatctgacacaagctactaactaggctcacatttaacatgaaaagctacagatttatctacaacagggaaggctaggatcatggtgacagtgcaggccaatcagccagagaaatcacatctgtggaagaacaaggatgggtcaccccttcttttgcaaggtcatttaaatttatgctcctcgagcttttatgtgcacaggaattacctggggagcttgttaaaatgcagattctgattcggtaggtctgaggtagggctcaagattctgctcttctaacaaactcccagatgatgccaatggtgcttgttcaagggccatattttcaatgggaagggtctacagatcaactctctctccccatctctcacatcctggcaaatttatgccaacagaattacagttatcatattaggaaagggaaaaacactacttttagacaatgtttaaacagtttaggccaggcatggtggctcattcctgtaatcccagcactttgggaggccaaggcaggtggatcccttgagcccaagagttcgagaccagccttggcaacatggtgaaaccctccctgtctctacaaaaaatacaaaaaaaaaaaaaaaatagctatagtggtgttaacctgtagtcccagctactcaggaggctgaggtgggaggactgcctgaccccaggagactgaggctgcagtgagctgtgatcacaccactgcactccagcctgtgcaacagagtgagaccccgtctcaaaaaaaaaagaaaggaaacagtttcaaccacaaacatttatgaatagcgtacattattgacccatgaagaaattagctgtaaatgacccacacgccagccaatgatgggtattaaatgacaacgaataaatgatctttaggacaagaggttgcaatacaataattattaagggtctgcaagcctcttcaccctgttcctggtgatgacttaacaattgtctttgttctacctgaaatacaggctatgctccgtaaagagagtgcctcctctagaatcacaagacctaagcatgaatcttcctttgaaggataaaatggaaggaaaaaaactggatgaggaaaagaagagtggggaatagaaagagagagagagagaaagatggataaatttttaaagttactataataaaaatcttctacaacgaaactataattgttgatcagcaaatgtgaactaatcctcctcctccttaccttctctctctgaattgccttcattttttggagttcagcttcttcagcttccttcttgattcttacagattcttctctttttagctaaattgtattgaaattacagagaacaaaaacagttaccatttttcagtctgaactctggaacacaaaattatgatgaaaggcaaattacagtattgtttgtgctatacctcaccatgattataggttgttacttcaagctacttagatcacagagaatggccgggctacgtcttctgcccgtgaaatttctgtctttgtgtttcttccttggtctgtctctttttcaacgtctctgtctttgtctatctctgtctctctctgtgtgtatgtgtgtgtggtgtgtgtgtgtattggggagggaaaagggaaaataatttttcctgattacaaaactcagtgttcattgtaaaaatcgctgggaatcttaaatattttttgtactacttccatgactgccatgcagtaaacaaatccatattcttagaaccaaaacattccaaacatagtagactttaaactatagttaaacatagttaacttaaatgaaaaaaataattcccttaatcgagggtcatgctgagtgataaagggcttaggtaggaattgaaggtatccatctcttcacttctcacttcctgagagctttgattctgaaagctgccttttgcaactggttggaaggttttatacttttggtaaagttactgtgttatttcacagttacttgtaagagctggtactcatattccttaccaaaattcaactaaaagagatgaattctgaccttttgcttgtatttagattgcatcagctggagttgttgtttctgtctgacttcagtttctgactggcttccaccttaggaaaaaaaaatccatgaaggtgaaacataaatattaagctgaaatgtcagccatcgaggactaattaatatataataaatctataacatgagttcccttaacattctcatgctcttgcaaataagaacataaccagttttccaagaagaccttaaagaaggggaatcacttagaagaaagagctggatagaaagaggagaccatatttttaaaacaaaagagcacttttactaaggtttttcaatcatgtaggtattaaagttttcacttggattgaaatcatacctaaaggtctgtgctaaacagaagaaatagtgcctgtcttggaaactgtagaatattcctcctgcttgaatatgaccatgcccgaacctagtaaagatggtgatcaaaggtgcttctattgcttttcttcttctaactctattgccttatattcaagcagcaaggctcaggaggctctcagaggtcttgccactagacaagcatgtagtctttataacccagtttctaaaaatacaatgggaatattctagttagtaactgatcatcaatccatactatttattgttctttccttatatagtcaaaataaaaatatggatgttagattatttacttgctctctcttaaacctaaaagaatttggggccagaaatcctggcagcttgacaatcatctaagaattaccatttagggaattctcagtgtttatgcaagcttggtgtgcgtattataaagattcctttgaaataattctctggtgctttggtcactaaaagtgtcagctctctgaaagattcactctcacagaagatgcattaaaacaatttgtgttcactataaatcttataattgaactgagaaagataccatagggacttttcttctgagatctgaaagatatataaggcctgtttggtgttggccctttgactgctattgtgggggatgggggatgtttctttcaaaacagtaaggaatgttgacatttttctctaatgttacagcaacttttagtatctcctgcaaccattccaatattgtaaggggtagagaaatagaggaggagttgaaaattagaagaaatggagagagccagatgtctaagcatttacaagttttgttcaaaactcatctcaaagtttaatacattctagaattttcttttctacccccaagtccctcccacacacacatacctgactaaccctagataatgcatataacaggaagtcaaaatgagaatcctgctcattttctgctaaggcttcaagacaacagatgccgagcgcttcaaattccaaagggaggtaatggcccctcaaagcaggatctgcaaggaggtaactgaaacctaccttggggaaccttaactaacttcagcctataaaagaggttggttaggtcaaagggaggcagaaatctgaggaaagatgtcattctgaattctatgtcttctgtgttttgaggaaggagaaatcttcacaccagatgagcaggagaagtttaatgaaaatcagctggagtccctgtccctctccctctccctctccctctccctctccctctccctctccctctccctcgtctccctctccctcgtctccctctccctctccctcctctccctctccctctccctctccctctccctctccctcgtctccctctccccacggtctccctctcatgcggagccgaagctggactgtactgctgccatctcggctcactgcaacctccctgcctgattctcctgcctcagtctgccgaatgcctgcaattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacgcctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcatctccgcccggccgccatcccatctaggaagtgaggagcgcctcttcccagccgccatcacatttaggaagtgaggagcgtctctgcccggccgcccatcgtctgaaatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccgccccgtctgagaagtgaggagcccctccgcccggcagctgccccgtctgagaagtgaggagcctctccgcccggcagccaccccatctgggaagtaaggagcgtctccgcccggcagccaccccggccgggagggaggtgggggggtcagccccccgcccggccagccgccccgtccgggaggtgaggggcgcctccgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggaatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaaaaagaaaatcagctggagacctcaacctgcatttttaagagtctgagggtcttattggattcatgcctagaacagttagagcctaaaggtataaggctgttgtccattggccactgagatgagtcctcaagaagaggtagctacattacaaatggcccacattcacagtttatgaaaagaaagaatgcacaagtatttcctgtacttttaatgtgattctcatgaaagagaatgccaacctaaagccatctaaagggacttgcctatgagggccatgtcaagaacaatggaaccctaaaaggagtctaccaagagccaacagtgaggccaagccctgccgacaggagaggaaatcgtctgtatcagggaaatccaggtgggagatgggtagcagagagtgggggatgctgaaaaactcgaagattcccaggaagaagaacgagcagtcagtgtaaacctaggctcaaagaaacaaggatcactgcattacgaaccccgaactctcttatctccctccacttcccccttcaatcccagaaaggtcagaatctgggaacagagccatgaatagagaaaagtccagccacaccctgttctacttgctggattcctacctgaaacaggcctgggttagagcaggggagaagctctcatctccattagtaacagaattttgatcagtacctaagactgaacattaattactgaaatgagactgttttaggcctagaattagctaggtcactctactgtttgaaagagaccaaaaagctttaatttcttacatcatccaaaaagcctgagaaagactgttctcacatagccaatctcaggggccaagctaggaaagattaaagctgttttctgattgtacccttcgagtctggctcatttgcacaaaggaggcacttgagattagcccttttcacgaaatacagtgggatgatgataatattactattacttcctcccattaaataatttccaaattagattatttttacctatgttcttggtgggggggcagggtgtggggagggaacttctctaaaactatcacaaccgtaagtggcccctgacacaagacatgcttgtattaactaaatctgtggacactgtgtgtccaaccctttaaattttcggctgctgatagaagagaaaaagcaaagaaaagatgtgaatgattcccattaggtggcatcccttctgaatgattcaaacaccggcaaaggcggcccagacaattcatcacactggcagcacctgctccagaggcccagaggtctctatctgtagaataaaaacacaggtgatgtttctcttatacccaccaccgggtttccagctcactctcatctccctcttggaactgactctccactccttttcttcagattaacatttaactgccatgattaatatgcttgtgccagcatttactcccatcctgactagtgctatgacagggcatatgcagcgccccaggtaagctttttcagagtcaatcatctaagaggctctaaattatttggcaattaagccatcactgtgttcccatagaactctggcattacaggtttgctacttgcagaaaatcagaaaaaaaaaaaaatacacacacacacacacacacacacacacacacaattaaatgcattccacccaagcagcacaatgaccaaacaaactacaatggacattcacagacagacatatgcaagctgcttacaggatccataggtggccccgccctccctcattccggcagcggctgtgcttgcttacctagccgtctgggcaccaggtgaaccggtttagctctgttctgctccttccacttctccaggttggccagctcctgctccgcaactaagccaggcgagaaatatcaaatcgtcaattattagacttctaaaagaaaaccagtcccttcaaagcataagaaacaactattagaaggcaattaactatatgtgagcatgagtgaacaaggcttccaggttagaaacacaatattcagccctgacccgtacaggtcatcctgggcccggccctgtggcacattctcaccaagagtcagcacagagggttcgaatttgaaaaaccacctgggctcctactaaaagaagtatagattttcctaccattctggcatttttaaaactctatatcaagttaatttttaaagttacctatagaaaatgtgtgcaaaactagaatattttcacgtcaataagaactttccacacataggtaaacatatccccagagaattctgatgcccatactcgctttatcttcaatgctcccaagcttactgcgactctagggaatgagggctcggtgctacaggtggagacccttgctctggtttcaggcactccagaccactgtgcagagtcggcttcctggggagcagggctcatttcctaaatgttcactctgcacgacagcagggggcgccagagagaaattagttctgtcactccagcgcctccccttatctcctcatgagacctgtttcaaatgtccattactagaaaaacaaattctgaaacatttcgaaatccagaccacattgagacttaatctcctattaagtatttaaatcaaaagcttgtaagataccagaactgctggcagttcccatagtccctgcatggctgtgattgtcatattctgcactgacccgctgtcccacccggagctacatgtccggtggagactctttagagagctttttcccttttgtgcctttctgtccatcattagtcatgaagttaaatttcctaccaatcatgtaataaaggagaccatcgaatttcagcatagccccacagctggacttgagcaagcctacaatttctttgtgaactaaatgaactttagttctcttccacctctaaaggataatgctataactttaaatggcagcatttatatttactgtacatcaattaaacatgttatgtacgcattaagtacagagagcacaaaaacgagtaagatgtggtccctaccctcaaggaggtttattggcaataagtgtaaagttgttcaagccaacagaaatccaggatctaccatcatgtcatgagttctgttactaacgtagagaaacaaacttagaagtgttaatagtagaatatttttaaaggtataatcaaaactaaaaaaaacaaaaaaccttgatgagatttggtgagtctatataaatgagaaaataaaaatacttcacaccaaaacaaaccaattgtaaaaagagagaagcattctgaatgttaaatgaatgactatacatacttctttgtatctcatttctccggtttatatttggtgctatcaaggtgtatgcacttgtgctaaaaggaagagaaaaaaaaatgcttattaccatgagaaactaccaatgcatataagccaccagatatttttccttctattatactgtatttatgatcattaccatcaaataggcactatgaaagataatcttcttaagaccctgatctgttctctgggacctcacaatcttgatgtcaaagtaaaacaaaggacatggccaaatatgaaaatataaagcattcgatgagtgacaagtgactagttggtgtactgtccttgtagggctccaccgttcctctaggtggtgcttgtgagtaaattcctttaagatggctttagattggcattctcttctgtgtgaccacaccggggtacaggaaacattggtacattttctgttcccacagactgatcctagaggccatttgcaatgcagccacctcctcttgatgatctgagtaactaactggcttttaggctttgacttttctaggcctatgtccactggtctcttcttctcctagggacacaggttgagcataatcaggggctcggagaagcaaggagtcatttcaaccaggcggatcagggaagactttttaagaaaaatattcacctctgtgacactaggaagctgttaaaatattgtgagcttttgagggcagagagtgtgcttgattgatgtgtattccaagcccctggcacagtgtctggcacaaagacattggctgcttgataaatgtgggctgaattaaaacaaaatgatgctacagacccagcctgtgagtctgtgtgggggtggctcttttttgagatgatgcacgtgatcccacaagaacatgaatactccattaagcaataatatagcacagcaacagactgcagcatacatgtaggtacagttttaagagaaatgctgtggataaacacaaccagcttctaactgtaggatttaagagggagggaaaaaaccccacccagatactcttggaagtctctctcttctacctgaatacacaatttcaaagggcaaattagcaaagattgaactgtagaggccaaaagcactgatcaacagaagccatttccttccttatctcattatttttctagcagctagccttcagccagcttcaaactgggctttaattttagacttgtaaatgtgaggtgtgcaacagcctttgcatgcaaatggggctgctggatgcccaattacttaatgtatatcagcagacgttgcatgtgtagcctagcatgcatacaacgttatgaatacaaaattaggagactgccactggcaattaatcccttgtccattgcacattctttgtacaccctaagaaacatttttcacttctgaattgccagtactttttaggagcttggaagctacaatcccgtgggtagtccctggaaacttgaatatgatgcaatggtgagccatgctacagagactgaaagctgaaacatcagatacgagacgtaaatgccaatcatgaaattgctacacaatcttcaatgtctgctaacattgtggtatagagcttctctctataccacaaatttgactatactccagatcagtagttctcagcctttatcgtgcatcataatcaccaggagggcttgtccgcgagcttgagagtttctaattcagtagcctgcgactgggtcaaataacttacatttttaacaagttccaagatgatgctgttcttgatctaggtaccacacttggaaaaccactactatagagcaatcaagctatcttagaacatttgggataaaagaaaacttaggtattcataaatcactggtaaagacacagaggttgaatctcaggccaaagatcaccaggtcaattgagcaacactgatgagactccagtctaagacttttgacttagatcagttttctgtctgcagctaacttttcaactcaatgtgcaaagcataaaatatgaccatcctttaactttagtcccttgatagacttccaaacaatgcaacctacttaactgggcacttattatggatttattgtattaggggcttgtagagagtgaggggagattccagaacagggatactaatcactttaacagaacttacactttagttaggaacaagtcaagaaaccacaaaagcaccccacgagaatatccaaccactcaacatgagttctggatggggaaaaaaacaaaaataaataaataaaaaataaattaaaaaagaatacccaaacaagtcttaaagtgggaatgatgtaagtactcagagatccaaaacagtggagattcatagagacctcagaagagtaaaaaactgaatagcacgaaataagaatagtaagttgaggcttaaagaataggatctgaaatagcaaaagtgtttctttgccaggactttgccaaaagcagcttcacagagaattttccaagtccatgagtctctcttacggaaattttgcaaaaggtttggagagaaaaatcaactcatttgtaaaagattgtattctacaatatctaatctggttaagtttttaagtccgacatcatactagaatcttccatcttaagaataggacttcagtcaatctatggccaatgtgtgtagcttacaggtacctaatagagaaacataaaataaagggaaagaattagctctgaatttagagggtttttactgaaagcattttagcataaacccaggcagtggtcccagtaataaacgttttatgtaaattttatgtgaattgctcagcaaccttctcagcaatattttattgactgaaaatgccaaatctgaaacatgttataatagtcccaagaaagcattgccaagtaaatggtaaggaacttagcttctatttctatttcttaatataagaagaagagcttaagtcaaaggatatgctttttattttttaatatcatgtgtcagagtgtaatgccttagtagatacaaatattcatcccttctttcttagctttctcttgacatgaagagcaagtataatttattaatgttttcagccaattagtttgtacccacagcaaaggcctttgctgttttaacctatgtgctatctcttccaacagcctgactctcaaagttgctaatctagacaagcccaacaaccaacatttcgcattcttgtcatttcctgattaagcaacattcaagccactgaaataaatatatatatttgaaaatgagtctccttaattacctcattgaaatttaatgaaagatctcaatttgtaagattattttcactttccaacagcgcacatccgtgagatatactgagggagaatatatgaaagaacagacaagataaaatgtttttctgcaccataagaaacataaaataaaaagatattcaagaaatgtttggccaagcgcggtggctcatgcctgtaatctcagcactttggggggctgaggcgggtggatcacttgaggtcaggagttcaagaccagcctggccaacatggtaaaaccctgtctctactaaaaatacaaaaattagccgggtgtgatagcacacgcctgtaatcccagctactcgggatgctgaggcaggagaatcgcttgatcccagggggcagaggttgcagtgagctgcgatcatgccactgcactccagcctggccgataacagtgaaactctgtctcaaaaaaaaagaaaaagaaaaagaaaagaaatgttttcctggccgggcgcggtggctcacgcctgtaatcccagcactttgggaggccagggcgggcggatcacgaggtcaggagattgagaccatcctggctaacacggtgaaaccccgtctctactaaaaatacaaaaaaaattagccgggcgtggtggtgggcgcctatagttccagctacttgggaggctgaggcaggagaatggcgtgaaccagggaggcggagcttgcagtgagccgagattgcgccactgcactcccgcctgggcgacagagcaagactccgtctcaaaaaaaaaaaaaaaagttttccttgcgaggtctctcgagttacacaactgcatcttgtgtgtacattcttgcacaatttttataactttttatcaataagtactctgaaaaaatgttatgttgaagttatcaaaaatatcttggctggctaaaagtattacataacaatatcccctggtgtgtacaaactgcaccagatgtaatttaaatttgtaattaggagcaacactggtttgacagaaaaagaaatgcagttaagagcaaaagttcggaaagagaaaattaagtgaaaaacataatttcaagcagaatagtagacatgtaaagtctacagtcctgcaaaaagttgaagttttcatagttcaagaaaatcttatccttgggtatatataaattgaaaaaaaaagacttagagataatcaaaggcatttcgatacttatctttccagataagacattccatattggtttttgttacatgaccttcaatgtaagaatcagaaacttactgttttcagtcaacattgagtcaaaacttttgaggcatttaggtttccaaaagtttgttcatacatagatcaaattcccaagaataatagaaaatgacaagaccaggccgagcgaattacccttgacccctaagcctatattataccacccctgatcaagtattccacatctccagtgtggaaacatttatgaattgtctttggcctcagaaactacagaggctaagatactgtctgcacacccaagaagctgatgtgtaattgattagttctttcatcagcacaactcattgcctctgttagacggctgaatacagacacagtgggtaaagacagataaataagcaggaaatcatcggggcctttgtttataggatgcctttaagaaaatgagaggcatacacacccaggatccccatggcttactgagatattgtaaattcatgcaaactagaaaaaaagtgctgcttctttcaggtggaggtaatcccacactaagatacatggtttggtatgtatctcagccacaaatcacaccttagctgggcaagtgtgtgtagtcaccaatctgcacaaccatatagaatcgacctgagatgatgtatttcttcacttaaacacacacacacacataagtaaaagccacacaaaaaaaagttagcaagaaggagtcacactaaagatataaagagtgtatatgaagtacaatattgtagagactcaccatctttaagaggccaaaaaccaatgatgggaccatcgttgagatggagaccaactggtaggtatacttacaaaatgtcttgtaactacttcctcagtaaaaataactgtcagaaattcatattttcagaacatagagatgtcaggtctgggatttgattggattccacttacaagctaataagttagcctgttactgtttcacagacactggcagaagacatgaaattcctggatcagagtcaaagactttattactgatggcacagtaggcagcatgagcaccagcttatttacatctattctctctggcctccagtcttatgatgggcgcaacaggatggatgctgcacacatggtgtgtttgcattgcagctgataaaatccttcgggaatacaccatttttacagcagatagtaagtgagcctggtctttgtcctgggagaacaaaccttatctctcaaggttcccagctaaataaataactctaagaaataggttaaagagtggtcttggcacatccaacaaaacgtaagtgtacctgaggccctagggggactctcttttccagcaagagaatatttagtattaacattcatattaagaatggcttaatgataaataaattgatattggcagaaaaaccacttacttatgaaatgtgctatatattttctcttcccattattattattaatagacttagaatggattatgtttctgtctcaagccttactcaaggttatctataacttaaaggaaaaaaccagaaatgcaagacatagtgatgtactccaaaatctgtacatagaacacttagaaatgaaattcatgttttctgattttgaaagaaacatacttgtaaaagaaaattcagaaaactattttaaaaacatttaaaagtcacatataatcccacctctcaaacaccacaattacaattttatttgggtgaatttacttttcatctatgctctatacatattattacacagttgcaaacatattttaagtacagctgtacatcctgctttcatttataagtggttttcctaatttgattatatatgtaacatgcttaattctcaatggctatgtagtatttcatgatattggtgcatcatataaccactcaactattgcaactgtttcaattattcactattataaataatcctacaggatgtacaaagcataatgctttcagcagaacattatccagaagaaaacactaacagtcctctgaattcaatactctgaacaggaatgtgggctacatttaaacttttcttccttagatatcctatttacatttcaaaaatctgagacaacataatcatatgattaatttccactcttatgtgtgacatcctttattctttaaccaaaagagatgtaggccctacccaacattcactctcacttcctccttgctaatagcacttctgtattattcagacagagaatgtgcccaattaaaagactacagccaccaaccttctgtatagttaggtaaaattatgtgattaagtttgagaaattgagacataagtggaagtcacggagagagatttctagaaagcctcctttaagtggtggtagacaaatagaaaaagctgttttgttactttccttcttcctggaaggttgatgtggtagctggtgctcaagcaaccatcttagtcaatgaggcaacctgaatatggaagacatgatcaggaatggcagagcagaaagtcagaagcagtctggtgctctgtgaccatgaaaacaccacatcagtggtaatccgttgctgtactgcccaacttcaaaccctaattctgttatttcctatctgtacaactttgagcagattattcagtttttctattttttcacctgtgaaatcgggataactatccacttcataggatataaagtgctgtgaaccctgaatatctgaggcaggcctcagttaatttataaagtttaaaggcctggtgtggtggctcatgcctgtaatcccagcactttgggaggccgtggcaggcagatcacgaggtcaggagatcgagaccatcctggctaacacggtgaaaccccatcactactaaaaatacaaaaaaaaattagctgggtgtagtggcgggcgcctgtagtcccagctacttgggaggctgaggcaggagaatggcgtgaacccgggaggcggagcttgcagtgagccaagatcacgccactgcactccagcctgggccacagagcgagactccatctcaaaaaaaaaaaagaaagtttattttgccaaggttgaggacgcacccatgacacagcttcaagaggccctgatgacatgtggtctaggtggtcagagtacagtttggttttagacattttaggaagacatgagacatcaaacaacatatgtaagatgaacattggtttagtccagaaaggcaggacaactggaagcaaaggtgggacaacgcatagcggggagggggcttccaggtcataataaataagagacaaacagttgcattcttttgagtttctgattcgcctttccaaagaaggcaatcagatatgcatttatctcagtgagcagagggctgactttgaatagaatgcaaggcaggtttgccctgagcagttcccagcttgacttttccctttagcttagtgatttggggaccccaggatttcttttcatttcacagttctgagaacaatgccagaaaataacaaatattctattatagttttccattatttgtattagatcatccctagactacctaccttcagacttattttatgggagagaaataaagaaagccatagatacttacttaagataactaaggggacatctattgcattgtatgtaattataacaactatatataacatatatgacatctattttatatgtaacaacttagccctgaatcactaggacatctcctttcttcatgctgtgactgattccctttgctgcatcttctttcataaatatatatcattaagttttttctaattatttctttatatccctgtttctggctcttccttttaacaactgtatcctggttcctgattctttcctttgaataataaggaccactgcatgaaacaaagtagtatttataaataatacatcttaaaaattagtacatattttttctcctgtaaatggtagcatgattctgagcccaggcttttttcattaaattatgtattaacgtataacgtaactacagaaaacggcacaaattttaagcatacagcttcataagaaaagttcttttacattctccaggttccaaaagagaaaaggaaaaaaataacaataggcacaatgagctttagaatatcacctaaaattgtatttcccccaatgttttaagaaattttaagccggtggggcacagtggcttatgcctgtaatcccagcactttgggagactgaggcgggtggatcacgaggtcaggagatggagaccatcctggctaacacggcgaagccccgtctctactaaaaatacaaaaaaaaaattagccgggcgtggtggcgggtgcctgtagtcccagctactcaggaggctgaggcaggagaatggcgtgaacccggaaggcggcggagcttgcagtgagccgatatcgcgccgctggactccagcctgggcgacagagggagactccgtctcaaaaaaaaaaaaaaaaaagaaaagaaaagaaattttaagcctaacaagcaaagttatatattattaaaatgaatatccatatactgtttacttatatttaccaactgttaatgttttcccacatttgctttttctcttttaaccatatgaaaataagctgcagggtcataacacatcatccctaaatattttagcatgtatctcctaaaaataaaaacagtctcctacttaaatataataccattatcacaccaagaaatttaacattaatattgcctaatagtctatattcaaatttccaaattgtttccattttaatattcttccctacctttacctcatcctagatccaattatggattacacatttctatggtttgacatgtgtttgtagactcctatgagctcagacaatttccttgactttttttttctttctttcatgactgacatatttgaagagttcaggtaacttttcttatagaatgcttcacaatctggatgtaaggaaaagattatttcctcatgattcgattaggttaaacatttttagaaagaatactagataagacatgttatccaagatgccactgtgagaacaaaggttgtttccttgtgcaactaaataataagccaaagtgaaaaacaagatccgtctatatgatggagtgcaatcacagtttaaaacaaagattagaaaaagagtatctgtcacattctattggcaatagaaatcaaagggcattgtattagtccattctcatgctgctaataaagacatacttgagactgggtgatttataaagaaaaagaggtttaatggactcacagttccacatggctggggaggcctcacaatcatggtggaaggcaaaggaggagcaaaggcacatcttacatggtggcaggcaagagagcacgtgcagaggaactgccctttataaaaccatcaggtctcataaaacttactcactttcgagaacagcacaggaaaaaacagcccccataattcaattacctcccatgggtccctcccacaatacatggtgattatgggagctacaattcaagatgagatttgggtggggacacagccaaaccatattaggcatcatggccctaggttttctacttggaataaagagtcaaagagtgcaatctgtactttagagatttctttacactaaactctttgaagtgtttatttctaagggtcagaattgcaggggactttcacattctgtattatttttgaaatgtttgagtttttataacaagcagatatgactttacttttataatcagagaaacatattctgaagatttttaatagagaaatatttaatataaagatttcttatagcaggggctcagcttttcttacaagattaggtagcataggtttctgctttcactagtaccatagtaaaacaaacaatgggcaatactagcccttgagttttaatgatggtaaacatcttcagtttttctacaggactttaatggattttcttttaagtcttcatatttgcagggggtgggggacagggaattacaaacattacagaacaaaggaaccatcatcagccgattctctgatatagaatagacccttcaaatgcagtcatctccctttgattattttctttcctcttaagcttttgtttcagattcaaatacattctgaatagatgcaattaaccttaatatgtataaccttacagcactctactgactttgaagtaagtaaccttactgtgtaattgaactaagtttctttctcatttctgctatggttctactgattattgttagtaatatgttttcaagctttcatcatcctgttgatttattgtttcaccgttccagctgccaaagactttttagcaattcccattcatttttggtgatattgtatttgaacaaaaatgattgctccccaaggcttggcagaccacaaatgcgtaccatactgaggaatggaatccagtgcagaaaagttggaaattccttctaaacaggaccataatttctaccgtcctgcacaaacaggaatgtaaatttgatctaatcaaaccaaaatgtttttttcttttcatccactctgtctcttctgccatgcatagaactgtgcttttcaaactgtaggaggtaaccctctaatgggttatgaaatcaattcagtggatttatttttaatgaacaagaatagaaactgtcagagtacatcacatataataaaggtgaaaattgttttgtgaaattttttcagttatatataccctaatatatactcagtcaggtactaggtcatgatgtcaaatgaattgctcactgcaggctatgatcagaagtctgaaaaaaaaatcactgtaagttactatgttgttgaggttgcacagtgagagtgagataactgctctaatgtcagaggtgtttgaaccagagagattccaccttgaataggggctgggtaaaataaagctaaaacctgctgggctgcattcccagacagttaaggcattctaagtcacaggatgagataggaggttggcacaagatacaggtcctaaagaccttgctgataagacagttttcagtaaagaagccagctaaaacccaccaaaaccaagatggcaacgagagtgacctctggttttcctcaaagctacactcccaccagcaccatgacagtttacaaatgccatggcaacatcaggaagttaccctagatggtctaaagaggggaagcatgaataacccaccccttgtttagcataaaattaagaaataaccataaaaatgggcaaccagcaagccttggggctgctctgcctatggagtagtcactctttattcctttactttcttaataaacttgctctcactttgctctatagacttgccctgaattatttcttgtgtaacatccaagaaccttctcttggggtccggatcaggaccccttgccagtaacactaacacaaggctaccaagctcacctgtcatttgtgaaaagcagcagaacaaagggaatccccagagaaacttttctcctgcaaagtacttctctattcaaatcattttaaagctatgatggggttcacgacatgttatcccaaaatatagcaccttggtatttgagaaaacagcaaaaggaggaaagcctctctgaccttctcccatctttttcccctgaagcaagccataaaaaatttctctgaccttcctctaaggtaggtcataatatcctcatttcagagggatcctccctcctccctaaacccataggaaagaagtggagacatagagacacaaagaatttgaacaaacaggacttgctaagcttccccagtttatgtcattagaccatactcctttttgaccaatcatacttctatatactatccactcttcatcaaacctaagcataaaaagacacagttttccctggttctttgaatcttcatttttggatgctcctatgtcctataaaacttatgttaaatgaatgggtatgcttttctcttgttaatctgtctttttttatagggatatcagccatgaacctagggataggtaaggaaagaaatcttcccctctctgcaactgtaaatgtcacattactgcttcgatattaccactctctttagcctatagaacttctcttttcttaatgtcaatataaaacaatgatagggctgggcgcagtggctcatgcctgtaatctcagcactttgggaggccaaggcaggtggatcacgaggtcagcagttcaagaccagcctggccaacatggtgaaaccacgtctctactaaaaatacaaaaattagccaggcatggtggtggacacctgtaatcccagctactcgagaggctgaggcaggggaatcgcttgaagccaggaggcggagtttgcagtgagctgagaccacgccattgtactccagcctgggcaacagagcgagactccatctcaaaaaaaaaaaaaaaaaaaaaaaaaacaatgataagaccttagctagctgtactatcaatccttctatctattctccatctgtacatcatattcaagatccaaaatttggtagatagacataggtttgaatactggttctgtcactcaaaaagccatgagatcttggaaaatcattttattttcaagactcagtttcctcatctttaaggtagcaaatggcttatcatgaaaagaatattcaataatgtacctgacatacttaacacaaggtctagcacatggctaatcatggaaaacacatgagctactaattgttattttggttttagtctctcaggggtacccagtttaatttttccagatcataactaatttactttatgctacaacaggattccaatgcttcattacatttctcatttcaaaaataagtcaaatagtagtagtattagtatctgataatcattgagacatctacccagctcattgagacatgtcattaggaagagttaaatactatctgttgctttataaactttctgcatgctagagattgacttaaataatcccctaatgaataaccatctatattgagccatcaagattactcattacaatcaatcacagatactatcttccaatgtactattatttcataacattaaaaggaactccagcattacccaattctccatctccagggaagaatactagactgatgcattcaggccacttagcatctataagcagaattttattctcataatcatatagagaaggaaattgaacatctgaacattgcagtgaggaagaaatagtgaaaacagttctaatatgctctaataagtttgttaaaacttgtacttcatttcagaatattttatgtggcttattcagatgcaaataatgtgagtcaaaatgacttaagttctgtctcagacataagaaaccatacttcaggattgcagaaaatagacactaaatagtgatattgataaaaatttaacactataacttagtgactttattattgtatatcccaccttgtattccatcttataattacaaaatactttacaaaatttaacaatgctttttaaggagaaaagagaaaaatcaggattggccatgatgaactgctcttatcaaaccatcatttattctccttttatctcccttgagagtttggggatgaagagaaggattacaaagattatttccttccctcaagcataacaaactggtgggacgcattaaggttggatcaaggaaattaggaaatgtttttctgggccctgaaggaggaaatgagaaaaagaatgggtttccccaatctgcatagacagcatgccaacaacagacataaataagatgtctaagtgttgaggttgcagtagggtgttttagagactgtattagtttgagtccttcagaagctgacaccaagatggggttagacaagcaagagatggataagggggaatgcttgtgaaggatgaaagtgggagcaggggtagggaaggaaagctttgagaacaagactaggtctgattactattgccaaaacctaaataaaagacagtgagagaggccctcccaaagaaaatcatatttattctggattgagcattgcaatgggaatacagtgggtatattcaagaaggcaaaggaagacaaaggttttttaaggaaaagtgaggaaaggagggtgatacaagttgtttgagacaaatatccttggctacaaaaatcaacaagggtagaatcagtccaaggctggacagacagttgctaggcagatgtccttgcagaagtactttttgtgtaaggttgtagcttttgtgcaaagttgtagtttttgcagagccttttgtgagagttcttgttatgaggcatatgtgcatgagaatcttcccttcatggccccagctccacgtgtttgacacaagtgacctcattttgagtctgacaactttcattctatgaaaggaccgaaggaaagaggattgagtagcaagatcctcagtgttatacagttctgagaaaatcttggacacgaatatggggagtcttccagcaaaagttgcctaatagaggagttctgcatgggccaggaataggctagcactaaaaccatcccaagaaaattgtataaaattgagcaagagaaaaacaaaacaataaaatccaaccgggcttgcagcagcaatcattaagccagcttgccctttggtccacttccttgtagctggttgttgctcactagcccagctttgagctgtccaatggacaaccccagattttctagcccctcaccctccatgaatccccttaaaaacccttgcccagaacccatggaagaaacaaacttgaggcttgagaattcctcctgtttcctcactgagaatgtcgcgatgattaaactctttctctgctgcaagtgccattgtcagtgtatgggtctgttgctgcccagagggcgtataagcctggcagtcctgcaacagcactggcaccctggaatgctcagccattggctgggatgggtgcagcacaagccagcactcacaggcaaggtgtaatggatccaaaagggtggcagctggggccgtcagctgactatgctccccactgtaagttcttctgaagacaatctgaataacaagtttctctggctgtccagaggccatttaaactcctgtgacataataaaaaataaatatttagccacggtccctggttcctgggacagagctccccaaacccttgggattcccagagtgctaagtgtcttttttatgctaatgtctgttggtgaggtccctagacagctagcttaagagactggtagctagaaaaaccagctatgcgattggggggttaaaactttcaacccctggccgggagcagtggctcacgcctgtaatcccagtactttgagaggtcgaggtgggtggatcacaaggtcaggagttcgagaccagcctggccaatatggtgaaacctcgtttctactaaaaatacaaaaaaattagccaggcatggtggcacatgcctgtaatcccagctacttgggaggctgaggcaggagaattgcttgaatctgggaggcagaggtggcagtgaactgagatcacgccactgcactacagcctgggtgacacagcaagattccatctcaaaaaaaaaaaaaaaaaaaaaaaaaaacaacttgcagccccatctcagtttctggggagaggcgggggctggagatttaatcaccaatggccactgatttaatcaattatgcctaggtaataaagcctcaataaaagttcttgaactataaggtttgggggtcttccaggttggcgaacacatcaaagtatctacctagagtatggaaactcttcacaccccaccacctaccccttcatctcccaaaagatgccttacgcatctcttccacttgactgagttgtatcctttatgataaacctgtaatcataaatatagtaatttctgcgagttttgtgagtcactctaatgaattatcaaaactggggaaggggagatgcatgggaacccccaactttgtagtctggtgggtagacatacaggtagcctggagactccatttgcagctagtgtctgaagtctgaagtggggggcagttttgtgggactgagcccttaatttgtggggtccacactaactctgagtagttagtgttagaattgaactgtgggacacctagttggggtcacagttagttggtgttagaatgacatatttgatgtcaggaaaaaaaaaaccacacaactcctaatgatcctgtagaccaaagctcaaacgtcacctctaaggaaagatcttcctgctcccaagaccagctgagaccccagctttccttgcaagcttgtccagcccagggcccacaaggtgcatgtagcccaggtggctcaggatggctttgaatgtggcccaacacaaattcataaactttcttaaaacattgaggtttttttgcgattttttttttaagctcatccactatgattagtgttagtgtattttgtgtggggccaagacgattcttcttcccatgtggccccaggaagccaaaagattggatacccctgctttaaagtatacatatttgttcacatattaataaatgtctgtcccatcaattagacagtaagcttcataagggcttattttgtgttgaatagttatttgttcctagtttttaattagttcttttaagctagagatcctctcattccatggtggttatgaggattgaaagagttagtatacatagtgtgcatttacatactagctactacgtaagtgctattattattattgctcatgttgaagtctctacaatactaatacgaagtaggccacaaaaatgttaagattaacataatttacatacaaattcagctcaagttaactgtaaaataaaattccatattataggttcattttcaaaatatatttttattttcttcaaacagcatcaagctaaaggaccaggtatggttagacaagtacatgaatgtgaattcaaccctatattaccagcacaggcaagaccccatttcccagaattggataaaactaggtaaatgcatgtctttgtcttatatttatctagaggtgatataaataatgtaaaatatttacaaacaagcagaatattaaaaggaaggataaaggtttactttggattagaagtttgtgtaagcttttttctcttttaatttgtgtagacagctttgatatttaaggacaagacaaaaatcaccaagtaaaaataattgggaaagccagtatgaattagtaaatacttataataacttaaatccaaattccatcaagaactcaatcttggccaggcgcggtggctcacgcctgtaatcccagcactttgggaggccgaggcaggcagatcacaaggtcaggagtttgagaccggcctggccaatgtggcgaaaccccgtctctactaaaaatacgaaaattagccaggcatggtggcatgtgcctgtggtaccagctgctcaggaggctgaggcagaggagtcgcttgaacacgggaggcagaggttgtggtgagctgagattgcgctgttgcactccagcctgagcgacagagcgagactctgtctcaaaaaaaaaaaaaaagaactcaatcttgtctgagagtctatcagaggtactcagaataatttaatatattgatagccacagatttttactagtatactttctttctatgcaaataggtggtttatttatttatttatttatttatttgagacagggtctcactctgttgcccaggctggagtacagtggtacaatcacagctcactgtagtcttggagctcctgagctcaagctatcctcctgcctcagcctcttgagtagctgggacagaggtatgtgccaccgtgcccagataatttaaatttttttttttttttttttttttttggagagacaagggactccctatgttactcctggactaaagcaatcctcccacattggctttccaaagtgctgaggttacaggcacaagcccctgcgcccgaccacaagtaggtgttttaaaccagtgtttttttttaacaaggcacaaacattcgacttaagggtgacagcatagtactttaccaggaataaagttatgttttacacatatacacgtggaaaaattaaaaccctatgaagttggtattgtcttatattaagtaatgaggaaactgaggcataaagtagctaaggattttgttcaaagagcaagtgatggcataatcagaacttgaacccaggtctacccagcatcagagcccatattcctaatccccacactggggctgcaggaggaaattaatggaaggattcccacaaaacaagacaaatcttttaccatataaataaattcacattatgagtggacaaatgaaactgtactattaaagcactttatcctcttttttcttttttttttttttttgctttttgttttgttttgttttgtttttgagacagagtctcactctgtcgcccaggctggagtgtagtggcgcgatctcggctcactgcaagctctgcctcccgggttcacgccattctcctgcctcagcctcccaagtagctgggactacaggcgcctgccaccatgcccagctaattttttgtatttttagtagagacggggtttcactgtgttagccaggatggtctccatctcctgacctcgtgatccgccctcctcggcctcccaaagtgctgggattacaggcgtgagacaccatgcccggcctcttcatttttttaaatcagaaagtgtttctaatttttatccccaaaataaataaagccttctttattttggggcagcgggtaggcagctaattctactgagatatttgccattcattttccttggttttccaacttcattaaaggaaacaagtgagaaagtgaatctaagtaactaatggagatgcaacaaaaattcaaagtcatcccaacaggatctcagacatcaaacccctaaaagggaatatataattctgtacttactgcaactggttcacatgaggaaaaaaaaaaaaaaaaaggaagactctgtgagagataactaaacacttcctggtatttttttaatggttcatttgaaaatcttttcaggaatcgcaaaatagtgtacagtgagctcttcagggtattaaggcctggataacccatcagaaagctgcctctttctgagcaatttgatctggcaagattccagggtaattacaaccaaataagaaaacagatgcaacagttaatacttatgcgatgatatgagcttagaaataaatggttgtatctaaataaatgctttttaacagaaaaaagtcatgcaaatcatgttcatcgttaactattcatggacacgagaccatatgtctgtgacctttgttactgttaagtactatagcttgtagatacgtgggttacttgaaagtaattggctgcttctactgtggcgagacactaattattctgaggaggaaagaaatgcaacaatctctaattgatttccagattatccaccccatctaagggtaaacctaagctaaataataatattaaaggcctggtactttccaaaagctaagggatgaaagaaaatctactgtttatcggccataaggttatatactgtttcttagcaaccagggtttgtctttcagagactagaagtcgatgaaaaaggagagactaaaaataaaaccatctggacagttccaattcacagaggcagcacttcaaaggcagtgatgttgtgataaaccatactgttgagttaaagttcattccattggctagaaagagaggctcatgacacttgcttaataaatgtttcccggatactcactgcagtccctgaaccaaagaccaggaataaaagctacctatctgttcctgcatagagcacatatcaacatcagggatgagaggtactatggtcactcacctcctcactctctcagctccactcctctggttgtaagaggctagtttatctgcgagtcttgctgggacgtaggcttgctcctacctagaggcagaatttgaaccttctaccccatatcacatttcttgttgacccttacctgttagtgtctgatacagtaattccgtttaggacaccaagttttgtttttctgttttgttttgttttgagacagtctcgctctgttgcccaggctggagtgcaatggcgcaatttccgctcactgcaacctccgcctcccgggttcaagcgattctcctacctcagcctcccaggtagctgggactacaggcacgtgccatcacacccagcttattttttatttttagtaaagactgggtttcaccatgttggccaggctggtttcgaactcctgacctcaggtgatctgcctgccttggcctcccaaagtgctgggataacaggcttgagccaacgcgcctggcccagcaccaaatttttaaaaacagtaagggaaaagttatttccatactggttggagtatgagttctggagatacctggaaaatgacatcttactggatgcctaggcagttccgacacacccatatctttcaatcctgtagccagtcacaaaaatcaggaaagtagtattcctggaaggaaccgggctggttatttaccaaaggactgcaaactagccgactcaatttataaggtgcggcatggatactttcatttaagcaaatgagctttcattcagtcaaaatccctgttgttgggcccctgtggttttaaactccaaggaccaaggtgcttgtgagtgagtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcgggaggcaggggaggcgccgagcccggagttcaccactctattgcgggtgttcatggttcacagcccgcgggtcccgggccgccgtcgctgcgggagggatgcggctgggacgcttagcgagtctcaagatgggattccaaagtgcagaggcagcggttttaacagctgagtttcggtttctcagaatcagcagcagactgcgcccgccccagagaacttccccacgtattctccactgaggccccgtccgaccttatcgcgggttaacagcccaggatgttgacttgagctggcttggtcggctacaggtgagacggtttaaagtctcacaatcaccttagaggttaatcagaataactgggatcagccacggacacctggtgagcgattagcccgcagagtgactacaatcctgaaagatacttgagaaactgtttaacaggcaactctaatttgaggttaccgctggatatttgagactgtaaaaaatatattaaccttaaaataccagagattaggtcaataactaaaatcatctcaacaaaatgtcgccttttatcagtaatgactgctgtgtggctgttaccaatgcacatactttcaagttagaggaaatggaaactgaaatcaaaagaaaacaaaaacctacaaagccggagaagtaagctaaggtagacatgattctccaggcagccttgctaagtaattgactagacattcgagaactattaaaaatacctgctctgtgcagaacagtgtgcaacggtgatgtggggacattttaaaatatggatgtgtaaggctcagttcctgtaggttcaggggtgagctctggcattcatatttttgaaaagctcccagatgattctgatgtgtgccagggttggtcaccagggtcacaatgccgtctacacaaagatgagtgaaggctcttccctcatgctacctgcattctaggagtatcctagtagacaggtaaacaaatgggaatgccactttgggataaatgaaatgacaggcagctgtggaggcacagagaaactggggattagccctctgagtaattcaggaacagggacatttgagaatgagccaccaaagacataggaattcaccaagaagaaggagatgctatggcagaggcttgtcacttaaaatgacatggtgtgtacttaattccaggggttgtcatgtggctggagcaccccagtcctaggtcagcaagacagttaggagctggactgtcttccttatattattggtgcttagaacaaaaagacacatacaggtttgatagctaatgaaagaatgaaattgaagggtgggccagggtgggacaggagaggagaaaataatgacaaggaacatggtaggaaagtcagtcaggatttctatgccatcctaagacattagggttttgtagagtaggccagagtttcacaaatttcagtaagcatcagaaccacttggaggagggtgcgttaaaacagatttatggccaggcacggtggctcactcctgtaattccagtacttttggaggccgaggcaggaggattacctggagatcaggagttgaagaccagcctagccaacgtggcgaaaccccacctccacctgggcgacagagagagactccatctcaaaaatatatatatatagtttctgattcaggtctgggatggggcccaaggatttgcatttctaacaaatttccaggtgataccaatgatgccagtctcaggatcaccctttgggaaccactgttgtaggcaatgtggaaggcacaggaagtttttcaatagggcagttactcaataatatctgttttacaaagttagcttctaacaatgtgaaaacggagattgaaagatgaagagactgaaatcgggaagataaattcagagcctagttacgtctaggtaagaaatacagatctgagctaaggcaacccagaaagtggggagcaaaatcaagacatttcacatgggccaggctcagttgctcatgcctgtaatcccagcacttttggaggctgaggcaggaggatcacctgaggccaggagtttaaggccagcctgggcagcatggtaagacctcatctctacaaaacaaataaataaaacataaaagacatttcacatgagagattagcatagataaaaactagatgaaagagagaattgagtactggaaggcagcagagagaaggggagatggcttttatagtgctttgagaccagctttgccacatactggccacacaaccaaggccaaatctcttaattcctcagagatccagtttcctcctctgcctcatgtgggtattgtgaggaatagagatcatccacatcagtggttctcaaatggagttgatttttcctctagcagacatctggcaatgcctggacatatttttgattgtgaagcctcaaagtgggtaggtgctgctagcatctagtgtgtaaaggccggggatgctcctaaacatcctacaatgcacagaataggcccacatgacaaagagttgtcctgccccacgtgtcaacagtgttgaagttgaaaaatcctgatcttcacagtatgcctaccttatagccccagtaatttaatggttgctgtctttatggtgacttttagctttgtgactggatacgaggtagaaccattaacctagaggagggacaagctttgagggaagttctaaaagtctgtttaggtgctgttgggtgtaaggtaccagcggggtgagaaacgcagacctagagatcaacaaaaaagaggaacagcagggcctttctggaggccatcttccacattgttctttactaggaaaatacccctggaactcttgtttcaaaggagaaaattattttggtggttggatgaaatttaaagtttgaggaagggaaaacccacactgggggaaaactgattctcctaaaggagctagtaatagggatgttggcctcaagaatatacttagttaaccatatttgtttcacaacacaaccacatgtcacaccaaagtttcaaacctgagatttctcactccattcacttcttgttttacctgagatttctcactccattcacttcttgttttgccacattctcaaagtgttttaaaaaatgtgaatgtgaggctggatgcggtggctcacacctgtaatcccagcactttgggaggccgaggcaggcggatcacgaggtcaggagatcgagaccatcctggctaatacggtgaaaccctgtctctactaaaaatacaaaaaattagccgggcgtggtggtgggcgcctgtagttccagctattccgaaggctgaggcaggagaatggcgtgaacccgggaggcggagcttgcagtgagccgaaatcatgccactgcactccggcctgggtgacagagcgagactccgtctcaacaacaacaacaaaaaaaagtgaatgtgatttattatggcaacagacatctacaggctccttttggatgcccgagaatgggctacttgtgtatcatccattctttcaccgtaggtgtgtgcatttgggcgaaaataagggctggccttttactggagttgttcttgggtgcgtttttctatagtagtggctggtggagagaagcagaggtgagtggggagggtcctgggcccctatccctatttagccaagtactttagccccttatctcttctactcactaggccactgcctaattttgtttgaggcaagaattcaatggcttttaaaagtttgaaaaaccaccatactagacaattacctaggaatatgttttaagagacatgagaaagaagtgaaatctagtgggattgttaccttacctgaaatttggccaattagagattcatttaggaaatgtttttcttttcaaatgaaactgcctctgggaaataatcatgtattcgttccttttggtaaatgagtttaatctgagcaaaagacattttggctggggaagaggagaactgagtgaaaagaaaaaggattccaaaagttgtgtaaagaaaaacataaaatgaggcattgttggggaatggaaattcagaaatacaatgagcaattttagccagccctatgagctttaagagagaagattaaatcaaaaagaaactttaccaatttattttactgcaaacatgtctaagtgtgtcttctttcaagaaaataaatgggaatatatgtctgatttttaaattaattgccttagattactcctgcattaatatgtacaaatatagagagagatacataaactctaagacttttcttgtcataaaatgtgtaaatgaaaaaaatcttagtttttgaaaattctaaaaagtcacatttccttaaatttgattcttcagtggaaagttagattaatctaagagatttaggacagcagttatctaaaggttttttttttctcttctaacaaaggagttatgtaaaactctgaatatttggtatctcctcatttttagtgtgtgtgtgtatgtatgtgtttgagcatacctgtattgtgacaactccatgtgaaattcttcaaatcctaccatagaattgtgaaatggtacaattatgagtcaccataagttcgtacaggaaatattttttgaatgacaagcatgtatcattctttgcatcataccatggagctacagtggtaagcagacagaatcttgttattccaccttcatatttaagagcatctaaccactttattctaaacaaggagacagaggcttagagaagccaaatgactcaccagcactgcgcacaaactagtggcatagctggaacataaatttaagttgtccgagccccaagtgtagcttttcatattttggaagatgattgtgacaaaatgtctcttttgacaaaattcagaattcggcatgttttttacttattataattatcccaatgagcagctgtgcattactttctaaaatcaaaatgactatgccaaagtttctgaacctgtcagaatcaacattaataaaaaccttaacactccaatatttacccctataattacacgatcaaatgatctctacaatgatgctgttttatacaacttgtcaacatttcatgaattgcaaatatgctacatttgggctaaaaggccttttctttaaccgtgttaaaatagtgagccttatagtgtagtgcaaagaattctacttaagaatggaaagatacactatttttcggatgacaatgtgtactgtcacttggggaaatgaggaatgtagaaatgtgctttaaatgatatttcctaccctcagataggtggctgaatttccttgtttgtaaattcaaatctgaggagtaggtaacagctgccatatctgggttctaacactgtgtagtagctgtcacaagatctctgctagctgcaggaatggaaggaatttcccttaactttggggaaacttctgtagactcagtggcgttgacagggagattaccctgaagggtttctttagctgtgataaatgaatcaaacagaaactctctaaagtcctcttcattttttgtgtgtacttttttttttttttctcatacaaagtctcactctgttggccaggccagaatgcaatggcatgatctcaactcactgccacgtctgcctcccaggtttaagtgattctccagcctcaacctcctgagtagctgggattacaggtgtgcaccaccacacccagctaatttttgtctttttagtagagacggggtttcaccatgttgctcagtcaggctggtctcaaactcctgacctcaagtgatccgcctgcctcagcctcccaaagtgctgggattacaggcatgagccatcgcagccggccttaaagtaccagttatttttactcaatatctgttccttttccaatgatgccccttcttagggaactcctaactgttctgatgttttaactccaagccaacacttttgtgagcttcatggtccttcgtaaatatcaccaggtatgtaagaaaacgtggtagaggggaaagagtaatggccacaaaggcagaagacctgaacttgagacctggcaaagccatttaaagagttttgtgacctcaggcaatcattgaaactctctgaactttagttgctttatttgtaagatggaaatattaatcataataacccacctgtcctatctaccttttagaagcttgtgagggccataaattgcaccttgatgcaatataagttgatgttataatttttgagttgtcaatgttagagctttatatattttttctaataatacttaaatttgtcctcaaagaattcttaacttcagtttcagtggcttttggttttaaattgctaaagcattacagagctatatctttagtgggttttttttgtttttttttttttgttttttttgagacggagtctcactctgtcgcccaggctggagtgcagtggctcaatctcggcttactgcaagctctgcctcccaggttcatgtcattctcctgcctcagcctcccaagtagctgggattacaggcctgcaccactacatcctgctaattttgtatttttagtagagacagggtttctccatgctggtcaggctggtcttgaactcccaacctcaggtgatccgcccgccttggcctctcaaagtgctgggattacaggcatgagccactgcgcccggcgagtgtgttttatcttgaaatccctttcagaatagaaataaagtagcgtttatagttttacttaccaatatagaaatgcctggcacagaatacagtttccagtgaagctggaactctgttgtcataactaggagacactgggcattccatagacattttgtgacaatgttccatcctgatatcttctggtagctaacaagagtttcatttccggggataaggccttgggttctcctgtttgacttgacttagaaaaggagtcatattaggaatttccatgacctttcatgtttccaggactgggatatagggctgggattctccacaggcacatcacatgggttagagttccagacttttcagtatagtccacagtagcccaccaattattaggttggtgcaaaaataattgcagtttttatcattaaaaataatggcaaaaaccacatttacttttgcacctacctaaatatatggctcctctccttgaattaccagtaagacagtccttgaccaagagagagtgatgagaatggttaaagtaatgaggttacaggcagtctgaagaaagtgagtagtccctgtgttatccatcaatgcaggacacttctccaggtggccatggaccaatccagttctccctcatttcttgcgcatggttgtcaacagaatgtgctgggaatgttgtatcctgagatagaaagaaacggcctgaaataacccaggccttgtttctgtccctcctaaggaatgtaacatcttgagttagagagggactgcctgggacagcccaggctttgttcctctgtcccctagaagcaggatgtccttcaaagctttgcccagtgacatggcctcaagtgcataacccagggcagactgcttttcggggtccctcagctgtgctgcaagtggggcatgcacagtcaagactgcatcctccctgggcagctttcttgagccttggggacttgttcacaatggatctgagacatcttctgttccttaccatctgtaagtagtaaaccagtttcatgtaacttgtgtgtgagtgtgttctgtctcattaaactcagacaagtacctaaccagtatatcgtggacctaaatagtagcccaggatgcagtgggcataaatatatcgactcctgtttctgatgtatggcatagtgaactttgctattctccatgcagtggaggttctcactcagggtcagcgattagtgaacttgcttcacaatgaagagcttgctgttcaagcttctggttttgtcaaatagtcctgtgtttagattttggctctactacgtacaactgtgtgactttgggcaaattactgaacatctcagggcctcagtttcttctcctgtgaaataggaataatatttacatgacctactgaatagtgttgttgtatacattaggtaagtatgaaatgcttcatatcatgtatccaacatagtatattcaataaatgttgtgatcattattatttaagctctgaaaaaacaaagtgagcagggcaaaatacttgaacaagcactttacacgcacacacacaaatatccaaatggctaacaaatatataaaaaggaacttcatttgtcacagaggaaatgcaaactataaccataatgagatatctctatacactcaacaaaatggttaaaatgaaagagaaagactgttttgggcaaagaggtgaaacaactaaaacaactctgctagtggacttgtaaatcaatacaacctttttagaaaacagtttagcagaatcatctaaggctgaacatttttatatccaagcaattccattcccagatgtccaacacaactgtgtacatgtattcaccaaaagtcttatatgaaaatgttcatatcagcattattcattgaagtgtaaaactagaaactactcaaatgcctatcaatcatagaggaataaattgcagtatattcctataatataatactacatatgaggagttatatgtttgttattctgtaagtactagttggccattatcttacttcctcaggccgtccccatgtgtcgttggacttccgtctaactcatctcacttacataacttacattagttaaactttaggctcagctgcagttgtagagaatgaaaataactacagtttaaatacatggaagtttgctcttagatgccagtccgggcatatgcaggccaggggctaggatgaggacttaatggagtcaaggatctagacttccccatttgctccactctgccttctctaccgtgttgctcttacttgcatccaacacatacacaatgtagccagtgagaagggggaaaaggatactggagggcaagttcattccctttaagggtacaacttaaagattgcatacaatgcttttatttacgtttcactggccaaaatttagttgcatggccaaacccagtcacaagagaaactaagaaatgtggtcttaactagatgtaggcatactgtagtagctagcctccaaagtggcctccaatggctcttgccttcaggcatttatatccttatgctgtttgtttcctccaacattgaacaggactatctggtgtaaccttcagcctccattaagttgactacaattctagttgacatcttgactgcaacctgaggcagaaacatgcggctaagctgctcctgaatttctgactcttagaaattatttgagaaaataactatttaatgttgttttaagccactatatgtcaggataatttgttataagcaatagataactaaaacaagaattgaggagaggaaattaaagtgaaaagagaacaggggtgggtgtggtgactcacacatgtaatcccagcactttgggagaccaaggtgggtggatcatctgagggcaggagtttgagaccagcctgggcaatatgctgagatctcttccctacaaaaaataccaaaatcagccagatgtggtggcatgtcctggtggtctcagcttgggacttgggaggctgaggcaggaggattgcttgagctcaggaggtcgaggcttcagtgagcagagatcatggcactgcactccagcctgggtgagagagcaagatcccatctcaaaataagaaaagagaatgggacgtggtgtatgaaattttagatagagtggccaggggaaatattaatgtggcctctgagtaggggtgtaaagaatgtgtgagcacaggaagagtattttgggtaaaatcatgtttatagtcaaagtgtttatcaaccagtatgccacgggcactgacaaaacagaataggtgcccaaaaaataaacactgagacagatcataaacattcatcagggcctcaggtggagccccagctgcatatcagctgtgagcagagggaaaagaagtcaaagaccctggggtgggagagtggctgtgtttgataaaccacaaaaaggccaatgtgagcagagggagagagcaggaggaaatgaggacagaaatataatataacataacatgtgggccatacagtatagtgtcatttaagtcatagtaaagcctttggcatttattctgcatgaaacgggaaatgtttgaaagattttgtggaaaggaacaacatggtgttatatgttttaacgtgatcactcgggctggtatactgaaaacagactgaagcaaaatgttatagattgaaggtttgtgtcctccctaaattcatgtgttgaaccctaacccccattgcgatggtatatagaggtagggcccttgtgaggtaattaggtttagatgaggtcatgagggtggggccctcatgataagattagtggtcttataagaacaggaagagagacagatctctctctttccatgtgaacagaggaaaggctgtataaggatagtgagaaggaggccttctgcaaccccaggggagagtcctcaccagacattgaccctgctaacaccttgatgttggacttaaagtttctagatatgtcagaaaataatttttagttgtttaagccactcaatctatggtgttttgttatgtcagcccaagttgactatgacaaaaggcaagggtggaagcagggagactggttgggaggctgttgcaataattcagatgaaaaatgatggtggcttgggccagcatggtgcagcagaggtggtgagaagtggtgagattctggatatatttataaagtacaatgaacaagattttaaaagtaagatgaacaagaacagattggatgtcaggtgtagagaaagagtcaaggatgatatcaaggtttggaatttcaatcgctggcaggatggagttttcatcagctaagttggggaaggctgtgagaggcatttctgatagctgtggtgagccagggtatagtcatgagttcatgtttggacttgttgttttgaaagcctgctaaatatccaagtggagtaagttattgaagtgcaagtgtggaattcagggaaaatgcccggattgaagataagagtttggaactcattgtcacatagagtatatccaaagccaagtgattaaatgagattacacagtagtgagtttagatcaaaaagagtttgggtggacttgtccacagctgtaaattgtaggagcaactgtaacactatcaaacgagaactagaattctctccctgctcactccactttcagaagtttagttaataagagtgcatggtttccaggttagtgagctgggccagtgttccagtggtatagggtcaacactaacagtgtaagaacagacagacatatctaaacctctaaatctgaagtccaatcaagaatattgtcatggacaagggggaaatgctgttgactagcagctggaaaatcagttatttgtcttccagatcagtggttctcaatgttggctatactttggaatcaactggcaggctttaagcatcactgaggattgggtcccaccccaggattccgatttaattggtctggggtgcagcctagactctgggagtttaaaatgttcccaagggattctgaggtacagccaaggttgaaaaccaccacggtagctaaagaacgctacagttaataagtcatcattatcagcacctttacaaccagctcctagtttgctttttgttcagaaagatgttagaagtgactaaactatgacagcatgactgctcaggaggctaaaaatagacaaaataactgggcacagtggctcacacctgtaatcccagcattttgggaggccgaggagggtggatcacctgaggtcaggagttcgagaccagcctgcccaacatggcaaaaccccgtctctactaaaaatacagaaatttgcctggtgtggtggagggcacctgtaatcccagctacttgggaggctgaggcaggagaatcgcttgaacctgggaggcagaggctgcagtgagccgagatcacaccactgcactccagcctgggcgacaagagtgaaactccgtctccaaaaaaaaaaaagtatagggagaagcattaaacatatattttaagttgttgctaagcaggtatttctcagaacattaggccaagaccccaaggatgtgtggaaacagaataacaatttgggcttttttgtttggtttgtaccacagtaggtggtgtgcagtacagcagaagaatcatctactggtttgtaagggaaggatcacaaagcatggacacagagtgtatccaaacataggcaatgtgagtgaatttagcacttttcagaagaacgtagaataggtaagcatatacaaattctttatttttatttttagtttttcttttgagacagagtttcactcttgtcacccaggctggagtacaatggcgcgatcctggttcacctcaacctctgcctcccgggttcaaggaattctcctgactcagcctcccgagtagctgggattacaggcacctgccgccacgcccagctaatttctgtatttttagtagagctggggtttcaccatgttggccaggctggtcttgaacttctgacgtcaggtgatccacccacctcggccttccaaagtgctaggattagaggtgtgagccaccatgcccagccacaaattgtttattgatataagacatttttaactgtttgaatagtgctttcagagttccttcaaacatatttctatgtttgtttgccagagtatagctccatctgaaccccactcagttgaccccaaaaaggtcacgctgttcttgtggctacagtacagggacatcatgttgatgagacaggtaggtttcgtggcacagaattgtgaaagataaaagtattttgaagagcaaacctatatcaccctaagtttcttttgctttcaataacttaacatgactcaatgtagagaggacaagcaaaatgctagaaaagtggtacagtttgtactatgtcagcattagatttggtgtttaatttaggttaagacaatccagcagactttgtcccaaaacctcgcatattcacacagaatctggccataaaaacaaagttgagacccaaatgaaaacaatgttttctatttcttagttgtttgatagcaatgtgttttctgaggcaaaaggactgggatcatcaggctgttcttcctttttagggtgtatataatccaagaaaaacgtgctgctgggttatagaatgctaaggttgagttttaaactcactgggaaaataaatgtagcaatcaaaagtatcctgttgtaaatagtaataggtggattagctcttgggtactatcaacaacctgtgcttcaaaccaaatgtttaattctggctagaatcctaaactgtgttctaaggagatgactgacactggtattttaggaatgttaaacaagaatgttctctgtattgtcttttcttcttaaaagctacatgaccttgagcaaattactcaactcttcttaaattcattttccttttctgtaaagcctctgctatttgcttttacatgatctcagggacaaatgtgattattccacatgaaaaattataaagtgctttttatagttagtatctaacaagttaacaatggcatgctggataatctgcacttgcagatagtattgtagcatgcattagtgagatggtaccatttttagagataatgtgaatgttcccaagagagtttaaagatcaaaaagaaattttacatttattacattatttatcctgatataacctgtgaagaatgttagtttttcagtttttaaagatgacacaagcagctcagaattattgtgcaataattaatatgcacacacatatttacatattgtacagtaattaatatgcgcacacatatttacgtacgtatttattgggctactgctatgtgtcagccatttttaagcattttcacctatgttatgttagttccaaaagcaggcttcaaatctaactcattaaactctctaatgttctctttactagctaactctctattttatcatattgggcattttaaaggagacactatccagcaaaaaagtgagaattaaaatatatagtaacatcatacacaaggctcccataggtatatggatgaaagatacatgcagagaaaaatgacaaaatattctttttttttttgagacggagtcttgctctgtcgcccaggctggggtgctgtggagccatctcagctcactgcaacctccacctccaaggttcaagtgattctcccgtctcagcctcctgagtagctgggattacaggtgtgtgccaccatgcccggctaatttttgtatttttagtagagacagggtttcaccatgttggtcaggctggtctcgaattcctgacctcgtgatccacccacctcggcctcccaaaatgctaggattacaggcgtgagccaccgtgcccggccaaaatattctttatacatacacagtgctgaggctccgaagcccatactccaaaatatggcgctttaacatgctgaactgaagaagcctcaaggtctctctgaccttccccactaccgcatactgtctctcctaaagcacagaatgaagttgaagttcctttatctgcctaagatccagaccatcccaaaagaacaattgtttctttttttcccctccctgtaagaccaagatacaaccaaacctgaataaaccctttcacaaaacgatgtaatctctgttccctgatccattccttctccctggtaatcccctcaacagaattcctctttttccccctcccataacttgttttgccaacacggtgtatgaacttctgaatccctgttgggggatgagtaatcactttgtggttctccctatgtacagcttaaaaaattcctgtgccttttcttgaattactctgccttttgtgagttgaatttttagtgaacctttagagggcaaaggggaagtttccctacaataggaatacattattataaatctctttcagatgactttttagaattttcaagttcagaaaattgcatacctaagaagctgatgttaatgcaagcaaacaaaggattgatattgtgaccaaatgcaggtttagccactggctgcttgcaaaatccaacaacaaggacgaagtgcagtacaaacaaggtgacttcattgtttgaagctagcagtggggaagtggttcaggctcctgccttaagaaaaccactttaaaattctcaggcaaaatgctagggtttaagaagtggggaggtggtgaggcagtacaggtctacatgacctgttccagtgacttgtgttattgccccaactggtgaatgggctgtcaccatctcaggcttgtccaggttgtcagttacctgcagccttgaggtaatctcctgtgggggagaagtccacaggcacctgattgtctcaagacccggtctctggaacttcttcttcttttttttttttttaaatttgagatggagtctcgctccattgcccaggctggagtgcaatggagcgatctcggctcactacaacctccgcctcccgggttcaatcgattctcctgccttagcctcctgagtagctggaattataggcgtgtgccaccatgcccagctaatttttgtgtttttagtagagacagggtttcactgtgttggccaggatggtcttgatctcctgacctcgtgaagcgatccgcctgcctcaacctcccaaagtgctgggattacagacgtgagccaccacgcctggccggtctctggaacttctaagcatacgtaactagataagctagcaaggcaagcttatggtggaaagaaggagagtaattattattttatcactaaaaagttaatacaaagggcagcagaaggaaaagggggaaaaatccttaaagccagggttctcagttatagtattagtttcttagggctgccatagccaagtactacaaactgggtggcttagaacaacagaaatttattctctcacagttctggaggctagaagttcaaaatcaaggtgtttgcagggttggttccttccttccaggaggatatgagggagaatctgttccatgcttgtctttccgctgcggatgtttgtcagaaatattttggcattccttggcttgcagctgcctcacagccatctctgcctctaccatcatgtggctttattccccatgtatctgtgtatcttcaaatctccctctcctttcaaggacacaagttcaccctaatccagtatgaccccatcttaacttgattacatctgcacaggccccatttccaaatgacatcacattcacaggtaccaggggtaggttttcacaggttttcaacatttcttttgggaaggcacaattcaacacacagagggtttttaaaacttttttttgctgaaacatttgagtgtaatttgtaatcacattgccccattactcctaaatacttcactgtgtattttcctttttttttttttttttttttttttggacagaatctcactgagttgtgcaggctggaatgcagtggcatgatctcggctcactgcaacccccaccccatgggctcaagcaattcttttgcctcagcctcccgctcagctaattttttgtatttttagtagagaaaatacaaaaggaatctcactatgttgcccaggcttgtctcaaactcctggactcaagggatccgcctgcctcagcctcccaaagtgctgggattacaggcgcaaaccatcacacctggcctacttcagtgtgtattttctaaaaatcaggacactctcctacataaccacagtatacccataagaatcaagaaattaacatggatgcctattaccatcaaagacacagattccattcaaattttgccaatcgttccagtaaattattcataacaaaacaaaccaaaagcaaatttcttccatgttgcattctttcttcatgatctaggatccaatctaagaccatttagttgtcctatctcttctctttcaagctggaactgttctcaagtttttccttgtcttgaataattttgatattttttgaagagtacagactcataactttgcaatgtcctttaatatgggtttgtctgatgtttccttaagattccaataaggctctgtatttggacaggactaccacagaagatgctgtgcttttctcagtgcatcatgttgggaaacatagtatgtcagtttgtcccattattggtagtgctgactattatcacttggttatgatggaacatgctgggtttctctacagtgtggttattgaataattaataaacagttgatatgcaattttcaaggagatactttgaggctatgcaaatatcctggtcctcatcaaacttttacccactggttttagcatccattgatgttttctgcctgaatcatttatgattgtgaaatagtaatttctgactccatcattccttctctacttattagcctgcattcagctgtaaggaagagctttcccttttccctttggtattcatttatacaaataagcactggtggatatttattttatgcaataggttataattcattactatcattactttgattgtcacatttgaacagtgaaagccgtttcatgctggcccctgtatccttttttttttttttttttttttaattttttaaatatagagatggggtctcgccattttgcccaggctggtctcaaactcctgggctcagacaaatcttcccacccagtctcccaaagtgctaagattacaggcgtaagccaccgtgcccagccccctgcatccttttgacacatccttatcattctttgagtgcttcttttgctttctggtataagatgttccagatttctcttgtacttttcctgcctcagccatgaaaatacccatttcaaaaaggagacatgtttccttttagtggggagtggtatttagaaaccaagatttgggtgcaaagtatactgctttttactagagtgtcattgcttctaggccctttcagaagacacatgtaggaaatatgtgtatgtatacatgtgtacatatgtctctatttctgtatctatccatatagatatctattaacccactgacaaagtatagatagtatggtagacagaattctaaaagcggatttcctgagattcttgtctcctggttattcaatcaaacattaaattaggtactgtagtgaagggatttttgcaggtgtgattacagtcccaaatcatttgaccataagatgagattattcaggtaaccctggtcaattcaggtgaatcttttaaaagcacagagtttccgccagctgggagcagaagggaagtcagttagatttgcagcgtaagaaagtttgatgtcctgttgctggctagacgatgggattagagaaatgtgatgaggaatacaggtggtctcagagctgaagacaacaagataacagaaacctcagtcctacaaatgcagggaactaaattccgccaacaatggctttgaaggcagattctttcctagagaccccagacaaaggccagcctgactgataccttgatttgggccttgtgatgccctgtgcctagaacccagctgagccctcttggacttctgacctactgtgagctaataaatgtgtgttgttttaagctaccaagtttgtggtaatttgttacatcagcaatagaaaaccaatacagatagatattgatataaaactataaatttacaccaattctaatccaatgccactgagcttttctagttttccctttttcatatctgtacctccaaaaattaataacctgattcccactatcttcaagatatttacttatttgctcaatctcctcatatgtaaacaacctctttaccatgtggatcatctccttggccttggccccacagcacacagtggttgtactggttaagtgcccctcaatcccgatcctatcacatatagtaaatcttactgtttgagatggctcccaaccagaccttatcactcacagggcctatgccagctaagttgccccgggtctatggacccatggatgatttatatttatgtatattttactttatttagcatcatttcaggtatgtaccacttcctactctaacaacattatcacttccattaatatgaaaaggattttctaagtccccattgttctaagaattgtattagataggccgggcgcggtgcctcatgccggtaatcctagcactttgggaggccgaggcaggtggatcacctgaggtcaggagttcaagaccagcctggccaatattgcaaaaccccatctctactaaaaatacaaaaaattagctgggcatggtggaggtgcctgtaatcccagctactcagggaggctgaggcaggagaattgtttcaacccagggaggtggaggttgcagtgagccgagatcgcgccacttcactccagcctgagtgaaagagcgagattccatctcaacaacaacaaaaataataacaagtattggctggatattctgaagcaattcaacatgagcaatatgacggccactgtcaggccacctttttttttctttttttttttagagagggggtcttgttctgttgcccaggctagagtgcagtggcaggatcatagctcactatagcctggaccccctaggctcaagtgatcctcccaccttagcctcctgagtagctgggaccacaggtgtgtgccaccatgcctggctttaggttgttgttgttattttttacagatggggctcattatattacccaggctggtctcagactcctgggctaagcagtcctcccaaagtgctgggattacagatgagaggcaccatgcccagggaggccaccaattttttttttttttttttggtctgagatggagtcttgctctgtcgccaaggctggagtgcagtggcacgatctcagctcactgcaaccacagcctcccaggttcaagtgattctcctgcctcagccttccaagtagctgggattataggcacccacgaccacacctggctaatttgtgtattttcagtaaagacagggtttcaccatgttggtcaggctggtctcgaaatcctgatctcatgatccacccaacttggcctcccaaagtgctaggatgacaggcgtgagccactgagcctggccccattttttaatgtggttaagtatagaagaattaggatcctgaatggatagctgaacttttactttgcctgacacttttcttcaaaatctgatagactgtctcatctggtttttttttttgttttttcttttaacgccactcaatgatctctcatgtcattttgagatgtttttgtaaacaaacatactgtgatataaaaaacatatatttagtctttgtctcagtccattttctgctgctgtaacagaatgccacagagtaggtatatttatgaagaaaagtagtttatttggctccttgttctggaggctgggaagtccacgactatgcatggtgtcaatatctgatgaggaccttcttgcatcatagcatggtgaaagatgtcacatggtgaggaagcatgcacacaagagaaagaattggggctaaatgtatctatttatcaggagcccactcccatgataatggcattaatcctctcataatctaatcaccccttaaaggcctcattcccaataccattacattggcaattacatttcaacatgagatttggaggggacatgcaaatcatagcagtcttcatccacagttcctggcacagagctcctaaaatccttagaattcctgagtgataggagtgacaggagcatcttttattactcacaagaagctcctttcaaccataccatattataaacataacataaatcatatcaaacatatgacataaaccatatcaaacatataacataaactatatcataaacatactgagtttatgataataaggtgactcttagataatggaaactaattgtcagggaagccaaccatgtgtttagggagttggcacttatagccccaccccctaaccttcagggaggggagaagggctggaaattgagttcaatcaccaatggctaatgttttaatcaagcatgcatatgtaatagaacttcctattactattttgtaattaaaaaacccttacgtttattaaaatgtaaaccctaaacaacaggatttgaaaagtttctgggctggtgaacatgttgagatgatgagaggatggggtgcccggagagggcatagaagctctgtgcacccctcctcctgataccttgtcttgcgcatctctcccatgtggctgtttataatagttatatcctttataataaactagtagtaataaataaaatgtttcactgagttctgtgagccattacagaaaatccttgtacctgaggagagggtcatgggaacctctgatttatagccagtcagtcagaagtacaggtggaaacctgggactcgcaattggcatctgaagtgggggcagtgtcatgggacaaagcccgtaacctgtggggtctgcagtaattacagggtagttagtgtcagaactgaattgtaggacacacacttggtttccaggagggtgaagaattggttggtatgagaaaaaaccccacacatttggtataaaaagtgtcgtgtgggtagccagaaatggtttttccttttacagcccatgtgtttattaggaacatactttctacacatttcttctctttttaggacagagagagaagagggaagagctgaatttgaaaaaatgtaaaacataataaattttaattataataggtaatactcagaacttgttttgctgtctagtagaaaaagccctcctctctcaactataaatatggctgagagacaaggacaaaataattatatattcacctccatctttcaataaaggcagaaagagctttccatttcaaatttgttttgttttgtaccacatgtgggttaattagataaaaccatgtcatgtgccagattcaatcagcctgaaaataatcagaaaaccgagtttggcattgtttatgctgttttggctcagctagacaaaagcacaaaatgtaaattggctccagaaagcaacatatgtgtactggtgccagcttttctttcatgggattatctctagctggcacctgagcagcagaggctgctctgggtgaccattagacaaatctacatgatgtagatacccattttcctcgattagacagtggacaccatcatgacggggacttattttactgctttgacataggccaaaactagcttgccaactattggctgtcagtcaactgaaaatacaagttaaggttaaaaaatgaacccacatttttgtttggcatatccccttgtggcttcctttaagctcatttcttgatttttaattggttgtaagattaaaaataaaggctgggcatgatggctcattcctggaatcccagcacgttgggaggcagaggtgagagaatcacctgaagttgggagctcaaaaccagcctggccaacatggtgaaaccccatctctagtaaaaatacaaaaactagctgggcgtcatggtgaatgcctgtaatcccagctactcaggaggctgaggcaccagaattgcttgaacccgggaggcagaggttgcagtgagccaagatcgtgccactgaactccagcctgggcaccactgcactccagcctgagtgacacagtgagactctgtctcaaaaaaaaaaaaaaaaaaaaaaagattagaaatgaagccctgaaaccactcctcagctgtatttccttgttgtatgcagttcagtgaaatattattaaagagaagaaggcagcgcatttcactgtcttcctaccttaaggtggttttttagtgtttcaagggataaatattttagcaagtattcaagcaatcacagagtgagaaatagtcatttcaaagacctaatcatctgactgatgatgataagctctgcatgagttggttttctcttctctttttgctgtataaactattcgacattactacacagaaaaatagcattatatgttgttctttttatactttttttaaaagaatactttctagaatattctagaatgtgggatgggtggtgatcattgtctctagtatgaattaaactcttcttgcttaggtcaccagtgatcacctagttgcaaatcttatgggagcattttatccttacttgacttatctgtgagcccctggcatttctcactattttttttttttttttttttgagacggagtctcactctgtcacccaggctggagtgcagcggccaatttttgtatttttagtagagatggggtttcaccgtgttggtcaggctgatctcgaactcctgacctcatgagccacctgcctcagcctcccaaagtgctaggattacaggcgtgagccatcatgcccggctctatttcgttttttaaaaacttactttgtttccatgaccccactctctcctggcttcttctatctttttggctttttatttgtggtttctgtcacctcctcccctctccttccactgtccattccttgagtcttggtgtccttagagcgtaatcttcactttcttttcttactctgtatatttttcctagctcagtagttgccaatgaaagaaatctaagaatcaccttggatcctcccctttccttatctctcctatttgttcaatcccaaatcatcttgactatccctttatcatcgagttcactccttggatcagttagaatgctgtggttacaaacacagaaaacccaactaaaacttggcttaaaaataaggcaatgattttctcaacaagttaatatatttaaaaaggtggagaaagggaatttttaaaataaaataggactaatatgacataatgattgtcttcgtctagtttttgttgctataaaagaatactacagactggataatttgtaaagaagagagctttatttcttacagttctggaagttggggagttgaagggcatatggtgctggtgtctggtgagggcctttgggctgcatcatcccgttgtggaaaagtggaagggcaagtaagcacatgcaaaagacaaaagcaggaggggcggagcttgctttgtaacaactcactgtagcaacaactaaccctgtcccatgataatggcattaccccacttacgaggaaggagccctcattacctaaacacctcctattaggcctcaactcccaacactgttgcattcagtattaagtttcaacacgagttttggaggggacattcaaactacagcaaccatctaccgctatgtgtggactttgtttagatctgacgtaaacaaagcagctatttaaaagttttctgtaacaatgaaatttggatattagatgacacaaaaggtgatcactaatttttattagatgtcacaatggtgcagctatgtcagaagatgtccatatttgggaggaatgtatactgaaatgtccagagtgaaatttcttgatgcgttttaaatacttaatcagaaaaaggaaaataaatgaagaattgtgacagaatcttgacaattgttgaatctggttttgggagatatgagggttcattatactattctttctacttcttcaatgcttgcaattttaaatacaaaatttaaaaaattataataaaggaaatttttactctcataactaaaaagtttagaaacggggtagacatcaagtgaagattcatatagtcaacaatatcatcaaggactcagtttctttttaatttcctcatgactttcaatggtgtttgcttcatcctaaggccatctcttctcatggtatagggaccatatatcctggtttgctagacagtctcagttatatctattgtcctaacataattatttatagcactatctttctttcaaatgtgacctcgttttggatgataaattaaatgttaaccctagtttatggttgtcaaatgactgccaactacaattagtgcttcacacttctctgttcatgtccagctaaagagagaagctgctgtcccagaaataaccaacaaaccttttctataatcccaatgtcccagaagggcaaagtgtccatccatgaaacagacatcatggctagagtgatgggatgcatcagttggcttaggtcaatcaggggccaccctgagaataggggacaaagtcaataggtgggtccatggtaggtggggccaagagggattaaatgtggagaagaatccagttaaagccactatactcctccttgccatatcttctgccagtgccctagtttagggctcagcctctcttagactattgcaataactttttagctgatctccctccttttgctttggcctatcactacgttgctgccacaatgatcttcttagtatgtaaatctgatcatgtcactgccagattcaacattttttgatgtcctgcttttacctatgagataaagtctaaatgcctctgcttattatataaagctgttcaatacttggcctttgtctagttatctgtccaccctcatccatcttcagtcgtttctttatactttaaacttcagcaaaactgaatgactttagtattgtttacatacaaggctttctcacacattgtttccccaagtctgcctcatatttatcagttcagcaaatttgttttcatccccccattgtcatcttgatgctggcttctccgactccttccttgaacatttcaggcccgtttttggtgcccactgcactttgtcatacagtaaagccagcctcttttctgaccagaccaggctagtggttggtgggttaattgaaaaaccaattaaaatctgagatcacaacaatatacatattttaaccttttttttttgagatggagtttcactctcatcacccaggctggtgtgcaatggcgcgatctcagccccctgcaacctctgcctcccaggttcaagcaattctcctgactcagcttcctgagagcctgggattacaggcacctaccaccacgcccgcaaatttttttttttttttttttttttttttttttttatgagagggagtcttgctctgtcgcccaggctggagtgcagtggtgcgatctcggctcactgcaacctccacctcccgggttcaagcaattctctacctcagcctcccgagtatctgggattataggcgcccaccaccacatccggctaattttttgtatttttagtagagacggggtttcaccgtcttggccaggctggtcttgaactcctgacctcatgatccacctgtcttggcctcccaaagtgctggaattacaggtgtgagccaccgtgcccggccagtaatttttgtatttttagtagagatggggtttcgtcatgttggccaggctggtctcaaacccctgacctcagatgatccgccttcctcagcctcccaaagtgctgagattacaggcgtgagccaccgtgcctggacactttaaccatttttttttttacaacatatataaattactgtttctcaaccttttttttcttcattatctccacccaaaagttttttttttgacttttcttctaatacactccctctacccacatgaaattttagtgtcacaacagacacactgtatgtgtactctatgtacatccgcagggctgcagggccaaggccttttatttggatgtgggtcctctggttcagttctgccttggatttcttccacactggtaatccatcctctatgattcctaatttgagtttgtttaaaatgaaggtggagcaagacattttaaaagcaaacagtacagaatcatagtcagtgtttgtgattctcttcccatgctcaccattcaacagctttttaaaaataacctgttttatcaaatatttccaaggcatttaatttcattttcatgaaaacaactatttcctctcccacaattatattttatcactatgcgatgttagtcagattttgtaatttcaaagacaagacaattggttggggatcaacacaactgctgggggaaggaggcagagctagtgagagaaaatacacaaggaaataaatcggtgaaagaggtaacataaagaaaatagtaactaacaattttgtagaagttactaagtatcaagcactgttctaggagcttttcaaaagtgaactcatttaatccctacaagagaggtgctattattatcacctactttactaatgaggaaactgaggcacagagaggtcaattgtctttgttaaaattcctttcaaacaataaatttttagaacattttccactgagatgtttcgaagacatactaccaatgcaatctgcctttcttttacaaagtctattgaacataatgtaatctgtctttgaagtggcgtaactaataaaagtaggccaatgaaaatttaatgtggcctcccttttgggtttcacaaaaatatttttctttgttctcaagaagctagaaaattgagtttaactaaatcaggaagagatccttgtgggggagaggaaaggacttcatggcccttttttccatcctttctttgctgaggagggtgaatttaccaaagaaccaaaggctgggaactaagtaatctttgtggatgagatttttctttaaaattggctacatctgcaagagcggatgcctgaggcagcagtggaatgaggtcagtcgagtctacaagcagccagctatctgatctcaatagtttggggtctgagctgacatgcaaccctgctgagtccacctcacctccaccttgctatattctccccttcccacttcttctattcccccttttcctggcttctgctctgaaagcttctctccagttcctgagcaggggcagtagctgccctaacaggagctgaagctaagctgggtcttgctctaattgttcatttgtttcaggccagcagcctgttactgctagggctcagccactagaatactccaaactccaaggaatcagagaccttatttgtatgtttgactgtataggtccaatgcctagcatagttcttcatatctaacagatactcaataagtatttactgaataaataaatgaatggaagaatgacctgtaggccttgatccaattcatttgcttagtttactagtgtccttcatagtcgtggatccgtttaacaaaaattaatttctgtaatgagattatttctgtgaagagtcctggaatattttttacccagtcctataaatcagtgtttttcatttccttccatttgtttccagttgaaatttctggcatttcctctcttccatctaaagaaatgttacccattctttacctcatctcaatggctaagccttcactaaacctctctgatgacccctgttaaaagtggccattccctcctgtaaagtccaagagcactatggttgtaattcttttcataagtgcattatacaagttgcttccatatcctgtcgttttcttttttatccctatgtaaatgaaaagttctctgaaaaggaatttagaggagagagactatcccaataaacagtttgcaaacctgagagccacagatttcagtgtaaaaggaaggtttggctctattttaagttagtcctagttagccacttgggatccatcttgaaggattggttctttgaggtttatatttgtttgcacaacttccctgagtcagaatgttggacaaatgttattctccttttacaggtaatttggagaggttaatggatatgttcagttatacaagcccagaaaataatggaggtacactagaactcagatgtcttccttattcctgtaaccacccaatgggtttactttgctggctgtctagacagagccaaatttataaagacggggtaattgcaatagagaaagagtaattcatgcagagctgactgtgcaggagactggagtttcattattactcaaatcagtctcccagagcattcagggatcagaattttttatttatttatttattattattatttttttgagacggagtctcactctgtcctcaggctggagtgcagtggcgcgatctctgctcactgcaacctctgcctcccaggttcaagcgattctcctgcctcagcctcccgagtagctgggactacaggcacccaccacgcccagctaatttttgtatttttagtagagatgggatttcaccatgttggccaggatggtctcactctcttgacctcatgatgcacccaccttcggcctcccaaagtgctgggattacaggcatgagccaccgcgcccagctggggatcagaatttttaaggacaactcggtgagtagggggaagccagtgagctgggagtgctgattggtcaggtcaaagatgaaatcacagggagtccaagttgtcttgcgttatcagttcctgggtgggggccacgagatcagatgagccagtttatcgatctgggtgatgccagctgattcatcaagtgcggggtctgcaaaatatctcaagcactggtggtagtttttacaatagtgatgttagctccagcagcaatttggggagggtcagaatcttgtagcctccagctgcatgactcctaagtcataatttctgatcttgtggctaatttgttagtcctacaaaggcagtctagtccccaggcaagaaggaggtttgttttgggaaagggcttttatcatctttgtttcaaactataaactatgaattacattcctcccaaagttagtttggcctacggccaggaatgtacaagacagcttggaggttagaagcaagatggtgttgattaggtcagatctctttctcagttgtaattttgcaatggcggtttaattcccagtccagttctctttatactgctatgcaatgcatgtgctcatgttctggtatgtactattattctgtgtcagtgttatcttccctacaagattgtaaatttctaggacctaacttcttagacatgctaataatattaactaagtgaacaaattaatagaccctcaaaactttaaattcaggaatagaaaaaaaataaagctttttcttcctgtcagctgattttgcaaagggtataaggagccaaagagctgccacgttggtacagaagttggaaaacaccatacgcttcaactgctggttaatttttgctctaaaaacttgatggaggccaggcgcggtgactcacgcctgtaatctcagcactttgggaggctgaagcgggcggatcacctgaggtcaggagtttgagaccagcctggccaacatggtgaaacctcgtctctactaaaaatacacaaattagccaggtgtggtggcacgtgcctttaatcccaggtactcgggaggcagagggtgcagtgagccagagattgcgccactgcactcagcctgggcaacagagcgagactccatctcaaaaaaaaaaaaaagcttaataataaaatgggcttttatatatacaaatcagcacaaactcatttgagggagagtaagatttacctacttgctcacaactttttttcccctgcctcaggctcctgagtagctgggattacagggacgcaccaccacacccagctaatctttgtatttttagtagagacgaggtttcaccatgtcggccaagctggtgtgatccacccgcctcggtctcccaaagtgctgggattacagcgtgagccaccgcacccggccacaactttcttctgtgtaatttcaccttaaatacagccatttacttgggggtggagtaagcaaattgcctctttaatttctctcccggggtggtagaactgtggcattaaacagaagtgcgaacagaagttgagagtgggaagaaaggctgcccggaagggggtcaggaaagctcaggcaagcccaccctcaggcactacagctagactccgagcttactgggcagtcatctgattcgaccaacatcagttcgcagggcttaagcccagtcccttacggcggcctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtgagtcctgccagcggcccccacccctctctggctcccttgtagtttctgcttcagccccctctaccgcctcacccttgaacctttgtactcccccgcattcgctcacggtctgtgccctagcgctcacttgttcagtggagagaccgctttgtgctgggctttgacgcctgggcgtggaagacggagcagttctgaggatctgtctcctcaaggagcttccagtcttgtctgggacacaaaccagaaaacaggcaattgcaaatacagtaaaataagtgctgtatgtggattttcctatctcataggaggccctaaaaacgtcttgcaggggacgtggtgggatcagggacgcttcttggagaaagctgtagttaaaaattaagatctgaatgaataaaaacagtccattcagcaaggagaaggggaaaaagtgtttcgggtaccaggactactgtctccaaagtctccggcacagaaacagggcccagttggaaactccaagtggtgtattcaggatgaactgtagagctggaaaaaggaagggtctaacagaaaactgtccaacagaagcatattgtgagccacatacgtatttttacgttttttttttttttttttttttttgagacggagtctcgctctgtcgcccaggctggagtgcagtggcgcgatctcggctcactgcaagctccgcctcccggtttcaggccattctcctgcctcagcctcccaagtagctgggactacaggcgcctgccaccactcccggctaattttttgtatttttagtagagacgggggtttcaccgtgttagccaggatggtctcgatctgcttacctcgtgatccgcccgcctcggcctcccaaagtgctgggattacaggcgtgagccaccgcgtccggcatatttttaagttttttgtagccatattaaacaactgaagagaaacaggtgggtttgattttaaccatgtattttctttaacctgatatatgcacagttgcatggtaattttcaacattcaatatgaaatattgcccaagtggtggtttaggcttgtaatcccagcgctttaggaagcccaggcaggaggatcacttgaggccatgagtttggaggacagcctgggcaacacaggagaccccatctctgctaaaaaaaaaaaaaaaaaattagctgggtgtggtggtgtgagcctgtagtcctagctgcttgggaggctgggtcgggagaatcacttgagcccaggagttgaggttatagtgagctatgatttcgccactgcactccagcctgagagacagagctagaccctgtctccaacaaagaaaaaaaaatgaggcagtagagatttagaaagttttaagtaactggtccaggatcatccctggtaagtggcagatctacgattccaaatgctacactttttcccttatgacttgctgactccttagaaataaggatttctggatatagtattcagtgtatgatacagctgaacaagatcaggcagaagtaatccttttgtggagagtcgtaaaaatccgagtatcaggctttcaaggtagttgggagctgtggtaattggaagatagaactaatattggtgacttttacatgtgtaggtatttttacttggaagaggagagagtttacagaatccagagtaccacataggaagcatctttagtagtccaggtacttgaaggctaaagtgtaggccagtgattctcaaactgtctgtgtcctgtaatatcctgaaatcctgaagtcagattcatagacaataaaatctacctgtaaacataacttttaataatcaatataatgctttaattgagacataaaggtgaaatattttattagacaataacatgtctacaggctgcgagcggtgtctcgctcctataatcccagcaatttgggaggctgaggtgggtggatcacttgagtcaggggttcgagaccagcctggccaacagggcaaaaccgtgtctctactaaaaatacaaaaattagctgggcatggtagcacaagtctgtaattccagctagtagggaggctgaggcagaagaattgcttgaacccagggggcagaggttgcagtgagcggagatcatgccactgcactccagcctgggcgacagagcgagactttgtctcaaaaaaaagaaaataacatgttaacatgtctacaatttaaatatgtaaatacttagacattactacattagaaaacataatgaagtaattattagttgctgtcatattacaccaatttgtagaatcactgtgtatgtgacagctaccaatgcaaattgtttatcaaatgtattatattggcttttcaagtagcagaaggaccattgttctttacaaacttatttctcctaaatggtgaacaatttctggtaaaaacttgaacaaaacagtggaatctccctcaatttacatggcacttgcacttatggaagattcagtctgtactaaaacagtgtaataatgatatatttatatataatgaagttctggactaagattatcataaacttttcacctacttaatcttttaaaattgagggatgcaaacagttttttgttacacaggcttgtctcatatattttaggacttctacgatcaatggtcccccatccaccaaataccctcccttctattcaaattattgtgcaaccaaacagggcctcacgtactttcagaatgtccctaaggggttgttctgcttcttttgggagttgttggtccaggcaatgaccaataatgaggcagaagattgttgataataactttagggaacttggaagtactgaaagcaatgagaagctgacaaaaggtaaatattaggaaagaaaaaaaaatggcctaggtgtagggcatatttggaaatcttatggaaaatagaaaataatgtttgtcaatgagttaaagaaaaactttcacactgtattttaaaaatgtaattcattttaaggtttatgaaatatatcttgttgggctggacatggtggctcatgcctgtaattctagcaatttggaaggtcaggtgggagaattacttgagcccaggggttcaagacccagggtgggcaacatagtgagacccctgtctttctaaaagaaaaatcaaaaagaaataaatatatcttgtcatatttgttaaataactttttcttaggtaagcttctcttttgaaactaagaactaatgttcattagcctgcttaggagattaaaataatttttaaaaataggcaaaatatgtagcatcttgaataaagttagcattttacaattaatggtttaatagaagtcataatcaaactttgcactagcaaagctgtttctcatggaaaagtagaaaagaaactttaagagattattatcaaattttaaagcagtttgaacaaaactcagtttgtatgaaacggtagtcatttagtttccattactttcctgaaaactgtaactcttacttttatttttcttcaatttttattttaagttccggggtacatgtgctagatgtgcaggtttgttacacaggtaaatgtgtgccgtggtggtttgctgcacagattgtctcatcacctaggtattaagcccagcatgcattagctattcttcctgatgctctccctcctcccacccccacaactcttgttattattaggatagtgtaacatgtaaaaaaaactagacacatatatgtttcattataaacaatcctgatacgtgaaaactaaaacctgtcaaactaattttcaggcatttattcatttccaaaaataagacagtacttttactattttgcaatgataacatgatttaaaacatgttttaacaatactttgaagcttacattggtaatcacatggattatgtactgtatacccatatttttaacttttttttttttgagatggagtcttgctctgttgcccaggctggaatgcaatggcgggatctcggctcactgcagcctctgcctcacaggttcacctgagtctcctgcctcagcctcccaagtagctgggaccacaggcgcctgccaccacgcccagctaatttttgtattttcagtagagatagggtttccccatgtcagccaggctggtctcaaactcctgacctcaagcgatccaccctcctcaacctcccgaagtgctgggatttcaggggtgagccaccgcacccggcctaactgattctttcccactgttttttacaccataatgggaggctagaatgttaagtttcatggacagggactttatttgttctctggtatgtatttctagcatttataatggtgcctgatgtgtggtaaacattccaaaaagaaattgttgaatgaatgaatgttattcttgaatgggaagaaatgagaagaacttttctttcagtgaatggagtaagaatttccagatgtctaccagtgagtaccatacacaaaaatagaaaattcagcttatttaaaatgtagctcattatagtcttccctgaacatgctgattctcctcttctttccccctttcttgactagtgccatcatgtgcactttctcctttacctccaccattcagttcatgagtcacttagcctcatctctgtaatttttttcatggtattccttcccttgctattttcttagtctttattgtttctcctctggcctgtagtgatcgcctttaaaaacaagtctctttgcttctggtattgtatcctttctaaacttcacactgccatcagttatttttctacaacacagacttgttaatgacaccatccctttttatgagtttaacatgatctaaacctttcttaggatcttacacaggactcttcatgtactgatccttaaatgacatatccagccacatttcacatcccctacattgcactgtaccctgtactatagttacattaagtttccttcatgaaattttatggttctgtgactttactagagctttctcttctgaaattcttttcctggctaactcctattcattttttttttaaagacacatccagtgtgaagccttccctgaccccagttccctttgcctagtaggagaaaattgttttatactgtgtgtttccttaggaagttgcacaagtttttattatagtttattaagatacatcaaaattatttatatttgtataagcacctatggtgtgaagtcctcagggaagacacttgtatctgtatctgtgattggcattgtaattggcacatgatagccatttaattatttgtctatgaaatagctattaacttctattattattgagcaacttaataaataaacatggatatttgattttaatatcattgacacctgtattttttccttgtagggtcctcttatatgttagcctctaagggagagcaagagtctgtgtctctcttgctcactgctttttccccagaacttagcataagtcctggcacatgccaaataaatgtttatatatttatatggtaaaagttaaataagtatttgttgaatgagtgaatagtctacgtctttcctctctccatcacaactaccacccctcttgtgaggaggaagaatactttttttcttcttcatttccctctggtacaactcttgtttttcttggactgaaatgttcagtctcaaaatagaaattttagcattttataacactttcaggcaacttatatttatctaaaaagttatttactgcctatgttgtttagggagaataaaatgccatagggaatttgtaaacaattttggtgcctttttttttttccccagctgtagcagctatgatggagtgatcttttttcccagttttcagaaattttttgattcatggtagtggaacatttatagtaatttttctgtttttttaattgttgctgttgttattttggtttttttagtggatatttgaaaccaggtagtggtaacagatacctgacatggcccatttgttgatctgctggcattatttaaataatgtttcttctctttgaaatatgcctttttaactaaaattagatattctttatagatggggatgaagttttaagaatactcgttctctcagttcccaacatagtaccaggcacatggttgctctgcctcataaatttttgttgaatcattaaattaacaaatgaatgaaaccaacaggcttggagataagtagattagggaaatgttatagaatgatgaacggacagccttcaggaattaaaaaaagaataagataaatgagactatgcctctttgacttttgtaatagtcaggagaggcctaaaatgtcagtatctaataaatatgtgtataatcagagtacgtataatactctgacttctgatgtgctttttcaagttttgatcattgcttattaatatctccaataacacaggcagtctccaacttagaaataggttctgtttttaaaatttgtcaattaaattcattttaatagatttttgggtaacaccaaatatatggaagctataaactaagtgtgtatagggagggtataaataaaccaagattgccaccctcaagggcagaggatagcaaacttaatttgtaaagggttagatagtaaccatttcaggctctgcagaccatatagcatctggcacacatttacctgtgtaacaaacctgcacatctagctgcaactacactgttgtagactgaacacatagacaataaataaatgtggctatttatgaaaacagttgctctaggaggcaaatttggagcaaatttaaatgcccaattaaagacagtttctctaagtgctatcatatttttgttcatttatttattcatccatttaacactttatttatggagtcgtacattattaggtaaggttctgagtctaagtgctatagtggatacaaagatgaatcaaatacgcattttttcctcaagggacttgaccagaaactaaacctagactctcagactgggaactccccagcagtggagatcctgcctgattcacttttgagaatgacttctagggccaagcacagcacggggtaggttgcagatacttagtaaatgtcttttcaagggtaagggaatgaaagactaaggcataggtgtcataagagaaatatatggataaaatgcttgatttcgtaggaatgagccattgtttcttatttgggaaatcagagaaaactgtgaaaagtgagttgaatgagtagaacattgagaaaagggaagaatgtgagctaagttaaaaagataaaatcttaggcagaggtagcaaattcagatgcttaaagggggcagtcacgtggcacaaatgagtgaggggatgactgggttaaatggtgttgcattatgtgagtgatgattatagcaaaatgagagagcacttgcttttctaaaggaggcagatcattggaataaaccattattaccagatgtttgatttttcgaaagaaaccagaaagagataaataagtttttctaaaatgtgggttatatcaaggaagaaaaatagggaaaggtaggttgggttaacaactgtagatagctccaaatggcgggttaaggaatgtgtggactaaatttgtaggcagttaattttgtaggagttgtgtgatcagtggaggccttcaggagaatcaagcccagagcagtgtttaagaagggtagaaactaaacctagactcctagactgggaactcctcagcagcggagatcctgtagaagaggacaagcctagttgaaaatgcgttacagtgggcagtactttgggagtgtagaggaggagatgatggcagcaataagagtgatgatagctgaactgttttgtgccaggctttatgctaatgttttaaatgcatgaactcatttagtctatataataatcctagcaggtatagatcctgctaatattataaccctctacttgtagatgaataaattgaggcttaaagcactgaaataatttgtgcaaagtcacacatttgagaagtagatgaatcccagaggtactctgctttgttgcctctgtgctcttattcagaatattctctttgtttctctttccccttcaacttcttaaattatgtcacggtctaactaggaaaacatataacttaaataatataaaacaagggaaatgtaattcaaggaattggcttcatagctagtggagttgttgagaaatgaaactaggatggtgaagcaatccagagattgggaacagcaaggaaccactagcactcctagagctgtagggccaaagggaggagttggtgtttttcaaaaccactctacattaattggaaccacggatgtctgttcagggggagctggagccactgctgctgctggagcagttgctaaagacggagaggaaggggcggtaataccgtggtttcttccttgttttcactgtccagtctttcaccattgcatcccattggtctgactctactgggaccagctgacacaagagcctgtaggacttagctcttctaacagaacagagaatagcccaggaattgattggtgaatgcatatgggcctgcgaccaacacattatctgttttcagctgtaatttgaattccactgataataagaaatttgaaagcacagtctcctaaaagcagtgttagaaaacactttttgaaatgctaagtattcccttaatccacagtgtaagggtaacagtattattttgtggaattccatttacactgtcttatgtccttggaatatcatttccatgctattggagataaaataagtactgttgccaagtgtggtggctcacgcttgtaatcctggcactttgggaggccaaggtgagcacatcacttgaggccaggagttcaagactagcctggtcaatatggcgaaaccccacctttactaaaaaatacaaaaattagctgggtgtgatggtgcacacctgtagtcccagctactcgggaggctgaggcaggagaataccttgaacccgggaggtggaggctacagtgaacccagatcacaccactgcactgtagcctgggtgacagagcaagactctgtctcaacaacaacaaaaagaagtaagtactgttagcttataaagaaaagaggtttaattggctcacgattccataggctgtacaggaagcatgatgctggcatctgctcagtgtctggagagaccttgcaaaacttacaatcatggcagaagacagagtgggagccaccacttcacatggccagagcgggaggaagacagagacagggaggtgctgcatacccccagaaaaccagatcttgcaagaactcactatcacaggaatagcaccaaggggatggcgctaaaccacccatgagaaattgccgccatgacccaatcacctcccaccaggccccacctcccacattggggattacaattgaaagtgagatttgctgagggacacagatctgaaccatatcaagacaatatagtgagaccccatttctacagaaaacttaaaaaattagtcacttgtggtggcacatgccagtagtctttgtttcttgtgaggctgaggtggtaggatcagttgagcccaggagttaaaggttacagtgaattacgatcataccactgcactacagcctgggtgacagagtgagaccctactggaaaaaaaaaataaaccaatattgatccattattattaacccaagtcatattttattcagattcccatactttttagctgatgtcctttttctgttccaagatcccaaccaggtaccacattacatttagttttcgtgtctgttttggctgcttgtggctgtgacagtttttcagacttgctttatttttgatgaccttgacaggtttgaggcttactggttaggtattttgtgggatagtctctactggaatttcttaggtgtttttctcatgattatactggggttttaggtttttggaaggaagatcaatcagaaaggtgaagtgccaggctgggtgcagtggctcatgcctgtaatcccagcactttgggaggccaaggtgggtagataacttgaggtctggagtttgagaccagcctggtcaacatggcaaaacccgtctctactaaaaatacaaaaattagccgggcatggtagcaggtgcctataatcccagctacttgggaggctgaggcaggagaattgcttgatcctgggaggcggaggttgcagtgacccgagatcatgttattgcgctccagcctgggcgacaagagtaaaacttcatctcaaaaaaaaaaaaaaaagaaaatgacttgccagtttcatcacatcatatgaagtgtacatactataaacatgtttgttgcaattgatgttgatctaatctgatgcggcagtatttgtgagttttcttaactgtaaactttatttgcatactgcactttttgaaagaaagtcactttgtgcagcccacatttaaggagtagagagttatgctctccactccttaaatgtagagtaatctgtcagattatttggaattcttctgtatgggagatttgtccttttttttttttttttttttttttttttgagacagagtctcgctgtgtcgcccagactggagtgcagtggcgcgatctcggctcacttcaagctctgcctcccgggttcacgccattctcccgcctcagcctcctgagtagctgggactacaggtgcccaccaccgcgcccggctaattttttgaatttttagtagagacggggtttccccgtgttagccaggatggtcttgttctcctgacctagtgatccgcccgcctcggcctcccaaagtgctaggattacaggcgtgagccaccgcacccagccgagattgtccttttactcccatttattacttatttatattagtttggtttcatggatagtaattttatgctttggattataatccactaccacatttattttgttgttcaagctgttttatctttggccattgggatctctttcagttgactcttgtgtacctttgacatacccccaacgttgtgggggtttttttgagcacttccttgctttctggcactacatggtgctctaggctcattttgtgtatttcctgccccagtcccaaaatcaggcatttctccaatgagttctgtgtatataacattttatctcatggggagcttcattctgggtcataacttcagatcctaatccatttttatcctcccaccctcatccatttttatcctcccacccaaatgttccccaattcctttatcttttccctatatagctgatgaggtaagagcaaaagatatccttgtcttggtacacgtggctgctgctttcagtccatcaaggacagtagaatttttccctgaagcttcagtaaagcgcttttgtgtttgtttagtttgggctttatttttgtttttcaatatctggtgttagggactgctaatggagggagggtgctagggattgtgaaaggaattagagagagagaaagagactcattaacctttctgccatttgtcattgtatttcaagtttgttatagaatcttagtacaggtcaagtgaacagtaaagaacctgtctctgggtataaggttaaatattgcatattcattcctctaaaggactgaatatggtcttcaagagaatgattttcacttcttttggaatacctagaatttaacaatcaccaccacactgaaaaaatagtttttgtatagtaggcattagaactgaagagaactaaaccaagggagaaaagaatggtactttaaatagcactttcctccccaaataatgcctagctgcagtgatgttaaagtttaattcaaggacttcattactataagtacttaagagatttctatatttttatgtggtttttgaataatttctgtattgatttgtaagtaacttttttcaaagtaccaatttattttttaattttaatattttatttcttttgagacaggatcttgctctgtctcccaggctggtgtacagtggcgtgatcatagctcactgcagtctcaatttcccaggctgaagtgatcctcccacttcagcttcccaaggagctgggaccacaggagtgtgccatcatgcctggctaaatttttatttttatatttggtagagatgggggtcttgctatgttgccgaggctggtcttgaactcctgggctcaagggattctcccacctctgcttctcaaagtgctgggattacatgtgtaagccactgtgcccagtccaaagtaccaatttaattttacattttaaaaattggattctaaaagtctgccttcttatctgaacactatttttcagattccattttattttgttacttttttaaattgtgattggacaaaatgtttttcagtttctgtctttttttttttttttttttgagacagggtctcactgtcatccaggctggagtgcagtgatgcaatctcagctcactgcaccttccaccttccaggctcaagcagtcctccgacctcagcttcccaagtagctgggactacgggtcgcaccaccacacccagtgcagccctcaacagagaggagactggagtgggtagctcctatctgcaggcaggtcatcctgataagggtgtctggctaagtctgcaggtttttatgtgctcagaatggaggaagtgcatgttgattggttgatgggtggctggccatgggcaggcctggaaaaagcaccatccaattggccgattggtcatcaatgaacttcatactcctgttggtggacttcatccagaactggcagcctggcccctaggcttcaggccagtcctagcttgaaggaggggttctgccagggacccaccctttcctgcccaggaaactttcaacctcttgctgccaccaacatgacctccacagcaccctggctctagaggctgcggggagcccacaggcccatgccaagctactaccctcagccccttggctggacctccctcctgggcttgtgcccaaagtctagagggggctgaagtggcagggggctggcatgtcatcaccgctcttagtgcatgcacacccggctgggttgagacagtgcctcagcttagccacaactttgccccaccctggagtggatgccgtgagtcgggagaggccaggcagtgggagcaggcatttctaagcctgtaggggcaggggacttcctgggcccctgagagtgcggttgggcggctgcagctgctcctgggagcactggctcctaccctgccaagctgataggtggctggcctcctgcctgttcccagctcccggcagctctgctgaatgtccagcccccatggtgcctcccgctctgcagccaacatccttgtgggggccgctccagacgggccgtagcagccactgccttaaagtaaaatcggttgctgtaagggagtaaaagtagctttcattaaaggggatgatttcccaagcaagaagaaataagcaaaactacaaaatgttgcagataaggtgtacatcagatataagccgaaaaagagagtttgaggggttcttgctggagacttcaaagtcagtatgataaaagcttggagtacttgataggaaggaggccaactagagatgcagtgggatcatttttatgatcagggtgcagatttaagtgcaaggataaaaagggagacaccgaagatcaatgtagttattcttgaagaatgtaaggaagaattcatttttaaagtttattttaaagtagacaggtcagagggttttctgccttctgatgttaaaacatgttaaacccatctcaccaggtgagatcttcctttttctttttttaataacctttatttttacctcctgattttaaaaagacgattatgtaatgttatatagtaattgtaatagctaccatttgttgaatgtttatcccatgttaaatatactagtttatatatatgaatgccctaacttaaaaaaattcttatcaacccaaggaattaggtgcagtcatcatcctcattttacagatgaaggaacacatggaggtcatgtaacttgggcaggtcatggagctgacaagtaaggagccaaaactcaaaccatatttctttgattctaaagtctaatgatcccaagactacgttttaatgaaaatattcttttttatagcctgcttttattctgtacttaacatgtggttgctaaacattcctcaataatatatttaattgttgatccatattttacatgtgccttaatttatttaatgattcccccattgttgggtagtcagattgtttccatttttttgtattacaaataaaacacagtgatgaattttctcttaaatgtttttatggatttttctgattattttcttcggataaattttttgaatcttagttactaagcctaaagacattagtatatttaaggttgttgattcctgtgatgaaagtaacctcaagacacattgtcccaatttgcattcctagcatcagccatcagttcaggagattgttcattgaaccattcttttgacaatttgtaagactttgatttgttggccaaaatgtatacctctcatgattaacaggctgcgtactggaggtatgacagattgtcacatggccccatccagaggaaaagctgaaagagggactagtaatgccagtttcatacttatcaaacgattccatttttgtattaaacataggagtattaaaaatacgactggggaggccaggtgcggtggctcatgcctgtaatcccagcactttgggaggccaaggcgggcagatcacgaggtcaggagatcgagaccatcctggctaacacagtgaaactctgtctctactaaaaatacaaaaaattagccaggcttggtggctggctcctgtagtaccagctactcgggaagctgaggcaggagaatggcatgaacccgggaggcagagcttgcagtgagctgagattgcagcactgcactccagcatgggcgacaaagcgagactctgtctcaaaaaataggaaaaaaaaaaaaaaaaaaggaaaataccactgggggaagggagaccaaagaaaatttcatgaaataaagaattaaggacaccaaggactggtgctaggatctagcttgatgttagataataaaaatgacactgtattctctagaaaatttaaaaacctacctagtaataagttgtagaagactttatatgttttttgtgaatgggcagataggggtgttttgttgagtgtgagctcacactggaaaaaatcttgagtaatttttataatccattaaaggtaatgtgagagtgacttcagattgttgcttgaaggcataagctctggtctggaattaggatacctgggctctagtccagtgtagaattgttgctgcaatttgcaagtcatgtaacttctcgggccctcagtgtcttcctcataaaatgtgggttttggctaatgttctctgtcatttttttcaactctatgattccgtgacattgacttaatttattattacagtcagaaatgtcaacaaaacattcgtggaaactattgaaaatggaacagaaacatctttttgtataaaattatagtgtttctatagaagtctgtgtgtgcctttgcatgtacctttccatgcaatcaaacagaaatgaaaagtttccagaaaaggtcaacaagtaaatttactgaggggagaagtgtgtgattgagtgtctaggagtctcagggggtggagacaccaagggaaggctaatttgaagacataggcaaaatagttcagaacttaattcaggactttagaaattcattggccaaaaaattctaataaaatttcagtacaataataaaatgataaaagctgttggttgggtgaaaaaggccctttccttcaaatgttagaaaacaaaactaaggatactatttaaacttgaaagagataaatttggctgggcatggtggctcatgcctgtaatcccagcactttgggaggctgaggcagggggatcacctgaagtcaggagttcaaaatgaccagcctggccaatatggtggaacctcatctctactaaaaatacaaaagttagccaggcgtggtggcgtgtacctgtagtcccatttactcgggaagctgagacaggagaattggttgtacacgggaagtggaggttgcaatgagctgaggtcacaccactgcgctccatcctgggcaaaagagtgagactctgtctcaaaagagagagagagaaaaagaaatatatacatttaggactagtgaattaaatagcagggatgagcaagttaaagaatctcactcctagacccaaatgaaccttgagctgcctagaagactgaacctttgagagcagctgtatctgaagcttcaggccaaagaacagttctcagaagttgcattactagacttgacatgtgccagccatcaagacccacaaagcaaagatatagagcctgctgtagttctttcttcctaacaaattcgtttcaaatgctgaaggttttaaaatattttttctggcttaattttctaactagaatttggttttggctttgaaatttttgtctctttttgacttacctgtttatctgtgggggtaataatctgttacctggttatcatcttgaagtgaccccataatgttaagtagatggaagttgactttacattttacaagttgtctggtctaatctgtgtttaaaatattctgcaggcctagtctgtttttaacatattctatatgaaggggtggtttgcccctccacacctgtgggcgtttctcgttaggtggaacaagagacttggaaaagaaagagacacagagacaaagtatagagaaggaaaaaagggggcccaggggaccagcgttcagcatacggaggatctcgccggcctctgagttcccttagtatttattggtcattcttgggtgtttctcggagagggggatgtggcagggtcataggataatgagagaaagtcagcagataagcacgtgaacaaaggtctctgcatcatagacaaggtaaagaattaagtgctgtgctttagatatgcatacacataaacatctcaatgccttaaagagcagtattgctgcccgcctgtcccacctccagccctaaggcagttttccccatctcagtagatggaacatacaatctggttttatactgagacattccattgcccagagatgggcaggagacagatgccttcctcatgtctcaactgcaaagaggcgttccttcctcttttactaatcctcctcagcacagaccctttacaggtgtcgggctgggggacggtcaggtctttcccttcccacgaggccatatttcagactatcacatggggagaaaccttggacgatacctggctttcctaggcagaggtctctgcagggttttgtgtccctgggtacttgagattagggagtggtgatgactcttaaccactgctgccttcaagcatttgccttcaagcatttgtttaacaaagcacatcttgcacagcccttaatccatttaaccctgagttgacacagcacatgtttcagggagcacagggttgggggtaaggttacagattaacagcatctcaaggcagaagaatttctcttagtacagaacaaaatggagtctcttgtgtctacttctttctacacagacacagtaacaatctgatctctctttcttttccccacactatagatatttaacatgtcttgtagatgatccctgcctcccaacacacacattgactagattgcagtaacagtgaggtgagggcagaatctcagtcagaattcaacatctaacctttgttctctccctgtatcctcacatttccctccttggcctaaccttgaccctatgcttcagttttagttctacttttctaagaagcaatctatgattcagaagtagagtactcagccagctggccagctgtctgttttactgtctctccatgcatatacatacatccatgcagtcaattaactgctaacttttatttagcctatgctatataccgggaatacaaaggtgaatgaagcctacctcttgccttctagaggttcatagcatggtgagggagggaagttttgaagtgtggcctgggatcacaatggaggagtaagctgggaagtagtcaggtggtgatatttaaataggtaagaccataacactgacattgatttctttaatggttggatgtttacttaatcctgctgcctatctatagtgtagtaggccccctcttatctgtgggttctgtgttccaagaccaccagtggatgcctgaaaccatggaaagtactgaaccctacagatacagtattgttttcctatagtactggtcccttcatacacaatgttttttcctatatatacataattatgataaagtttaatttataaattaggtacagtaagacattaacaacaaacaatgcaatggaacaataataactatagttgtaataaaacttatgtgagtatggtctctctttctctggaaatatattattataaccatggaaagcaaaactgtaagagaggactactatagttttgtttcttcctccttcttagtagctgagaagcaatatagagcaggcactctcctgtgttagggacagggatcaatcataacatctttacatgaagggtggtgaaacagaagggcaggagtgcattaagagtcaactaggatggggggatatgactcaagtgctccagctcccaaactgaaagccagcagattcaaaagagggagagcttatcttgagaaaaaatgtcatggtgccacataaggtagggaccagctgtggtggtgtagctggcaagtctaaaatttgtagggcaggcccacagtctgagagctttcagataggatgagattcttgaggcagtatttcttcttcttcagagaaacttcaattttgttcttaaatccttgcaaatgattggtccatatagattggcccacatagattatcaaagataaactccataggtgttagccacatctccaaaatactttcatggcaaccccaaaatcagtgtttgactaactgggtaagcatagtgtagccaggttgacacataaaattaactgtcaccatgttcctgggttcaagaacttaaagccaaatatgcaacctggtttggcaagcctgtgatgagttcaggggctgcaagtgctctccaggctgtcaggaaggacatggttgatgacaggagcaagattttctgaccagtcacatttattcacattttggtttaaaaaagctgctttttaaatttgtttatttttatttttttgaaaggctctgtcactcaggccggagtccagtggtatgatcttggctcactgcaaacctccgtctcccgggttcaagcgagtctcccccctcagcctccccagtagctgggactacaggcgtgtgccaccactcccagctaatttttgtatttttagtagagacggggtttcaccatgttggccagactggtctcgaactcctgactctcagttgatctacccgccttggtctcccaaagtgctgggattacaggcatgagctgccatgcctgacctcaaaagcttcttatattatgagaaagtagagccatgactcacactgttattttgagtaaatgcaaaacagtacttaaaagatcattcttgttattatttatttacttattctagaccttttctgacagtgtgaaaaagattattcttaaaaaatcattatctatagtgaagatttaactttgaggagtttttaattatgctggagagtggagtaacattcatttggggtaagcctaagagttttgtttcctaacatgtttggcctctgattttgttgtttcgcccttttatttattcactagtcttgctgtagatactaatgcttgcctgtggtttaagagaaattaagcaacttaaaaacagagcaaatagaaatgtagttagctttgcctttcttttttgcttaatgtaagggtttcgtgggaattggtgttttgggagaagttcaaatgtatttgcttttggcaatggaacaataatggtaaaggtagggtgtcttaatgtagattggttcaatttagatatgaaagtctgaaatttatattggcttgaagattttagggcaggataattttataaattctcgttattgtcattttattgtgtctgacactttttcttgaatgtaaattctcctcccctccttattctaatctgcatgtataatacctcttttacccaaattatattgatttgccagcagtctttcttgtttcctctctttttttctcctttccacttgctgttgtttaaattcaaagagttttctttgtggagactgaacctaatagtaagacagcataaaacactgagttcagcagaaagtgatttgcttgtgattaacccttgagaattaactcactgcaagataacaaagaatgaatgttttccaaacatctggctcattcttcttttccattagtagatgagacctctccatttaccctctaggtgttaggaattctcatactgtttcacttaggctttatcatactcgtcacggcatattgttagaaagtaagtccaaaagagagttcatgacataccctttctctgccacagacctctcacagtccttgcagcaaaaggcagttagtgtcattcttttagttgttcaagacaataaccttgactcttctcttttccttttagttgctcaagacaactaaaaggtccttttagttccttttggttgcaaagactttattttctttgtcttccgagagacttttggatatatttacctggtccagggtattttgaagcatgaccatatgttagattcttaattacgtttaactagcattgtccattatattttctcatttcaaaaccttgactccatatccagtgtctcagcaaatcctattggccttacctccgaactctatctagtatctcaccactttcctcatttccatcattaatcgctgtagcccaagtgaccattatctctttcatggattattttaatagacttacaactcatccccatgcctctgcttttcatcctctacaatctattctcaacatgacaagtagaatgatccttagaattttaattgaaataatcttaggcctctgctcaaaacaatgatgtactgtatcactcggagaaaagctagtctttatgttgaccatataaggcccagcatgatctgctccccttgtgacctgttcgaccttgttgcctatttttttctctttctcttcctgctgtatgcacactggccttctggctattcgttaggcacactgggcacacctgtgctttagggactttacacttgttcccattgctagtccaaaatctaaggaatcctttttcttgctttaatttttttccaaaagtcatttttttcagtgaagcttgccctactcactttaaatttgttgctcttgtagcaggacaagccgcaggcaaaacctctcagacatcgagttgtagaaggaagggctttattcagctgggagcatcggcaagctactgtcttaaaatccaagctccccgagtgcacaatttccgtcccttttacgggcacacaacactaaagattttatatgaaagggttgtgattgattgagcaatctaggggatatgtgacggggtttcatgcactggtagtcagagtgaaacagaacagagcagggagtttcacaatgttcttccatacaatgcctgaaatctatgggtaacatcgggttctaagtcatgagttgatttttaactactaggtttaggccatgcaggctcgggcgtggttttgggcctggggccaggctgcctgtctttgatttcacttccttgtttttttcttaaaacaggtactgagtataaaatataaaacaatgtgagagggtctctctcttccctcactctcaccatacaaacacatacctacttctttatctgcttaatttttttccatagcacaaatcactgcgtaaaataattatatatttttcctgttaaaattgtttgttgtctgtctctcttgctaaaatgtaccttcatgaggatagggattttgtctgatatatccctagggcttaaaatcatgactggcacatagtaaatactgagtatttattgaattaattaatgaaccagtcagagatgggaaatagccttcaagtgcctgtttgctaaattacctaacctttttattgggagtttattttccttaatgtttgtttaacaaattagttattctttcatgttttccacataacctgtggattatcttcatttttttttttttgtaaggaaatttaccagacataaggtcctaactttattttctttgtcttccgtgagacttttgaatatatttacctggtccaggatattttgaagcatgaccatatgttagatttttaattaagtttaactagcattgtccattatattttcccatttcaaaacataatttcggtcaccagtatggtacacataaaatatgagctacaagagacatctcggtggtggtgagagacaggactagttggacttcctaggccgactaagaattcctaagcctaactggggaaggtgaccgcacctacctttaaacacagggcttgtaactcagctcacgcccaaccaatcaggtagtaaagagggctcactaaaatacaaattaagctaaaagcaggaggtaaagaaatagtcaaatcatatatcgcctgagagcacagggggaggggcagtgattgggatataaacccaggcattggagcagagagtgggcaaccccctttgggtcctctcacattgtacgggagctctgttttcattctattaaatcttgcaactgcacactcttctggtccgtgtttgttacggttcgagctgagcttttgctcgctgtccaccgctgctgtttgctgccgtcgcagacctgccgctgacttacacccctctggatccagcagggtgtccactgcgtttctgatccagtgaggtgcacattgccgcacctgatcaggctaaaggctcgcctttgttactgcacggctaagtgccctaatcgagctgaacactggttgctgggttccaccgttctcttccatgacccacagcttctaatagctataatactcaccacatggcccaaggttcaatttcttggaatctgtgaggccaagaaccccaggtcagagaacaaaaggcttgccgtcattttgggagcggcccaccccatgttgggagctctaagaccaaagacccgcccgtaacagtggtaaagtttcttaagatcattttcatgtcattatacaaacttttagaaaatgacgctttgctagattttggaaatccaaagaaataaaacacagtccctacctccggaagcctacatgttggaagggatttgaaataggtaaatgagtattaactaatgtaatatatattacagtagaaagatctcctgagtactatggagtactgaagagttttgtttgggtgagaggtgagtgaagaaagcttttttgagaagatgagcttgaagttgattgctgagtaagatttcccaggagtaaagcagagaggaacaaaaggagtaagagtaaataatatgagaatgaaaaaaggaccaacatggaatgtctgtgacgttcacataggtgctggttatttttcataaccttgtttgaatcattacgagcatgttaggatacaggtatttgtatcttaattttatagatgaggaaatgggcccaaagagaatagcttaggatcacagaatgttgaattggagcccaggcctgattaacttgaagcccatggactttccatagcagccccatacatagcattcaggtgtgaaggagtagaaagtataaggggctcatgcttgctgcatggatgaaaaacttgaaggcttatttagaaagtaaaagtttagtacgagccatgaggaatgggaaagggtactaattaatgatgaggaagatgatggtacagagtaggcttgaagggccagcgggcatcagaaaccataactgtgtaatgatgctatttagtgagaacataagatttttctttagctagacctagcagtctaggatgaggattctctgtggtaactctgccaccattttgaaaccattcgatttcactgacaatttgccatctgttgctttctgcagtgctattatgcatatgcctggaagtttttaaatccaaaatattcatgcattgtatatggtcagagagaatgcagtgaaagctatgctttttgtaatttttgacaagtgtactctaaagtaatgaattttaaaaacttaggccgggtgcattggcttacgcctattatcccagcactttgggaggccaaggcaggtggatcacctgaggtcaggagttcaagaccagcctgaccaaaatggagaaacctcgtctctactaaaaatacaaaaaaaaaaaaaaaaattacccgggtatggtggctcatgcctgtaatcccagctactggggaggctgaggcaggagaatcgtttgaacccgggaggcggaggttgtggtgagccgagattgcgccattgcgctctggcttgggcaacaagagcaaaactctgtctcaaaaataaacaaaaaacaaaaagcttaaatacccttgtcccatatcacataaatttgttttttgaatatatatcatctttttttcccccatggtgaccatgacagattattaaaaactaaatttctaaatttgatgtaagtagaatgttaggtttttggtttttcttacatagagaccactgttcccaaacattatgctggaccagttgtaaaagaatttttttggtggcatttgtaactgatttcatttttaagtatatatgtgcatatatttatagaaagatcagcttgttctataagtagaagtatgtggtaccctaattttgtgtaacaacaacaaaaatatatccaataattagattttctgcaggcctagaaaatgttagctacttttttaagccataaacgtctgaatcgtcagataaaatgtttcaaaactaaaacttgcccaaggcagccttgtgaatttttttttaaagaattaaaaaaaaagcctcatatggcatccatattcatcatctactgctacatatgtgtgacacttacggcagttttagcctatactagggtacaggaatatacttacttttttaaatcatacttcctgatttcttttattttcatatcccaatttttcctaagtcaaagaaacagcaacatttctgtttctgcagaatttaacctggttattgcctagttggtagaaaatgactgtagttgtggtaccaacactatgcctgattcaccattttactattatattgtcttttcaatgtcattttttctcattctgttactggcagtttagttttaaagcatcattgtttaaaaaacattcaaaataaaagtcgaaatacatcttcatgtttacaactggatcagatatggtgttgtgcatataaaagaaacaaaatacagatcctcttagcccaaggatatgatactgaagtttagtaaacgagaaatagcatagtgatgaaagcatgctaattgtttttcaacaatagtaaaatagagaacatgttaatggaattatctgatatttacacagttatgccaagtaaaccataggttattcagaaaccccagtgtgttttagatgttattttatttttaaaattaaagccaaagaaaggtatggtcaggagttctgtgttgagttacttacttagacttagattgactccctttctcttatacttctgttttctacatttgaaactagtttctttttcctgtttgagtcattcatatatgtggaagtttgaggagaattgttactgttttacagctcacaaaatctgtgtctgaaaagaaataccaatggctttttagcaaataaaaaaatgttaggtagtagataaatttttttctaggaaacaattcatattattctgggccagttaaagttttgtttgtttgtttgttttattttatttgtttgagacagagtcttgctctgtggcccaggctggagtgcaatggcatgataatcggcacactgcaacttccacttcccaggttcaagcagttctcctgcctcagccttttgagtagctggggctacaggcacctgccaacacacctggctaattttttgtatttttagtagagacggggttttgtcatgttggccaggctggtctcgaattcctgacctcaggtgatccacctgcctcagcctcccaaagtgctgggattacaggcatgagccactctgcccggccagttttaattgcttgtaaatctaacagccttactatttccacaggaaactttataagtacttttattctttcctttaaaattttaaaaaattttttagtttttttgagacagggtctcactctgtcaccaagctgaagtacagtggcataatcacagctcactgtggcctcaatctcctgggctcaagcaatccttccacttcaggctcccaagcagccaggactacaggcacacccaactaacttttctttagtagagacagggtcttcttgtgttgccgaggctggtctcactcctgggctaaatcagttctcccatctcagcctcccaaaatgaagacttttattcttacttcagattacaaaatatgattgtataggatacatgattaaaaaaaaatttcaagttgatttcaacttctaaatatgtttttgtttgtttactgtcaattgttcatgctcaaaaagttttattttaatatcaaattaaaatacaaagagaggtaatttagattaaaccctttcaatagagaatttttaagatttaaaaaatttttttagccttgatttgaaattgaataaggaattttaattccagtaaataaatgggtttttgattagctgtgctgtattttatcgttttagtgtggataagtaagatttgattgctcaattttggttatttactgaacatccttttttactctagtgatctacctaatttgggtttctttttgttgtttttgtttcttggtattttatttatttttttgagactaagtctcactgttgccgcccaggctggagtgcaatggcgcaatctcagctcactgcaacctccgcctcccaggttcaagggattctcctgtctcagcctcccgagtagctgggattacaggtgcctgccaccacacccagctaatttttttatttttagtataagcgatggggtttcaccatgttagcaaggctggtctcgaactcctgacctcagacgatccacccatctcagcctcccaaggtgctgggattacaggcgtgagccactgtgcccagctattttattttttatttcaataagttttgggggaacaggtggtgtttggttacatggataagttctttagtggtgacatctgagattttagtgtactcatcacctgaacactgtacccagtgtgtagtcttttatccctcgctcccacccattacctgccctgtgagtccccacaatccgttgtatcaattcttatgccttgcatcctcataccttagctcctagttataaatgagaacatacaatatttggttttccgttcctgagttacttcgcttagaataatggtctccaactccatccaggttgctgcaaatgccgttatttgttcatttttatggctgagtagtacttcatggtgtgtgtgtgtgtgtgtgtgtgtgtgtatatatatcacattttctttatccgctctttgatgagcatttgggctggttccatatttttgcaattgtgaattgtgctgccataaacatgcatgtgcagtatctttttcatatgattgcttattttcctctggttggatacccaagagtgggattgctggatcaaacagcagttctacttttagttctttaaggaatcttcatactgtttttcataggggttgtactagtttaccttcctaccagcagtgtaaaagtgttccctttcaccatatccatgccaacatctattattttttgattattattattatttttttgagatggagttttgctctgttgcccaggctggagtgcagtggcgtgatctcggctcactgcaacctctggctgcttggttcaagcgattctcctgcctcagcctgccgagtagctgggattacaggcatgctccaccacagccagctaatttttgtatttttagtagagacagggtttcaccatattggccaggatggtctcgatctcctgaccttgtgatacacctgtctcagcctcccaaagtgctgggattacaggtgtgagccaccacgcccagcctattttttgatttttaaattatggccattcttgctggagtaaggtggtatggcattatgggtttgatttgcatttccctgataattagtgatgttgagccatatgttttttggctatttgtgtatcttcttttgagaattgtctgttcatgtcttagcccacttttttttttgagacagagtctcactcttgtcactcaggctggagtgcagtggtgtgatctcagctcactacaacctccacctcctgggttcaagcgattctcctgcctcaacctcccaagtagctggattacaggtgcctgccactacacctggctaatttttgtattttagtagagacagggtttcaccatgttggccaggctggtctcgaactccctgacctcaggtgatccacctgccttggcctcccaaaagtgctggattacaggcatgagacactgtgctcggccattagcataatttttgatggcattatttgtttttttcttgctgattagtttgagtttcttgtagatagtgtgtattagtcctgtgttggatacatagtttgcaaagattttcccctactctgtgggttgtttattctgctgattatttcttttgctgtgcagaagctttttagtttaattagttcccatctatttatattagtttttgttgcatttgcttttggctttttgatcattcaggagcaggttatttaatgaaatctttgcctaaaccaatgtttggaagggtttttctgatgttatcttctataatttttatgcttttaggtcttagatttatccatcttgacttgatttttgtataaggtgagagatgaggatccagtttcattcttccacatgtggcttgccagttatctcagcaccatttgttgaatagggtgtcctttccccactttatgtttttatttgctttgtggaagatcagttgactgttaagtatttggctttatttctgggttctctattctgttctattggcctatatgcctgtttttgtaccagtaccatgctgttttggtgactatggctttatagtatagtttgaagtcaggtaatgtgatgcctccagatttgttctttttccttagttttgctttggctgcatgggctgtttttttggtgccgtatgaattttaggattgttttttctagctctgtaaatgatgatgctcgtattttgatgggaattgcattgagtttgtagattgcttttggcagtacagtcattttcacaatattgattctatccatccatgggcatgtgatgtgtttccatttgtgttgtgtgtgatttctttcagcagtcttttgtatgatagttttccttgtagaggttttttacctccatggttaggtatattcctttgtaattttttgtttgttttttctttgcagctattgtaaaaggggttgagttcttgatttgattctcaggttggtcactgttagtgtatagcagagctactgatttgtgtacattaattttgtatcctgaaactttgctgaattcattgatcaattctaggagatgtttgaaggagtcttcagggttttctggtatacaatcatatcttcagcaaatagtgacagtttgacctcctctttaccgatttggatgccctttatttccctctcttgtttgattgctctggctaggacttctagtactatgttgaatagaagtggtgtaagtgggcatccttgtcttgttgcagttcccagaaggaatgctttcaacttttctccactcagtattatgttggctgtgggtttgtcttttattaccctaaggtatgttccttctatcctgattttgctgagagttttaatcatgatggaatgctggattttgtcaaatgctttttctgtgcctgttgagatgatcgggtgattgttgtttccacttctgtttagtatatcacatttattcacttgtgtgtgttaaactatctctgcatccctggtatgaaaccctcttgatcatagtggattattgttttgatatgctgttgggtttgattagttagtattttgctgaggttttttgcatctatgttcatcagggattttggtctataggtgttcattttgttgttgttatgtcatttcctggttttggtattagggtgataactggcttcatagaatgatttagggaggattccctgtttatcttttggaatattttcaataggattggtactagttctgttttgaatgtctgacaaaattcagctgtaaatccatctggtcctggacttttttttgttgacagtttttttgattaccatttcagtctcacttattgttattggtatgttctgagtttctagttctaccttgtttaatcttggagggttgtatatttcctggaatttatccatctcctctaggttttctagtttctctgtgtaagggtgttcatagtactcttgaatgatctttttatttctgtggtattggttgtaatattgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtatttaccccagacaacgaggctgcttcagtatctcccgtttcatttctaatttagcgtatttggatcttctctcttcttttcttggttaatctaagggtctaccaattttacttatcttttcaaagaactgaaccagtttttgtttcacttttgttttgttgttgttgctgtttcaatttcctttagttcttctctgatccttctttctattctcttgctgggtttgggtttggtttgttcttgtttctctttttccttgaggtgtgaccttacattgtctatttgtgctccttcagaatttttgatgtattacatacattttgatttaatattatgaactttcctcttagcactgcttttgttttatcccagaggttttggtaggttgtgtcactaatgtcagttcagttcaaatacttttttatttttcatcttgatttcattgttgacccaaagatcattcaggagcaggttatttaatttctatgtatttgcatggttttgagggttccttttggagttgattttcagttttattccactgtggtccgagagagtacttgatataattttgattttcttaaatttattgagacttgttttttaattttttttttttttttagaaggagtttcgctcttgttgcctaggctgaagtgcaatagtgcaatctcagctcactgcaacctccacctcctgggttcaagcaagcctcccaagtagctgggactacaggcatgcaccaccacgcctggctaattttgtatttttagtagagacatggtttcaccatgttggtcaggctgattttgaactcctgacctcaggtgatccacctgcctcagcttcccaaagtgctggggttacagtgtgaaccactgtgcccagctgagactcattttgtggtctatcttggagaatgttctatgatgaatagaatgtatattcttgcagttgttgggtagaatgttctataaatatctgttaattccatttgttctagggtatagtttaagtccactgtttctttgttgactttctgtcttgataacctgtctagtgctgtcagtgaagtagtgaagtcccccactgttattgtgttgccatctatctcatttcttaggtctaatagtaaatttgggagctccagtgttaggtacatatatatctgggattgtggtattttcctgttggactgatctttttattatataatgtccctctttgtgttttttaactgttgttgctttgaagtctgttttgtctgttgtaagaacagccactcctgctggcttttggtgtccattgtcatggaataccttttgctacccctttatcttattatgtgaatgtgaaaattgttttgtttaaggaggctaaatataggacccagattccttcttgatcgtagggtttctgctgagaaatctactgttaatctctgataggttttcctttatagattacctgatatttttgcctcacaacacttaagattctttccttcatcttgactttagataacctgtgtttgtgcctacatgatttttttgcaatgaattttccaggtgttcttagagcttcttatatttggatgtctaggtctctagcaaggccagggaggttttcctcaactagtctctcaaatacattttctaaacttttagatttcccttctttgtcggggacaccagttattcttaggttatgtcatttaacgtaatcccaaacttcttggaggctttgttcctttttttaaattcttttttgtctttgtcagtttgggtcagtttgaaagccttgtctttgagctatgaagttcttttttctacttgttcgattctgttgtaactttccagtgtattttgcatttcctaagtgtgtctttcatttccagaagttgtgattgttttttctttatggtatctatttctctggatatttttatccatatactgtattatattttaaatttctttaagttggttttcacttttctttggtgcctccttgagtaacataataatcgaccttctgaaatctttatctgacaatttagagatttcttcttggtttggatccattgctggtgagctagtgtggtcttttggagatgttaaagaaccttgctttgtcatactaccagaattgtttttctggttctttctcgtttgggtagactacgtcagaggaaagatctggggctcaaaggctgctgttcagatccttttgtcccatggggtgatcctttgatgtggtgcactcccccttcctctagggattgggcttccggagagccagactgcagtgattgttactgctcttctgggtctagccacccagcagagctactgggctctgggctagtactggggagtgtctgcaaagagtcaaacacagatgtgatctgtgtttgagtctctcagctgtagataccagcacctgctccagtggaggtagcatgggagtgaagtggactctttgtagttttgtttagtgagttggttttcttgaatactgggtactagtagtacagttgttacatggacagactcaggacctctggttagccaggatgctacaggcagtggaaatagctgttttcttttttcttagagtgtggttgttcttttatgagttgctataatggcttgagtttgttggcttctagccaggaggtagagctttcaagagagcatcagctgcagcagtatgggggatacaagcttgccctaagatcacctggataagtatttggttttctcagctgatgggtggggacatagagctcccaagagattatgtcctttgtttttggctgtggggtgggttggtgtgggtggtggaaggcggcagtgtgtagagaaggatcaccaggttggggaagggtgaggcttgtctgactcagattgtccttgggcagggcttgctgtggccactgtggggtatgggggtgtggttctcagcactgggaatttgccccaggctataagcctcccactgagaaagcaagcatggctttcaggctccctgcatgctgcatcttctgtgttcatatctgcacttcctgtttgaacctctcccaccccttcctccattcctcccaggaaaattcatgctcaattgaaattatcacaaagttcatctggaactttccttctacctgtggtccttccctaattccagtggcaaccctcccgaaggacccctgtgagataaagtcagaaatggcttccctggggaccaggagtgcttatagggctcttcctgctgttgcttctacttttaattttcgctcagctctcttcagctctaggtaaggttaaatcctactgtttcctggattttcaggttccccagtgaggatgcatgttcagaggcagactccccctctcacactttgggcacttaacggtttttctgctgtctcatggagtctgcaatggcaagctgctgctttcaaagggtctgtgaattcttttggttttcctgatatgtttctggagtagttcttggagcaaaagttcacggtgtgagtctccacatgctgtttctgcacgtccgagtgggagctggaagttagtccagcttcctctccaccgtttttttctttttgttgtttttaaaggttacaaggcctttgtttttccttctgtaaaataagtctttagaagtagtctattaattttattattaaaaactcaagtttttattacattattattgaatgaaaaagtaaaatatatgtgacagaacttctgatgtgctctaggagttgaagattgaatgagatatccttcagtgagctcatatatttatatttcttcttctctttctttttttggagacggagttttgctcttgttgcccaggctggagtgcaacggcgcaatctcggctcaccgcttcccgggttcaagcgattctcctgtctcaacctcccgagtagctgggattacgggcgtgcgccaccatgcctggctaattttgtacttttagtagagccaccacacccaggatctttctttttaaagaaagattcttctgttggagcttgtgagctgaaggacttcaggaaaacccacggaatcccctcaaattgtatacagatttttgtgatgtttgtgtctcacgtgtccgtgtgaagagaccaccaaacaggctttgtgtgagcaacatggctgtttatttcacctgggtgcaggcgggctgagtccgaaaagagagtcagcaaagggtggtggattatcattagttcttacaggttttgggataggcggtgcagttaggagcaatgtttcgcgggcatggggtggatctcacaaagtgcattctgcagggtggggagaatcacaaagaaccttgttaagggtgggagagattacaaagtacactgatcagttagggtggggcagaaacaaatcacaatggaatgtcatcagttaaggctattttcacttcttttgaggatcttcagttgcttcgggctatctggatgtatacgtgcaggtcacaagggatatgatggcttagcttgggctcagggacctgacattcctgtcttcttatattaataagaaaagcaaaacaaaatagtgaagtgttggagcggcgaaaaattttgggggtggtatggagagataatgggcgatgtttctcagggctattcgagcgggattaggggcggcgtgggaacctacagttggagagattcaactggagaaagattttggggtaaggggtaatattgtggggttgttagaaggagcatttgtcatatagaattattggtgatggcctggatgtggttttgtatgaactgagaaagtaaacgaaagacacaaggtccgaataaaagaaggaggaaaataggtattaaaggactaagaattgggagtatccaggacatccaatcagagagtgtccaagggggttcaacgttattgtttgcttggttggcgagtttttgggctctatccttgagttttttatgttgtcatataccaggccagattgatttaggtaaaaacaacactcttcattaaaaaatatacagagtcctctttaacagtaagtcgaggccttggtgattttggaggaaagagaaatgcaaagccagcaactgtttgttgaagaaggattagaaacgtttgaggtaaaaccaggagccactaaataccaagagcctgagaaacagcttgggtgatttgactaataaaggccggtctgttattggactgtatagaggtgggaaggccaaactgaggaattatgtctgacagaagggaagaaatgactgcggtggtcttctcagatcctgtgggaaaggcctctacccacccagtgaaagtgtctacccagaccaagaggtattttagtttcctgacatgtgagtaaagtcaatttgccagtcctgggcaggggcaaatccctgagcttgttgtgtagggaagggatggggcctgagaaattcctgaggagtagcagaatagcagatggaatgctgagaagtgatttccttgaggatagatttccacgatggaaaggaaatgagaggttctaagaggcgggctagtggcttgtaacttaacatggaagaggttatgaaatgacgacagaatagaatgggcctgtgaggctggaaggggatattttccttggtccaagaactatttgccttgtgtgggaagagattgataggtggaagtttcagtgggggagtgggtgggagtggtcagatgagaaggagaaaagggatagaagtttgaacgctagctgcttttttagttaccttatcagcataagcattgtcctgagcgatgggatctgatgccttttgatggctgcttttttagctaccttgtcagcataagcgttgtcctgagcgatgggatctgatgccttttgatggtctttgcagtgaatgactccagcttcctttggaagtaaagcagctttgagaagagtttttattaaagaggcattgatgatggaggacccttgcatagtgaggaaacctctttctgcccatataacatcatggtggtacaggatatgtgaagtgggagcaggcatttcaaatggcggaaagcagtacaagagagggagagtgtggtgggaggtgccacatacttttcaatgaccaaatctcatttgtattcagagcgagaactcacttatcaccaagggaatggcccaagccgttcattagggatttgcccccatgatctacgcagctcctgccaagccccacctcattacatttccacatgagatgtgagtgtggacaaatgtttaaactataaggataaaaagcaagatctttaggagataagcatagagatttaggagattagcctacctgtcatgttcaagtttctatgtaggactcatatgatatagacccttgggccaactttaccctgttgcatgccccgtctctcacatgcaatacagtgactggtatgtagtgatgattttatcagtgaggatcctggtagtaataggtggattttttttttctttttgaagatagtttattgaagggactgttttcagaggtgtgaccatggtttaagataaccaagaaaggatgatgaatcacttagggactagcagcacttggaaactgttattcatccaggtgacagggcaagggtagaaatcatgttccagaactcagtgagagttgtaggcatgaaagaggagccttctcaacaggagctgtggccaaaaaagaaacaaggcaggtaagaaatggggaataaattatgccattatttctctttccttccactctttctttttctgctgatgcttcctctcactggtgaaacccaaccagaagctaaatggcaagtgaatccctagaaataaggcaaggcagagatgcagagcaaggcagataaaactagaaaatgggtctagggggagacaaatggaaataatcaacagagtgctcaatacttatttgttgaattaaactgaatttttattgttaaagtggaaaacaagcaaatgcctgatggtttaatgttttcttatatacaaaacttgaaataaaaatctctttgaaattttggaggcaactatttcatcttttgaatggttgaaatagtaaaaatgttgcaatacttaatctataaaaaattaaatactttatatttttcttttttcttttcttttttttgagacagagttttgctcttgttgcccaggctggagtgcaatggtgcagtcttggctcactgcaccctccgcctcctgggttcaagtgattctcctgcctcagccccctgagtagctgggattacaggagcccaccaccatgcccggctaattttcatatttttagtagatacggggtttcaccatgttggccaggctggtcgcaaactcctgacctcaggtaatccatctacctcggcttcccaaagtgctgggattacaggcatgagccaccacacccagcctttattttttgagagagtctctcatctgtcgcccaggctggagtgcagtggcacaatctcagctcactgcgacctccaccttccaggttcaagtgactctcatgcctcagcctcctgagtagctgggattacaggcacacgctcccatgcccagctaatttttgtatttttaatagagacggggtttcaccatgttggcaaggctggtcttgaaattctgacctcaggtgatctgcccgtcttggcctcccaaagtgttgggattacaggcgtgagccaccgcgtccagcttttattgatagtattaaaagcagttcacatttactgattgtttgacatgtcccaggtcactgtgctaaatcttttacgtgtattcttatattttatcctcacataaccctgtaacgtgtcaatactgttgctatactgttgggatgcatcactgtacaaaacaagttccacaaaggccacagatctttataatctgatattaatatttctataccattctgttgttattgttagtattctctggttactcttgaaattgagcgccttttcatatgttttagccatttaattttgtgtgtgtgttttgtgaaatcactgacttagtcttttgcccgttttctatttggttgtctttttattattaatttggaggaagcctgtgtatatttggatatgtgctattagctatgtgttgcaaatgacttctgccatctgggagattcaagctgaggtattaagagcaggtaggatttgggtaggcaaagatgagtgtttctagtgagatgaaagaataaacaaaattataagggaagaagatataattcacatattaaatagttgaatagtttgattggactaacaccagaaagctcaaaatatgtagcaccagggaagcgctagaaaatggcaaaaatatacctcagcagaacatttgctttaaatcaatacgtcttctattcaggaataacctatttcaggcaggctagacaacctgaaaggaaccccaaagatagtttgcctctctggtaggcagctctaggctttcgctcctctgccagggaatgaatcttcttttactgaaatggccttgctgtcattgccttgtgaaaaggtgtgacttaaaactggaactgatgaggggagaagcctagaggaaagtccttcctcttgtcctccggctctagatttctcagagtttttgcatattaaagttagaacaccttcatgcggctgcccttgctgacctgatgtttctcattatagagtcattccttgaaggttgggactttgatttcctatgacttggtgtatatttccctacagaacttgaatgccaatggctgaatggctttttggttttagcctccctttagtctcagcctccatcttactatgtctgcaccaatgaagaagtctattcattctgttccctagggagattatgctagtgttttaaaagtctctgccgactcttcaggatttgcctctcccaccatttatcagacaaaaatgtttctgtggtttcacttcttaattttgtatccattagaatttgttttggctccaagtgcctaaaacccaaaaatatagtggcttaggaagatggaacttttatttttatcccatgtattaataaataaaggcaattcagggatgggaaggcagctctgtgatcatctggaaccaatgtcttttcatctcattgttcttcctactttatccaagagggttgctccagcagcaatgtatgcattccagccagcaggaaggagaaatggagaaggacatctccttacccctctgtaggacttctcagaagttgcatacactactctggttgtatcttacgtgccaacgcttagttagcatagccatacctaaatctaagggaggcttggaaaaatatatctagctaaaaacaggaattcctgatcatattgaaaaaaaaaaaaaaagagaatggatattgaggattaccattgatccttgccacataaatcttttgttattgtgacactaatagtttcctgagatgtttaaggagaaaagctcagaatattgtgggtatatagccaatttaaaataaattatcatcagaattagcttatatctgacattctgaattttggacccttattttaaaatttttacactggtctagaaggtagaccttaacttttgaattttttatcatttttgataagtttggaagcttgacttctttcctaaacattgatgtaaggtttcatgaaatttttaagtatagcaaatgctgttgaacattgcaaatgtaaaatatggaggaggaaatatgtgctttttatctttatagaagataaatatattaaaccccctattaaaaatcgtctatagaaaaaattatagcaataggtagtataaaagctctgggttagagtggattcaaatatatggaaattaaatgaaaatctagaatcagttcactgagaattagctgatacagtgagcagcagatataatcccatagacactgcatatttttttaagtcctgatcttcacagtagagcttaaagaaagtgtagtattgtaatgtaattattctcattattaaaaatgatttacttttaaaacccagcatgttacatcataagtaatattcattttttcttccataggtaagaagtttgatagctgtaggactgggtgttgcagctcttgcatttgcaggtaagataaagaatacataccaataaattgcaggagaaatctttccaaatagcatctacagtgattcatgagtagacccttagtattctgaggttttggttttcagacataatacattctcattctttccaccatttgtagttactgaacatttgtcattgtagcaaaatctagataaactttatagggaagaaaattagtgataaaaagccagaaaaactagctccaataatagtttattcctggcattttttttcagtttgaagtatagtatactataaaaagaaattttaatattatgcaatgtaagtggcatggagtgcctttattctcccatatttattttttcttgcagacaggtttatacattttaagctgtcagttctttctcatgagcatagttgttccgtgtagtttattgatttgtctctaaacatattggtataattaccttgataaaccctggggaatttttttcactgctaaaattacgtttttcgaaagaatagttcttttttttttcttttttttggaatgggcaagactgtgccccttccagaggctctggggagaagccctttccttacccttcctggcctacagagtttgccttcatccttggctcatggacccttcctccattttcaaagccaacagcttagcatcttccaacctctgtctgactgtcactctcctccttctctcttaaaaagattttgtgattacactgggcccacctggataatcaaggatcatctccccatctcaagatcctgaacctaatcacatctgcaaagtcagttttattacataagggtaacatattctcaggttccaaggattaggacatggacatctttgaaggccattattcagcacagcacaatgctagtttttcttttttttgagacggagtcttgctctgcccaggctggagtgcagtggggcgatctctgctcacttcaagctccgcctcccgggttcatgccattctcctgcctcagcctcccgagtagctgggactacaggcgccagccaccatgcccagctaatgttttttgtatttttagtataaaaatacaaaatttagccaggatggtttcgatcgcctgacctcgtgatccacccacctcggcctcctaaagggctgggattacaggcgtgagccaccgtgcccggcccattcgaaagaatagttctgaagatctaaagtaaatttgctgagtctgtcattaacttacagcagttttaaattacatagctatatcctaattaaatgttaatttgagaatatgtccttattgataaagatttacttttttgttctagcatttgtgtttgtaagttctatcggtttgatcttgttaattggctcttttaggcagagctgcattccattttggctatatagagtttagtaagatctgatagaaaaatgagaaataagagggtcttgttttgtatggtatttattttctcacaattatcatttaaaacactattttaaccttttgtcttggaaatgatgaaacacttcaacaatcagaactttaaaatctagatcagtggttcagattctcttgatgtttttgtcatcaaggtcttatgtctcagttatataacttatacttaatgaatttctgaggttttatgagaagaatatcatgtctcaaacagaattctgacaaacttgcccctaaacataaaggaattttagtattaattagagtaggcatagttatgaattcaaatgtaaggttttgatttgaaattagataaagatgtattttttccagggtcgtctttgtaaaatgacaagaattggtgtgtgtattctttatagaccacaccattcccaaactcgtattactgactagaatattatattaaataacaacaagatctcttccagagccaaatacaaccaaataatagaatttaggagaaagtacacttagatgtgttagaactaggtcttctagttagagtaaacctccaggtgtcacttcttgaagcatttaactgctttttaactgagattagaagtcagtcactgtggttttgaagaattttgaggtaatataaaagctacatttcatactattataaaatcaaatggaagatgacatctatgtgataagagatacaggcaagttagggaatcagcctcatttaatttcactttatttaatgttctcctttatctcaagacctttttatcttcacattttcccatttctggcatcctgtctttcactgtaacatgtttgcacagaataacagtatacataggcaggtaaatttttctaaaacagtatacataggtagttgaatttttgcagtagaactcttgatttgcaaataggcttatggttagaagttgaattaaagcctgtagtgtcatatactggttttctagcaagactcttggagaaagagatactagtagaagacacaatctgattggggtgcaaaagataaagtagctagataatattttactcttatttgatgccctcaaaataatttagaacctgttttactattgactcttagttgttaaaactcaggggagttttgattattgggattcccaactagggaaagaactaaaaataagttttcagagagagtagccatcctcagtgagaaaaattgataattaacatccttggtaagtatttcatatgtaattgcttttttactttagagataattgattaaaaccatttctgtgtagtatagatcataaatataatttgttttctatatatttcaaagtgattatcataaaaagcaatacaattaaccattttagtattataagtatcttttatatgtaataggactttacagtttgttgtataaagaatactaggatgttattttttttgtgacctataccataatataaatgtaagatattacacataaacattgaaaatttctagttttatgatcataaactagaacttgataaatttaatggctatgataatggtattaacatgaaattttgccctccaataaattaaaaatttgaaaaaattgaccatctttctggtaagttttgaaatacttattgcaataacatatataaactatcaataaatactgttgcaagcactttgaaggtgttgattgattttgattatagaaaatacatttgcttttattccctttactatttaggtcgctacgcatttcggatctggaaacctctagaacaagttatcacagaaactgcaaagaagatttcaactcctgtaagttaaacgtggctttagttagaagactcattttgatttttgttcatatgacatatttcaattaacttagaaaatgtcttggattttccaatgtttgtagaagtttgtttccttcactatatcattggtgagtttgtctaatttactggctcagtttcttttaagttattggtcacattatttttatatctaactttattcctggttttgacatctaattattataatctgtttagtagtattacatcaaatttgatgtaacttactttacccgtttagttactgttcatttattcaataaacatttagtgagtcccccatccctgtgccaggagcttggaatagctgatgaacaaagaagacatggttcttgtcctgatgaagcttatccaagagttgatgccatcttgtaatttgaaactagtccccttataccatcatgcctggccatctcaaacataaaattatgagatttcaaccatgaaatcctgtagaacttattatacatttttgtaccagcattatagctactctggggagctgaatgtaagtgaaaaaatgaatgagagtatgtatccgtaaaagcaacagtatggattgtagtttgtaaccactgaagacaatataaagaaaagtcagtgaggccctgcagcgtaaacattggcttcagggaaacagaagcagatctgggatagatcaacttggttgagacttgagattgtcaaattgctgcaaaccaagttgatcatccgctattctgctattctgagttcctggcacagggatggggactcactaaatgtttattaaataaatgaacagtaattaaacagggaaagtaagttatgtcaaagttgatataatactactaaatgtaaaactactaaactacctactttatatatgttatttcaataaatatttcaaaacttaccagaaagactgtcattttttccaaatttataatttattggaggacagaatgtcatgttaataccattatcacagctattaaatttatcaagttctagttcatgatcataaaaccagaaattttcaatgtttatgtatagtatctttatattatggtataggtcacaaaaaatgaattgcttcttttagcaaagacattacaggcttgtgaggcttagttagccatgaataatgacagcaccaaaggatgacatactgacaaataattaaacttagattcaaaaaaacagcaagtgattttacagtcctataaatgcatgtctgtgattagagggaacataggtgtattttctgttttcctatttatattttatttggctaaaatattggtaggtattcagtaaatattctttgagcacctactacatactacattaccatagacagtgggatatagttatggaccaaagacattgccgtctaggagcttacatgttagtggagagacacagtgtaaaaaaaaaaaaatgaagtaagatatataatacctaaaagtgtcgagtgcttttgagaaaaccaaatcagggtaagaggttaaagagtaacagcaatgaggaatctttaccttagataggccaggtaaggtttctccaagaagataagggagcaggccatacaagcctctggtgtaagagcttcctaggtggtgggatcactgcaaaggtcctgaggtgcaaatgagtctagcagcaagagtaactccaaaggagtatatgaagggaatagtggtagcttgggcccagatcccttagggcctaatagacaatgaaaaaaaacttcaaattttaccttaagcgtgaaagaaagcccttggaagggtttgagcatggaggcaatgtgatttgtattttaagttatcactctgcttgctaccttagagccagagtagaagctgtgaaaccagtaagcgggtattgagatagtccgggtgatagatgatggtggcttgaaatagagtagtagcaatggacacagtaacatagttctttaaatgaattctatttatatatttccatatgtttataaataataaatggaaagaatttcagaaatcgtttcttttctgttacggtgatcttcaatatagtgtaaatagaaaattaccaagctgtgcaaaactacattatttaacattgtaaaggaagagagagcaagaaaatgagaaaatcttcagtagttggtagaggcttacagataaggccgggtaattcaagagattataagggatatactcatgtaaactctttattcagtggctcatatgacctgctccctcatctcagaggagccttacttaagagtctgagcctggtacctgcgtttcttaaagggaaatgatgtgtgtacccccttttccctctttgtggggctcaaggtaagaaacttcgccttcaataaatctggcttctttttcacaaagtgctactcttaagagtttgcagtaaaacatcttagaatatctttatcattgtcataatcataattatatttttacctcaggaaagatgcaagtacttttaaacaattttaaaactagtaatcatttccagggaaactgagaaatgaaatatgtgcatactttctgttggtactaatgaatcccagtgtcacacctcataaacacagtatacacagtgttttgattttgtaaatattattaattattgaaccaaatagggttactaaaaagacaggaactgtaattgtgggtcactaaatctctgtcattcaaaaaagattgtccaaggctcaagtttcaacggggggtctcttttccttgtttctttaaactttatttgctttctctaagctttaacatgttgtttttcaatcttatctctttttcatacttttttttcatcttgctgaaatagtgccttggataagtcttttatatggaatgcatggatggtaaatgtattttctgctttgttaaacagtttgtttcttttgttctcactgttaattatcagctgctagctccttgaaatctggtgaagccaacattagagaagtatagaaatctctgctgagactaagccttagtgcctgaactcccgcattcctgcatactcacagctagattttttggtggtcttattattcttattccattgtagacaacctattgttttggttttcttttgttgtttgggttttggggttttacattttggtggtggtggcttttatttttagctctgaaagtttgtaggattttctctttcttactgatgttctggaatttcacaagaattcttagtgagccctaacttatttgaaaatggtctttagttctgtaagattttcttacagttttttcttttattatttcttcctttcattgtctctcttttctgcttctggaactctgaacagagagatgagaaagatgttggacctgataaaaagatgtctgtcctctatgtctcttaccattttatctcttattttccatctccttatctttctttgctcttcattctacagtattttcacagcttattttccagatcaccaggttggcctttagcaatgtctattctgtttttcatctatccaccgaattcttcacatcagcattttttttttttttttggagacagagcctagtagtgcggttgcgcaatctcggctcactgcaacttctgcctcctgagtttaagtgattttcctacctcagcttcctaagtagttgggattgcaggcactcgtcactattcccagctaatttttgtatttttagtggagatggagtttcaccatgttggccaggctggtcttgagcttctgacctcaagtgatccacccacctcaacctcccaaattgctgggattataggcgtgagccactgcgcccggccaacgttagtaattttctaacttccaaggattctttcttgtttcttttttctggcaacccattttttaattaatgtggtatccttttgaatatttctaaagccattaattagcatttggccaaattctcttctgcttcctaatttatctccttttcctaaagtcagttgttatgtgttcatattggttctttttttcccctccatgataattgggtttgctcaaatgtccagtgatccttggttgttgattcatatttatgatgactaaattgactaatagaagtaatgttcttgacttttcttcagcagtttggtagggttgcttcaacagcttaattgaatgacagtgttgacagtgggctgtaaataacataggtgggtttgttaacaggcatgtctttcagagcaaggagactagaaggcagcattggtacctggagagtccaggagaggttgagcaccgtgtatattttactccttggcatagcttctcacctccctaggcttctgggttctgaaatgggatctgctggtatgcctctttggttctcttagtacctaccacccaaaataagatgcgtatcagaaaaagaggcatatggttctctttctcagcctgagggcatgacaggtacctggcctcttatgctctatatgagtagagtaggaatgatctgtttatattgttctggtttaataagtttcgctgatttttttattgttgttgactctgaatttagtgttcttgttttcctgaaaagggtttctttttttctctgatgtttgaagctgctgggatttttctgtacatgcaaattttacctaggatttctttaaactttctggtttgctatttatcccatttcttgttttctaggcctattaagggtgttttaaaatttacagtgtctttactcatttcaaaggcacttcggaaagcaaaagatctttatgattcagtctgctcttttgaacaagtgcccttttgcttgtttttttgttttttttttaaattaatgtattaatgtatattattgactcagccaatgtctaattacccttaaatttttttctgggggagaaaacccatccttcttcttttttttttgaggctttgaattttctatttgtgaatctgtccttttatttgaatataattttttaaattgcatttattttgttttatgatcaagtgaaatttatggaaaaatatactaattaaatcatcctttgttagctttaaatcaaatagattattgtacataataaagtttatagtttatgataaatgtattcttttaaaactatgggatgatccagttcttctctagttgtctggaggacttttgtgtttcaggctattgagtgaatgaattagctaatgaatactttggtttaacttagcaaaggagacacaaaataatctaacatggcactatagcatttattgctaattttagaaggaaaatgattttgatttctgtcatttatatatacaatattttatgaatgggatagtacaaaataatcatttgtaaggtccaggatgtgtttctgttttcagaaaaaaaggaccatttactccatctatttgatggtatacttgttccttacagtaatctcattttttggatctaaacattttctttgacctaccacagtgttgtcagaaaatggttctgcagtggcttatacctgtaagtcctaatataatgcaatgtgggtatattattttcaagcttaaaaggacctttcagttttattagtggggaggagtacagagttacaattttgtgctttctcatgacatagatattaattcaaacataataatggattaaaatactgtgataacagttttgttctatttaaagttatataagacctaaattttctagaagtttaggaagcatgattttctctgaagaaatgtgtaaatacagttgacccttgaacaacctgggtttgaactgcacaggtccacttaatcatgattttaaaaaataaactcaatgagccctccatgtctgcaatgaaatgtagatcaaaaatgtagtattcatgggatgcaaaactcacctatgctgaggccaactttttgtatctgtggtttctgtagggctgaccgtggtgcctgagtgcagattttagtatgagtggtcctggaaccagtcacccacagatactgagggttgaatgtattttagtagtgtgtaacatagcaattttttgttttctctttgtatacttttctgcacccagccccacatgttaagtctctattctcaaaatggtctagatctttttggaagggttgtgttgattatatgtatatacagattgacttactcgtaataaaatcagtgttcatatgaacttcttcccgacactagatttttggcagccttttctgaaactctatgtctacctgggcaaaactgaaagtgaaaaaattgctcagataccaatacctgcttttaagattaatgagcttggtgactatagtgggaatgacagtttatgaaacatgataaatttatcttttttattatgctggctccaaattttagagctccctaaggtaaataaagactcattgaaatatttttttcctgaataaagaattattctatgtagtagttcaggcatgatttaaaaacaaaagtaggagcaaatatttggtgatacttctgttttgttatgactaaatcaactaattacctttaatttagggagtaacgtatgcatctagtaaaaattttggtttcctgaaagaaaccttaaaaccagcccctattcctctaagtccctcgttttttgagacagtctgtctccattgcccaggctggagtgcagctgtgcactcacagctcactgcaacctccacctcccagggtcaagtgattctcctgcctcagcctccagagtagctgggattacaggcatgcaccactacacccagctaagtttttgtatctttagtagagacggggtttcactgtgttggccaggctggtctctaactgacctgaggtgatccgcccgcctcagcctcgcaaagtgctgggattacaggcgtgaggcaccacagtcggcccccttacttctttccatttgtatctgtatctgtatttctctctctatctctctttatatatgtgcatactctctatgtatgtttagaaagatataaaatttgttcaggttagtatgtgtgcttaacccaatttgattatccttcctctcctcaaaacttgtgtcaggggtgggggactatttgtttttttactggattataaattacttgaaacttggagagtatattatattctcacagtattgattcattgatagattagcatctgtgtgatgaaggacagtccttgatctctcatttgaaaagtgcctggtacacagcaattgctgaagtgtttattgaatgaattaattgccaggaattatttattaccaagtagaaatttataataagctgttcaaagagtatagcttatataaatggccagatctgactccctagaacccattttttaagctctagtcatttccttagtttcttttagtattcttctttctttaattgtataaatagcctgtgctcattgttgaaaatttagaagttaaaaacaaagaaaaaattataatcccaccagctaaaaataactttaaagttatatgctttcagattttatttcatgtaagcatacctatttttccctacttttgtaaggaaatggtttcatgcttagaaacgtttaatgcctgtaatcatatatgtgtatgtttcctcctaaaagctaagtttatacatcctgtttctctgtttagagctactgaaaatagtgtctttacttgctgtctccattcctttctttccattctgtcttaaatacactctaatcatacgctcacctcactttctgcagctcttctcagtttttgatgtcctctttgctaaatccagaggtcagtttgtggctctcattttactttacctattagaaactttgaaaccatttttcatttcctcactcttgacttgtagttaccatcctcctttactgctaggccttgtcagcctccttgactgattcctctccatttctataccacaaagtgttgcagtctttagggaagactccttggacttctaatttttaaaccatcttacttcagtctcatggctttaaatgctatctgtacactaatgactctcaaatgtaaagtctgatgttaagtcagacattctccacttggatatttaagacattttaaacttagtatatccgaaatcattctcctcatgtctgttattcacaacaaataaacagctgctcctttcctcagtcattaaatggcaatttggcagtttaggccagaaaccttgaagtcatttgcacagcttgggttctctggaaagcagagtgagataaagattagcaagctatacttttattaaagagtgctcttagcataaacaactccagaaagaaagggaaggacaagttaggcttcagtgcattcctacaaaagcctcagccaatctcacaataacctctaagcaaggatggctcattgtagttatcccaagttggggcaaggggtcataggattaaatgacattacccaggaagtgagcatatatataagaagtccaaggactgaaccctagagaaatacaatgtttctatcccatgtcaaccagtcagtagatacaggctgccctgcaaagtgggataagcttgacttcctttaggcaaggcaattcctaaagtgtctgacagctgggagctatcagccagccacagccccagtgtctggggagtaagtccttcacgcctgatggggatctgatgagcacataacagtgtcctcaacatcattcttaatttttctttttctcatatcccaaattcaatccatcaaggaaatgttagttctgttttaaatatacatccagaatctaaccacttttatcacctcctctgctaccgccttagttcataccatcatcatctgttgtctggattattgttatgttttctgaactggtctgctacttctactcttgcacctttctattctctacatggcagttagattaaatcgaagttagattgttattccagtgctctggcttctcctcccacttaaaattctaaattccttccattgtttacaaggccatccacagtctggttcccattatatctcgagtcctccttttctccttgttcacgcctctccagcagcattgaaaccttttaatccagcttcccagcctctcttggcttgcctgtctgctagtgtgacatactcccctcttcattagttcctccccattctctgttggctagtgtggtaggctaaacgatgtctgccatatcaacattaaatgacttcatcaaggttatccaatgagaaaagtactacagagcttagaaaaagttcaagcattttgcttctaccagtctgttttgttctttctgttgtatcttggtgtagaaaaattaatctgttttaaagtgaaaaaaagttagtattttttaagacttcatattggtcaaaatttcttgaaaagtttcattgtttggtgcttccccccgccccataattttgagttgacttctagtaaaatgcattactctcactgcagctacatgatgagattgaggtcatgccacctcatacgtggaactaatgatttcttgctctttctttcctatacagagcttttcatcctactataaaggaggatttgaacagaaaatgagtaggcgagaagctggtcttattttaggtgtaaggtaggtgtgcagcataagtattgttttgttgtgtggccaagcttgtctttaaaaaagagaaaacgttacaataaggttatacttagacttaaaattatgagtaggtggcagaggagaaaatatcaaatttttatattttaaagcctcaaatctaaaagtatcccactcccctaaaaaaacaaaacaaaacaaaacaaaaaaacaggcaaagttgtgaagtacctttattctttaacaaggatctataatatttgaatactgatgtttcagttaaccaaaatatccttttttgtgacattctctctagactcagttttataatttgatatcatattgttaattataatccaggatatgtttcatagttcttttctgcttctgcagtgtgacatcaagcatatttattgtgcttgtttcaccttagtatccttttattgtctaactttggacaatatgagagaaaattaatgatattatataattgctgtgtgatatcatttaacatttaatgttaagaatattttcccctatgataatcatttgtttaccatatgttcccttagagcctactctcaagtttttgtgggaattggttacagtatgtcatgtacaacaaatcttctgatgatataatcaacacaattaagcaaattagataataaagtcctgtattgacaaaaatgttttgatatcttgtaaattttttaaaatttaaagattttttaaaaagccaaaacattttattatttcttatgacctagcagaaaaaacaagagttgggaggaggagcccagtttagtttggtgctttatttaagagatctcatctcttcttagatgagatctctccttaccagacaatagaaaataggaaatgattttaagcatgagggtcagattaggaagtttgctatactgccaactatttcttgcttaatatcattcagaatggcattgttatttttcctgaacttttattggcctcccaaaataccctgttgattatcttgaaatctgagtataaaacattataaaaccaagtacaaaggtttttgaggatatcctttaatattatgcagggcacttacgttgttaggacagacaggagttgactgtatttttacattctcttaagatatatatttataaagttttatcccatagaactgaaagctgtataaaattcacttggaaaattcagtgattaagagcacagactctggtatcaagtatatatgcgtacaaataccagtttaacacctattaaatgggtgaccccagtttaatcatctgtaaaatagagataatagattagttttaactgcataaagttgccgtgaagattaaattatataatatatgtgaatttctttttttggaagtttttttcttttttaaacttttaggttcagggttacacgtgcaggtttattataaagataaacttgtgtcacaggggtttgttgtatagattattttgtcacccaagtactaagcctagtacccaatagttattttttctgctcctctcttacctcctaccctccaccctcaggtaggcctcagtgtctgtttttcccctcttactatttagctcccacatgtaagtgagaacatgtgatatttggttttctgtttctgcattagtttgctgaggataatggcttccagttcatccatgtttctgcaaagcccacgatctcattactttttgtggctgcgtagtattccatggtgtttatgtaccacattttctttatcctgtctaccactgatgggcatttaggttgattccatatgtttgctgttgtaaatattgccacagtgaacatatgtctgcaacacatggtacttactaactactcaataaatagcagccaagcaaagcagattattgccctgagtctgtcgcttaggcgctgccctgtatgatcttggtcaagcttttttgttttgttttgtttttagcttttctatactttggcttcttcatttttgaattgagagtaataatattctgccttgttggaataatataagaatgatatgatgatacctttttacataatacctaccaaatatcaggtgctgaaaaaaatttggctcctgtttctttccatgtctgtcacgaacgcagaagctagatatttgtcctaacacattaagtggaaaggtaaatgaaacttatctgctttcctctagccctttcttttcagtcaggcaatgttgattatgacaagataattttaagatgtgagtatattcattgaatctcagctgtgtagactatataacaggtaggtgaaggcaaaatggagccgatccttttgataacctattttaaaaatactgtatgtgttctagatgatactatacattctgacatattgcatatgagaattgtttattgaaatgtgtatttgagtctttgccttatgtttttccttgcaagagaatagtgtcctgcaatatgactcatgtctgtaacaaaaagcctgaattattttacaaagctgcccaggaaaattgtttttatacctggtatagtaagtcctcacttaatatcacccatgggttcttgtaaactgtgactttaaacaaaatgactataatgaaaccaattttttaaatcaatgaaaggatgttgaaggaaatgacattattcagggacctgccatacatcattttgcttaaaatcacagtttttaagaacctatcaacagtattgtgtattatatgaaatgatgcacatttatgatttttttttttgagacagagtcttgctctgttgcccaggctggagtacagtggcacgatctcccctcactgcaagctgcgcctcccaggttcacgccattctcctgcctcagcctcccaagtagctgggactacaggcgcccaccaccacgcctggctaattttttgtatttttagtagagacggggtttcaccgtgttagcaggatggtctcgatctcctgactttgtgatccgcctgcctcagcctctcaaagtgctgggattacaagcagaagccaccatgcctggcacatttatgatttttaagctttctaaaaacttttgtagaattctgtttataaactatattagtccattctcaagctgctatgaagaaatacccaagactgggtaatttataaggaaaaagaggtttaatggactcacagttccacatagctggggaggcctcaataatggcagaaggcaaaggaggagcaaaggcacatcttacatagtggcagcaggcaagagagcatgtgtaggggaattgccctttataaaaccatcagatctcatgagacttagtcactatcatgagaacagcacaggaaaacccgcccccatcattcagttacctcccaccggttcccctcccatgacatgaggggattatgggagctataattcaagataagatttgggtggagacagagccaaaccatatcactatatgttactcaaaagctcagtagtagaaaaaaaaaaagatgaaaccaaaactgctccatttgccagaaggtccaagaacaccactccacatacccccactgccagccagatgcattctagggaggtgtttgaaatctctggtctaggtaccatcatatttaaagttatactggaggtatatcatcatagctacatttagtttttatactaagcttaaaaactaggcttctctcatgttgtttaatctttacagcaacaaacatgtattaatattaaaatgtattaaggtccaagagacttaatataataataactaaaaggaaataaacactgccagcaaagcagaataggtctcatttccagagctcaccattaggagtctgatcattattatcttaaaggcagagtgttttgaatgccatacttgtgcatatgaactttccttccttgtgtttactttagttcagtggttggtggacctcagtatgcataatgcgttgtggagttttatgtacaaaactatgtggaactgattttcagagcattgtaattaattatcaaggaaattttgacggagtaattttcagattttgtattatgtgctcaactaaaacttaatatctagaataaaatggaccttgccatatatcttctaaaaaaatacaatggttcagcagaacattcacctatatatatatatatacacacatatatgtgcgtatgcgtatatgtgtgtatatatatgtgtgtgtgtgtatatatatatgaaatttggattttactgaacttatctcattatttagagggccacatggtgatgaaatttatgaaataggtttttaaagctcccccttttttactttaaaattatttgcatagtaatcctttataatattagtatttactaatatggagtatttgttattttaaggagtttacctttttacagtcatttttggagggtgatgtaaaatgcattaagcacttgtacgatatataatcctaatttcttttttttgtttttttttgagacggagtcttgctctgtcacccaggctggagtgcagtggcgctatcttggctcactgcaagctccgcctcctgggttcatgccattttcctgcctcagcctcccgagtagctgggaccacaggcgcccgccaccacgcctggctaattttttgtagttttagtagagacagggtttcaccatgttagccaggatggtctcgatctcctgaccttgtgatctgcccgcctcagcctcccaaagtgctgggattacaggcgtgagctactgcccccggcctacaatcctaatttctattttaagatacaaatcatagtttcagccctaaagttatttagaatctacctaacacaacatgccaaatacatacagaacagctagaaaacataagtaataaaggcaagatgtgccacagagcacctgtgtagcaaaaaaaggagttgataaatgtagattagccacagaaatcgaaatcattgagctgtaatttttcagtgtaattttttttgtttcttaataggcagttaaacagtatagtgttcatacctctggtatgatgtttaacagttattttctcaaaattcagtagtcttttaaccagacaatgtttaattgtttatctgggaggtacctacaagccaaaaagtaagtttagaatgctgcttcaaagacataggtaaacagccaagaggaatactcttaagtccttataggaaaatatttaattcattttactcatggaagactattttatgtgcctactcagcaattaatagtgcattttaatgtgcttggtgatctatcacttacccacagatcagaggtagcaagtaactagcaaggaactgccaaagactagaacaatagcagaatcaaggattgacagctgatagcataggggaggcactgttcaaaatagaacttaaatgaataacattctaggtccatttagtaggaggacaagcaaacatctgcagaccttgagagtttaattggtaataatgacaatgctgtgagccatccaagaaatgttaagttaggttatttacactttattttcaaaatgcaggagatatctaatacagtctcataagcatcctttactttcatgtgtgctaggttatgttaatctttttacttatattatctaatttttctttaaaataaacctgggggtaggttttattacgtgtatgctacgtatgagaaaattgcaactgagtttaagcaagacatactttcacagctaataagtagtggaatcaagaatttgaacctgtttctgactaactgtaaaagcacatgcttttagctattatgttgtggttcatccatgcaaattaaattattttgagctttacaataattacactgtgctttaagtcaactattattatccccatttgagactcagaaaagttaagtagcttaaacaagatagtatagctattaagtagcagtagtaggattttgttgttgttagtgttaatttttttcccttgcctagaaaatgtactaataagcaacatttccaatactggatacattgggttttacccaaataattttaggattatttaattatctactttaatttttgtttacagcataggctttaacagccaagcttttcccatgggtttttttcacaaagctaaataactatgagacataaagagttttgagatcctctgtaaaggtaaaagataactataatgaagcacttgctacattccaggtactgttctaacatttcgtaggcattaactcatttaatccttacagttgctctagccctgttttacagtgaggaaactgaagcaccaagaggataaaaatttgatcaagcttacacaatcttaagtggcaatactggcattaaaatccagcagtgtgccaggcgtggaggcttacacctgtaatcctagcattttgggaggccaaggtgggtggatcacgaggtcaggagttcgagaccagcctggacaacatgatgaaaccctgtctctactaaaatacaaaaattagccgggtgtggtggcgcgcgtctgtaatcccagctgcttgggaggctgaggcaggagaatcacttgaacctgggaggtggaggttgcagtgagctgagatcatgccactgcactccaacctgggcaacagagcaagactcctccttcttggggggtggggggggaaagtccagcagtatgcctctggaatccaaatacttgtctgctacaccgtatataccgccttccccccaaataacttagaagcataagttttcaaacttacagtattgtctgcagaagctgactcccctaacctatatgttgttttgttttttaaattgattgagaataaggattggcattacaaaggactgaagaaaaacacatgtaacattgaatcaatgatttattttgatggttagtggaattaagtggaaagctgtagtttcatatttgtccacaagatggtgaaattctcattaggtataattttttgaaacccatataaacccttaatttataatctgcatttgatgctatttattataagcactgtaatttctttttacagcccatctgctggcaaggctaagattagaacagctcataggagagtcatgattttgaatcacccagataaaggtaggtagaattcctatttttcataatatgtatatcaaaatatgctgtgaattcctttcagattaaagtcatatatgatatatagttgagatggaagtttgtgcgccacatgtattgtgatttttttctcataaatgagcatttaggttggagttcagtgattcacacaagtagtggatttatattatctgctttcaagaacttagttgctggtttttatatatgacttcctgaaccatctgatgcgcctaccatttttatcaagaaaaatcgaaaacacgagttatggactctttggttgtataaactgatttgggcatcacgaattgtatttatgtaaccttcaatgtaaaagcacaagagttagaggatttcctccaaatctgtgaatgtaatatgtcatagatgattctgaatttctgaattttattctggaaggctctgaggctgagccatttgtttttaactggccaggtttttaatgtaaatttatcttacagaaagacaattattataactttaactacactacagctgcttgagagggaaagcccatatgttcattgctgtttctgctttaaaataacagatggtagaaagttacactgtatttcagaagtcaaaggggggtgggggaggaaagtgaagggtttcttggattcttatttacagactttcagtttcctaattatttcaaaaaaattaaaaacaaattttggattcctctccatcctaaccagtaccaaaataaggcattctttttcagctttctcacttaattacttactataaaagtttttttcgctaagcatcatctctgttggtttttgcacttattattctttagtgtgaataaacatgagaataaactttcaaaagaggttttgctaaagatttctaaacagtttcaacagttactgaaagattcactcagctaatttactttgcattgtgggctatcttatgagcaagtagtgtttaaagaattacgatttattttgagatggtatatttatttgaggtgggattgttgactatagtgggcttactaacatcctttagtctcaccctgtgtggggtagctgggtgtgaaagaatggacttcggagcaagggatcagcatttttctttggcttctaccttccagtcagcattgtggccttgaaaactcccttaactccaaatatgagttttattatttgcaaaatgacaggatttatttctaaagtcctttttgtttgcatgatttaataaccttttatgcctattcaattaatgtagaggctgtaccctatgtttctgttcagatcagatttttaacttaagaaagatgcttttaatgtttttggattattgttccctctgagaatatattgacaactgtggactttttttccatataactgctcattcacccaaaatttataaacatttggagtttcagaaagttcatgcacttcctaaaacccatccatatactcacagttaagaactcctgctctagtaaaagtgtagtgataggaatgttggaacttctctctttgatggagttgagagatgatagctcataaatctaaagattatcctttgagaaggaagattgttttgttttcaatgggaagctaacagattttaaacaaaaatgcctcattgcctttggtaagcgaaatccaagagtatttggggaagtatgagaatgggcagcttttaattttgtttcttcttcttggaatccttcaacatatttactttagccaggtcaccactgggtattataggtagttggaaatacttaaatctcatttccagtgcttccgaattcatgaatatgtttccccacccacccccaaggaacttttctgttggttttgctaccagctgatagaacaagtttggaatttcaaatgtgtgaccaactataatttgttacacatttcattatcagctgtgcaaagaaagtgacaccagaaaattaggtgtgggaaatggctgaaaataaatttttgtaattagttttaaataagcattcagacgtattttggtaaaaaggaaatttttctttttcaatgtagtgagataaaaaaataatgcagtaaaaacatttcgtgtccttgatctaatgctttcaaggctaatatcttttagattactgcttttcttaaattgatgaagaaagaggttggtggttatgaaatgagtagttttacagtaatgcatagtgaatatagaaggggagaggacagattgcttagagatgtcttacaggctgtctaatgcagtcttaatcaatgtgtattttgcctattcttaccagtccagtttgtgcaagttaaaaacagaaaccaaaagtaaacatttagaaagcttataatatcgccacgatacccaaatgtgtgatacttttgtgctatgtaaaagtattggtccactaaagattggaaatgtttaaaatatttaaaaagtacacctttgccgtagcttgagaggcactgatctaatcaatgctgcctcctaaatctgggctttctgctctgtcccggggaaaatgtcctattagctctccttcaagacttttagtgattaagagcttcctgtttcacaaggcagcttgctttactggtggacagctctaactactagaaagttctttcttgcatttagatgaaatctgcctgcctgcagtggggagattctcaaccttttcccacttacacacctttcagtaaacacgcagtattctcacacttccttattagagtgtttaagtcaaaattaaatattgggatcaaaaacaagtcaaagtaattatactgttgaatggattttctctaattattctcattgtaaagtaagctaatttttatctgaagtcctgataataatatattgtaatttcttacagtatattacatttaaaaatgtgttctaaatatttagaaagagataatctccaagagtcagcatggattcactaagaaaaggtgatgcctaattaacttggtttttttttttttttgatagatttactggactgtttgttttggagggttcatctttcttttcccttcatttcagcattttagatttaaggctttgtgttaactaatttttttggtaaagagaaaattttgttttatgcattgattttccttgataaatgctgagatccttaaaagtgaagaacgtggcttactcttctttataacttatatggctgacacatcataaactctaaattcgtaagtttttttggtgagtaaatgaataaacaaatggataaaaacaaggcaaacacttggtaggtaaaacagaattggtagtgataactaatacattaaataatttcttagattagattgataggaaacaacctgacactaatcttccatttattcaaaaattatttatttagcacctactatgtgccaggcattgtgctaaatcttaagacaacttcaacaagacaattagatctctgtccccgtgggatcatgcattctaatggaggagcagacaaaaaataagtaaacctatttcaagttgtagcaaggcgataaagggtataatgagccaagatataaaacacaggagagaggcaactttacataggatgactgggaaaacctctgtgaggagatgtacaggatgagaaggagctagctgtgtgaaaagtggtaaacaaagtaaaggggctaatgtgcaaagcctctgagggagtgtgcttaaggacctgaaggaaaactagtgtgataggaatgtaataggcaaatggaaagatagcatgagataaagtggtacccagatttttaaaactaggtatgtattatgataatgaaatactgtaggttctatataagattttaactttgttccaaatgcaaagggaagttactgttaacttttaaacagtagagtgatataattcagtacaccttttaagaagtcatttttctttcatcgtcaatctctatttttgatttttaagtatactttaattgaagtgtaatttatgggcagaaaagtgcacaaatcataactatattcctttttcactttgccagcctttgcactgatggtgtaaaaatattggtgggtaaaactggtggtgtcttaacattagtcaaggcagtgacaccagtctatccatatatatgcatatgggaaaaatgaatcatgtgatgccatatgcaaaattaattcttaatggattataacctgttaaaagaaaaacttcagacaaatttagcagagtttatttgagcaatgaatgattcatgaattgggcagcactcagaaccagaagaggttcagagggcccccttaacagcataagcagcaagcttttataggccagataaagaagcaaagtagataaattacctgattggcttcagctaggcatctgccttgttttgcatgggcatggtatgatgaaacatttaccttgtttgagcatggtgtgatgagttggctgcttgtgatcagctgaaactatctgtttgttatacttctaagttgggtttcagtttgtgtaagtactaagttaggttgtagttcattacgtaggaactaagtacagagacagccccaggctaatggcatcctgcttatttaatttaacaaacctaaatatgaaaggtaaaactaacttccatattaaaaaaaacatagacttaggcaaagatttcctatacatggcataaattaaaggggaaaattttgcctctattcatgaaaaaaactaactggttattttgcctttttttgaaagttgacagatattgttatcaaggcgctctggcctcttaaaagaaattgggcagcattctttactttctgaacgtttgtgtaagattagtcttctttctttcttttttttttttttttgagatagagtcttgctccgttgcccaggctggagtgcagtgttgcgatcttggctcactgcaaactgcgcctcctgggttcacaccattctcctgcctcagcctcctgagtagctggaactacaggcgcccaccaccacacctggctaatttttttgtatttttagtagagatggggtttcactgtgttagccaggatggtctcctgacatcgtgatccacccaccttggcctcccaaagtgagattagtcttatttctaggtatttgtaagagttcacaaatgaagccatctgggcttggagacttctttgtgggaaggtttaaaattacagattcaatttattttattttttttatttctttattttttatttttgagacagaatctcactctgtcacctaggctggagtgcagtggcacgatctctgctcactgcaacctccacctcccgagttcaagtgattctcctgcctcagcctcccgagtagctgggactacaggtgtgtgccaccacgcctggctaatttttgtagattacttagtagagatggtgtttcaccatgttggccaggctggtcacgaactcctgacgtcaggtgttctgcctgccttggcctcccaaagtgctgggattacaggcgtgagccactgcgcctggccaattcaggttatttaaaagatacacatctctttcacatttttcatttctccttaatatcatttttggttagtttttttcttaggaatttgttcatttcacctaaaatttcaggtctattgttacaaatgggttcataatatcttcttattaccttggtaatgtttgtaattgcattgttaagccacatttttattcccaatattagtactttatttgtatcatctcttattaatctgtttataaaataattttttgcatcattgttatttcattccttccactatctttgagtttatttgctgttctttttctaattttttgaaatgaatagtcagatcactggtttcagctgtcattcagttcaaaatactgtaattttcattatgattttttttctttgacctgtgtgttatttgacatgcattccctcattttttaacaatagagggttttgtagttatctctatagtattgattgctagcttaattccatttgggaagagaacatactctgatttcaataatctagcatatggtcaattttgggaaaaatttgtgatcacttgaacagaatgtatattctgcagttactctatgcaatgttctagatatgtgagtaaagtttgttgactgtattgttcagatcttctgcattcttactatttcttgtctgcctactccattatctgttaagataggggtaaaacctcctacagtgattgtggatttgtctgtttcttcatttagatttttttgcttatggtgaaaaggattttggggacaaatgatttaggattgttaaatcttacatatggatttctcccttgttttaaatatctctcatgatttatagtactgctttttgccataaagcctaccttatcgaaaatatgtatagctgtaccacctttcctttggttagtgtttacatggtatatcttttttccatctttttattttcagcctttttgtatctctcttgttggtttgtctcttccaagcagaatgcagtcattttaagtgtgacaattttagacttttaatgtaactattcagtccttttacatttaatgtagtttactggtatttgaatatatacatatacacacacacatgtgtgtgtgtatatatatatataaatgttactttttgttttctatttgactcacctatattcctttttctgaccctttacttttagctggttctgttttttaaaaattttatacttttttctttagtaacttgatagatacatttttttaaaagaccatttattttgggaggcctgggcaggaggattgcttgggctcaggaattcaagaccagcctgggcaacatagcaagaccctttctccagtaaaaatttaaaaaaattagctggacatggtggcacatgccagttgttccagctacttgtgaagctgaggtgggaggattgcttaagcctgggagatggaggctacggtgagctatgatcatgctactgtactccaacataggtgacagagtgagaccctgtctcaaagaaaacaaaactgtttctttagtgactgtccaaagaatacagaatactttcttgacttactacagtctgaaataaaatattactttggccactcctaaagtaatactgggactattaattttttccagttcattgttctttcttctacactgtctaatttcctcttaaactatctattaagctcttaatgtcatttctaaaatttccagttgattcttttttatgaaatccaattctctgtaaaattctctgtaattttacgtatcttttccatcttccctctgttttcttaaatatattacttatagttatttggttttcaggccttctgtttgtatgcaaagtaatttttttgaatgccatacattttgtatgaaagcaacagttttcaaacttttttgtctcagaccgaaaaagactttatatggattctatctgtgagtatttacaataatagaaattaacactgaaaaattgttttctttttatttttctttttctttgttttcattgagacagggtcttgttccattgcccaggctagagtgcagtggtgtgatcacagctcacttcagcctcggcctctcagactcaagcagtcctcttaccctagcctctcaagtacttgggacaataggtgtgtgccaacatacccagctaattttttatttttatctttgtagaaatggactctcactatgttgtccagtctggtccctaactcctggactcaagccgtcctgccaccttggcctctcaaagtgctgggattacaggcatgagccactgtgctggcctaaaactgagaaagtttaaatatatttacctattaattcattttaaaatattaaacttcttatatattagtatagataacataatctttataaaaatatatcttttccacaataaaatttttgaagactaatgagtaaagtgacattgttttacatttttgcacatctcttttaatgtctggcttaacagaaaataccctgatataaatatcaacctctacattcattctgttgtgatatgttgttttgtttaaatgtatgaagaaaatacgacttcacacaaataggtagttgggaaaggaaagagtattttattcatcttttcaaataattgcagatattcttccttgctattaaaccagaactcaacaagtggtagcttcttaaagattagttgcattttggaacctgaaaccatgccaatgaactttcaaggtctattatattaaaatctattggtctatcttttactttgaatttttttttcccatctgtgattttgtaacgtcattcattggtcaaatactgcttcactgagagttacaaatcatccaaatgttgatgtatttcattttatcagtatttctaaagatgtggtccccacactgtcagcagcttcccctgggcaattgttagacatgcagactcttaggttccaccctagacctacttaatcagaaaacctggggttggggcccagcattttgtgtgttacgaagccctccagttgattctaatgtacactaatgtttgagaatcaccgctctaagggttccagctgggtttctggggtgttcagtggggtccctatgcgtggcaggttctgatctctaatcgcagtctccttagcattttgaaacttccaaaaactttactatgcttttcagaagcttcttgcttttttcagaaactttctactttgcttctaccctgtacaagttcagaatttggtatatacttagagggaaaaatcagctgtgtatcaggctctattttcaaacttgcctttttcagttgagttctaaatctttgagtctacaatttttgtcttagcagcttgtgagactgcaagaagccttgcctgcccccagcagcagccttcttgtgtccattgcccatacttctaatttcttgcgttccaccaagaatcatcaaataatctaagggaaaaagcaatttcagaatgtcattttacctctaaatttcctccccttccggaatctttggaccctcaagccatagttttcttagaagtttccctgtaacactaattcaacaggtggggttttttagtggttgtttcatttttgtagtgagttttgactggctttttttagttgcttttagtgtgagcatctaacacactactccatcataaccaaaagcaaaagtacagaaagttacttttgagacagtatgacaaattaattggctagccagtcatccaggaggctggtacagtaatatgagtgagaaataatgatgacctagcttaggagggagacaagaaagtgaatttgagatatgttttagaaacagaagcaacagttactgctgcttgatttgatacaggaaatttagtatttccccttgatttctgagtcaaaaaattaggtagatggtggagctatttactgaaatggggatgatctagagtggacaggtgattgtaaacaggtttaggagaaaagaaatactgtgttgatgttaaatgaattagtcagtagattgtccaagtggaaatagagaataggaattgaataaatgactctagagttcagagaagcagactggacttaagaatcatcaatataagatggtgttgaaaccaaccttaagaggtcatggaaagtgaaagtatggataagaaataggaggaaaaaaccccgaggatccaggtctaaggaaccaaacacttatagatcaagttagaaaaggggaaatcatcaaaggagacagaaggaaaaaaatgtaaggagaaaatgataccatagaagctaagaaaggaatatatttaagggaaccaagtgatcaactgggctgaatgctgctatgagaaccattaaaataaggatagagaggagggtccagagtattttttccacactggaagactttgatgaccttaaaaaacagttttaattggtgcagggctaaggaatgaaaagatgcggaagttgagttagcttatatacacaactattttgagaagttttgtgaggaagaggaggagagaaatggaatattgtctgcaacagagggatgagtcattaagggaaaaatgctgttttttgttttattttgctttttacttttttttttaattataaaagcttgttgagtaatttttagcaggtttgtttgtcagtggaaatgatcgagagaaggtgatttagaagagattaaattttgggggaaataaatgtaatgttttaagtctcaaaagtcaattgtataactgtgggacagagatttggcagtgtttcacatggaaaagagccatgggacatgtatttgatctcaaggcctgtaagattcaacagcataaaagctgctaaaaattttatgcagtcctaagctgcataaaggacacatagtatctttattaaagaccaaatattactgcaatcctctatttatttgttatgcattcattcaattaatatttatccagctgtactgagctaggcatttagatcttatctagaattttgtgtctgtttctggatcccagattttttatggatactgacaaaccaaatagtattcagaggaaattgaacaggatcatgaggtgtctggaaacaatgtcatatgagcaattattcattcaacaaaatttactgagtacttaatgtaagccagataatgcactagatactgaagaagataaccaaagaccttgctgttaggaatcttatattccactgtgagagacaatagtagataggtaattggtagtttaaaaatggccacagattcttcatagctcctcccatcaagaggtggtctgatttttcaccctttgtattcaggttggcctttgtcatttgttttgaccaatagaatatagcaaaaaatgacatgtgatttctgaacctaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtgagaaataaaaagaacattgttgcttttcgccactaagttttggggtggtttgttatgcagaaaaggctgatataaaaaatgcccatgatgtcatggatcataagtgctttgaagaaaaagcagagcatgaggtagagaatggcagctggaggggaggcggatgctgatttacttatagccttcttagaaattctctctaaggagataatatttgagcagagacctaaggcagtaagtcatgcaaaatgaagaaagaatatttcaggctgaagaaacaccaagtgcataggtcctgaaacgagaacatatggtttgtttctggaattataagcagatcagctggagcataggaagcaaaagggagagtggtaggaaatacaattggagaggaagcccaaggctaaatgatagagtggcttgcaagccatactacaaacttcaggttttactgttgggcattatgggaatgctattacctgttatgcagtattaggaagactattttggcagctatgaagcaaatagggagtcaagagtggaagcaaggcagtcactagagaaaactgtagtaatccaagagaatgatactgttttggatgagggttgttgtagtagaggaggtaaaggggaaaaaaaaaggtctaggcccggtacggtggctcattcctgtaatcccagcactttgggaggctgaggcggggagatcacctgaggtcgggagttcgagaccagcctgaccaacatggagaaaccccatctctattaaaaatacaaaattagccgggcgtggtggcacatgcctgtaatcccagctactcaggaggctgaggcaggagaatcacttgaacccgggaggcagaggttgcggtgagccaagatctagccattgcactctagcctgggcaacaagagcaaaactccatctcaaaaaaagaaaggtctaattcaaaatatattttgaaggaacacccaacaaagcttatgaatcaggggtaagaaaaaatgaggaaagatcactcctgggtttttggccaaagcagtggttagagaaaaagaaaatttgctatactgagaaacttagaggggatctatgcaatatcaaatacttaaaatgtggcatgtatatgtgaagtccctcttgtatgcctctatgaggacagaattatgttcactgagaagaaactctaagcagtgaaaatttgacccctataaggaagacttttcttctagctggaacgtaagacatcagtcagctagtaattattgaggctttctggaagttggtagaacagggtactttctaggcactgaagctacagcagtggaaaaagtgatgtgcagatagaggcagcaaaggtaatttgattgaaaactactagagagcaacttattagggatgtcatagaaggaatatatttattgggtaagaggtagaacctcttcagacccttccaactctgggtttctgtgattctctaatgatctgataaaccgaatcagactcaaatatttttcttcagatccccttgtctctacattatttaatgctatattgagataccataccatacaattcaattcatccatttaaggtatacagttcagtagttctggtatattctcagacatgtgcaaacatcgcactcaattttggaacattttgatcacctcaggaagaaacccctttagctattgtcccctcatcttcctgttctcagttcagtttcattgatcagtctgtctgtccttgtcctagtaccacactgtcttgattactgttgctttgtagtaagttttaatattgtgaaatgtgagtcctcctactttattcttattttgtagaattgttttggctattatggtccttccataataattccatatgaattttagaaccagcttgtcaatttctacaaggaaatcagctgagatttttgataaggattgcattaaatctgtaaattagaatggggaattttgccattttaacagtgttaagtcttctgatccacagagacatgatgtttttctatttatttagatcttccttaatttctttcaacagtgttttgtagtttacaagtctgagttttggacttcttttgttaagtttattcctattttattctttttaatgctattgtgaatggaattattttataattttattttcaggttgtttattataaatgtatagaaatacaattaagttgtatattgatcttttatcccacaaccttgctgaacttatttattaggtctaatagttattggtggattctttaggattttcagtatacaagatcatgtcacctatgaatagtgatagtcttacttcttgctttccaatctggatgtctttttcttttttaacctcattagactggcttgaacctccattacaatgttgactaggtttattaagaacagacatccttgtcttgcttctgatcttagggaaaagcatccagtcttcgctcattcaatctgtgggttttttgtagatgctttttatctacaaacatactaacacttagagaacgtctgtctattcctagtttgctaggtgcttttttcctgaaagtgtgttgaatcttgtcaaatgctttttctccatgtattgagatcattatgtgaatttttttttcttttgatgagactcgatatatttattttttggtggttaaaccaaacttgcatccctgtgttaaatcccacagggatttgcaaggtttataattcctgcatcccttggttggttgtggtttataattctttttatatgtttatatattctttttatatgttgctgggtttggtttgctagtattgtgttttagtatctttgcatccacacttataagatatattgatcagtagctttcttatgatatctttgtctggttttggtgtgaagataatataatgtaggctttataaaataaattaggaaatgttctctttctctcttctataagccatcaggggctgggcttttctttgtgggtagttttttgtttactgattcagtctcttgttgcaggaatattcaagttgtctcttcttgagtcagtatcagtagtttgtatcttttaggagcttgtccattttctctaaattatctaatttattgacatacagttgtttctcttctttttccattgtcttaggttgaaggttaagttattgaagtcttttttttttttttttttttgaaacagggtctcactctgtcacccagactggagtgcagtggcacagtcatagctcactgcagccttgacctcctgggcttaagtgatccttccaccttagcctcctgagtagctgggactataggcacatgccaccttgctcagctaatttttttattttttgtagagatagggttttgccctgtttctgaggctggtggtctcaaattcctgagattaagtgatccgtgcccccctcaccctcccaaagtgctgggattacaagtgtgacccactgtgcccagccgtcttcttttttaacatagacatttatagcaataaatttctctgcactgctatcgctgtgtcccataagctgtgggtggtgttattcatgtttaatacattctattattgtcggagaatacagtgtattatttctgtccttttcaacttattaaggtttgttttgtggcctattatatgctctgtcctggagaatgtcctctgtgcatttgagaaaaattgcgtattccattattgggtagtgttctgtaaatatgtgttagttcttgttagtttatagtattaagtcttctgtttccttgttggtcttttgtgtggttgttctgttattgaaagtggggtattagctggtatttattcttcatttcttagtttctgtttttgttttggttggtttttgcttcatatattttggtgctctattgttaggtgcacatatgtttacagttgtcccatcttccaggttgattggcccgtttttcattatggaatgcccctttttgtctctaataacatttttggtttcaaagtttactttgtctcattagccactctagcttttcagtgatttgctgctgtcaggatatgtctttttccatccttttacttttcagtatttttgtcttcaaatctaaagtgtgtctcctgtagagaacatatagttggctcatgcttgtttgcttttcttcaatttttaatagaaacagggtcttgctatattgctcaggctagcctcaaactcctgggctcaagtgatcctcctgccccagcctcccagagtgctgggattataggcattgagccactgtacctggctgggtcatgttgtaatttaatccggtgcgacagcctttgccttttgattggattgtttaatcctttctcatttagtgttatgatttattatttacttttatttcagtagttttgggggaacaagtggtgtttggttgcatggaaaagcttttttgtggtgatttctgagattttggtgcactcatcacccaagcagtgtacactgtacctaatgtgtagtctttcgtccctcatctcccttttctttcttccccctaagtctccaaagtccattatatcattcttatgcccttgtgtcctccaaagtccattatatcattcttatgccctttcacttataagtgagaatatacaatgattggttttccattccggagttactttgcatagaataatggtctccaattccatccagatagttgcaaatgccattattttatttctttttatggctgagtagtattccattatagatatgtaccatgttttctttatcctcatgttggttgatgggcatttaagctggttccatatttttacaattgtgaattgtgctgctataaacatgtgtgcaagtgtctttttcacataatgacttcttttcctgtggaaagatacctagtagtgggattgctgaatcaaatggcaggtcttttagttctttaaggaatctacatactattttccgtagtggttatactagttatactcacaccagcagtgtatcagtgttcccttttcaccacatccatgccaacatttataattttttttgattttttaattatggccatttttggaggagtaagatggtatggcattctggttttgatttgcatttccctgataattagtgatattgagcatttttttaatgtttgttggccatttgtgtatcttcttttgagaattgtcttttcatgtccttagcccactttttgatgggattatttatttttttcttgctgattggtttgagtttcttgtagattctgtatattagccctttgtcagatacacagtttgtgagattttctcctactctgtgggttgtctgtttattctgctgattatttcttttgctatgcagaagcttgactgaaagcttttattatgaatgtgtgttgaattttctgaacttattgacatgattatgtatttattttggctgggcgtggtgattcacgcctgtaatcccagcactttggggggaggaggctgcagtgagccaagatctagccattgcactgcagcctgggcaacaagagagaaactccgtctcaaaaaataaattaataaatatatatttattttttattaatgtggtaaattacatcgattaatttttgaatgtgtaagccagtcttgcattcctgagataaacctaacttggtcatcatatctagtctgatttgataagtgagtattttgtttgttttgcacctgtgctcatgagagatctgggtctgtggtttccttgtgacattttcattagggtttgttatcaaagatatgccagcctcataaaaagagtttaaagtgttttctttctcttctgtttttcggaaaaattcaacaaaatcatggccaggatttttatttatgggaaggtttttaattacatatttagtttcttaaatattcttttgattttccatttcttcttatattaattttgaaatgttttctttttcttggaatttatcttttacatttttatgtgctctgacatgaagttgattagttttttagagaactaatctttccctgtgttgattctctctcgaatgctaatttctattgtgatatcttccttgacgcatgagttatttaggagtatattgattaatattctaacattgggatcttctatatgtgtttaattctactatggtcagctaacagactccgtttcaatgtttctgaaactctgtgttggaggactttgtttttttctctcaatctctggtgaactgacagcttttgtaaaatacaatgaaaatgaaattatgagaaaattgaagaaaaaagtatgtatataagatccaggttttacaggggtacactgttatttcaaacaggtatattttctaaacacttaatctcaatttccaaacctatctatggtctaatagcagttgtaagtcaacattcatccatggaacacactttaaatagcaccgtttattgttattttaatctttgaagtttgtcgagacttgcttttagcctagcacatgatcagttacagtaaatgttccatgtgcagtttaaaagaagatatgttctgcacttgcagggtggaatcttgtatgtgtgtcagttaaatcaagtttgttgatgttatttaacttcagtgttcttactctttcattttgtctacttgttttatgcattattgagaagaggcatcactcactaaaattgtagatttgtgggtttttccttttggttctctccttttttcctttgtatattttgaggctatcttattaggtatattcagatttacaattgctttctcttaccagtagactgacccttgtaacactgtgaaattggctgttttatttttgcattttaccttaaaatgtactttatctaataattagtataacaatgtcagcgttatttttgatagtgtatatttttttctatttcttaaaagtatagtctcttataacaatatataacctgctggatttttattaatcaactttattgagatataatttatatagaataaaatgcacccatttaaacgcacaatttgacaagttctggcaaatatatatgtgcatgtaatcactaacagtcaagacatacaccatttccataagctccaaaggttcctttttgccccttcccattgccaatccctccccacagcctgggcaatcaccattcttctttctgccacagactatagattaaacatgtcttttctagagtttcatatatatctggaatagtattatatactcttctgtgtctggcttctttgaaggaaaaaagcagtgcagaatgttgggctcatcatagtgcatttccgttatctccaggatcttggccctcaagacctgactgacttggtagccctccagtgcttttatactgatgtgtttatattttatttagctcttctagttgggtgtcagtgggagagttggccttaaacatgatggttcacaatagccagaagcagaagacttctggccatatttagtggtagaagtacaaagatacagaaatactaagggtgaaggtgagtgttctaattaaatggaacccactgaattcccctagaaaactgagaggggttgaagagtgttattttttttgttctttttcttttcttttcttttctttttttttttttggagatagggccccaccctgtcgtccaggctggagtgcagtggtgcgatcaagactcactgcagcctcaacctcctgggctcaagtgatcctccacctcagcctctccagtagttcagactacaggtgtgcaccaccacacccaactaattttttaattttttgtagagacagagtcttattatgttgcccaggctggtctcagactcctgggctcaagtgatcctctcacctcaccctcccaaagtgctgggattacaggcgtgagccactgtgtccagccaagagtattttgttttcattaaatttagggtatgcatcctatcctatgttatcagtcaggattcactgccagcaactagatattataaccaggagagcatttagtacaggttacatattgttggaagatctgaaggagcaagttctacacttggcctacaagaatcattcctaaacaattacagagctactctgtcagggaagctgctgcctcacaggctgccactagaactgtgggagaagcacagttgctgccaccactataccacactcttgcttactagtagtaataatgataaagaggtgcagcaagaaagcctttctctcatttcagccttccaagtcccacaagaatggctctaattaatggaacctaatgtgaatcaaacactacttgaagagactataagaattgtagttttggactgaggaacttttccaactatttagaggtagaatgagggtcaaaagaaccagtccaaaatgtctaccatgtacataaattaaaagccctctaacttagagtgagtggtagagaattcaacgttattctgaataaattgtcatgtcatttttttcctctaacattgctatcaataagtataatatttaataagactctctatcatctgtgcctttgattttttccaactgctgagtgagcatagtatggcctatgatttaaatatccataatgcatatcaattaaaggttatgtttaagttcagttaatattttaatatttgctgaggatatccaagacatcgaggacatcaccctgataactctaagaatttaaacagcttaccacattgacattacctaattcctgattgctagattgtcttcaaagataatcatgaaatcaacatatttcataaccaagtgctttaaacttttatcagctttctttgtaactcttatagcatattcagggacatactatgatatattccataagtgtttatagcaattcagatcttgatatgaaaatgtcagttgtatcctcaagggcaaagaggtaaatatagctttctccagcattaccccttctaccacaacaccatgtttgttgatctattttctttgctttcttttcccttcataagctgggtggtatggtatcaataaaaggccagaaaaaagtcagaacaatttacaccaatactagctagatgctttttggtttgttgtaagctactgagaccttatgatattttcagcagctatagatggtttgcacttaaggggagaatacaaaataaaaaacacaaagagactggtgagctgtaatatgattgttagtctaagcattaaacaatgacagtattgaggactagaagttagaaggtatatgatgtttagctttcatgtgacagtttggtgctagtatttttgtatgtaggttctgtttgtgatttacaatgattctgcatttgaaattcacctcaattttcctcttgctgtttgcattagaaagaattcattgcaaagaactctaaaaaagaactgacttaattttattttttgcactgtaaatccaaaactacactctgtaaatattcgaatagaatcatttcagagaacaaaaaaaattttttgacattatttttatctctcatttattaagattagatcatttatctctattaagtaaataggtttttggcactgggtagtatatagttgcctttttaaacatacattttatttttgtgacattataagacttgattaatactttaaaagaccccttggattgatttaccttcttcaaaaagatacccgttttcacagatgaatgtgtctttaaaaaaaaaaaaacagtcatggaaaagactgttattttacttgcctaaccatccacttaattttagaaaattctctggtcaaatacttgaaaggtgaatgtctgaccagtgcagtagttgaatgttgttcaagttattcctgattataactttctttcatcatttttctcagaggtttttttttattgttgggtagttgtaggacttcactaatcaagtttaatttatactgttttgatttctagttagcttataaaataatttgtcagaggattaatgtgtgagacaatattcaaaaaagagtatttttatattttggggactttaaagtatgtcaatgatgaaatgtattttaattcatttttctttgttctctcaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaatgaataaattcccatagcactttattcttcacatggtacataactataggggctatagcttggtaccttgtgaagcaactcttggtgtaacataccttatttctcatactaaaatgcaagaacctttagagcaaggatcttgccattcatctttgtaacctctttactctggagcacttgcatttagcaggcatcataaagttttacgtaccaagaaaatgttgctgttttctgaatactatgcatcaaaaaatgttaccactaatttttaaagctctgctaaggaatattggggcaccctcagatgcaccttttaattgatgtcatattttcctaatccatactttattcatgagaatttgagtcaccccagcattagcttggaatttccttatttcccatttgctttgcaggtgccttggagtcagatctggttttgaatactatcttcctgttatgtgatcttgggcagttacttaattttctagtcaataacccgtatctataaaatagagaaaataatcctacacaccggggcctgttgtggggcggggagaggggggagggatcgcatttggagatatactaatgtaaatgacaagttaattggtgcagcacaccaacatggctcatgtctacatatgtaacaaacctgcacgttgtgcacatgtgccctagaacttaaagtataataaaaagaaattttaaaaaatcctgtcaaataaggttatagtagagaataaggatgtgtaaagcatttagtcacgtaaatgcttaaaaaaatgtaatttttacttctttcactgcctcatttaattagttttatctttaataataccttggattcagggtaaagtttcagttatgtcccagtaatcatttattttaccctcgaatctgcaatttggatagaacatggtggggacagctcgtctctattccttgcagcattaacaggctggaggcaccacttctctggccagcaagttgggcctggttgttggctgagagcctcagttcctttctgcacaggttcctctttacataggcttctcaacagggctactagagcatcgtcaccatagcagctgtcttataacagagagtggtcggtctgagagacaaaaaatggaagctgccaaattgttctgggtctggaaactgtcagggcatcacttgtgccatattcagttggcctaagaattacagagcctgcctcgattcaaagggagaggatagagaggactgaaggaatcagtgctcatctttaatatgcagcaggacaggtttgggattttttttcccccttgagtctgtgaaggcattacttaagaacaaagtcaggcatgtataattgaactacagttacttgaaatataagcccagaaagtttcagataataaatacaactatttttctgctgttacccttgtacctaaagatgccatcctaatccccagatctccacaactatacctacatagtagaaggttaaaatgtatccctctttttctggtgcatccagcaaaagtaatatcatgaattatgagctctctgagagcaaggatcatatcagtcttgtttattgttgcagtgaacaagtacagttgcagatattcaggagtaattatctaaatggcagtaggcttataaaactgaattttcaccagccacaccctccccccaactccttatctgtaaaaagcttatttgagtggttacctgtcttcagtaaagattgcgcttgcatatttgctgtcattgcatattctgcttaattaagctctgttgatattgcagtttctgtgcatacttacatcttagatgcaatctgagggcctaggaaggccttttaaaaataaaacaattccgattgcagagaaagtgtaagtcaaggacagttaattcaaggggaacatagaaagctatttagattttagttgatggtgccagtcttcagcgtaaagtcaaaagtggagggaagtttagtaaggaaaaaatgttgggcttggaatacattgtttagtcttcaaagcactttactttttatgaaatatattttagacattcagcaaatattgaatacttactatatcaggcagtaaagatataaattcattcttaaaatgtgcaacatgttcaaactgaaaaaaatacattcttaaacaggaaactttttccttcatactttttaattaacaagacatataagagttgcattaatgggcgtgcttatgattgatcacccagcagcatcattagaaataatatattttattcatgtgcagaaatcttttggttgtcctggggaaccttgaacacagaaaagagcttttattgataaggtaattgaacacacttgacaattagcttaatatggtttaataccatttgtgggagaagatgaatcagccaggctctttacgtcaagaatatgaagtttctcttgagtcaaccaacttaagatgagctacggagactgcagtgaaaagttaaatatccaagtacaccagccaatttcacacagtggaaccatgctgtcctcgggcaccctgcacctcgcccaacagtcatcaactagatggaggctcctggctgcaaggaggatttgatgggaatgagtaaatgtgtcagcatagtccgtcccttctaatggaaaagcaacccaaagagcaaatcctattaatggctggatcagtatcatctacttgtcaaaaacattccatgaattatgagtcaaaattttatttatggtggcattacacacattaagagatgaggacttctgttagcataatttattagctggaaaagttgagaaggttctctggactcatttttataggtggaacctaagtgatctggataattgcccaccagcaaaattgctgggcatggtggacaaagaaaatgttccttctaatgattttttatgagctgagtagctattgttcccagctgagtgctcttttcctctttttattgttgctgagcaaaagaatttataaaaagctctttcttttgtattaaaaaccctgctcaattgaaatgcaagttcattaagtaatcttcatttctcttcctgccataataaccctttccctctctgttcgattcaacagtatctagcagcactgctccaaattttaagtctgaacagactatattacatagatgtagagaaatactcaatcttcagcattaagagggagcttaatttcacacgggtggaatatgatcactcaggctagatgttggccataaatttcaaattagtatctcaacttagcaggggggatcaacagtggcaaacttcaattatgacaggataaaaatcacatagagatattggttcaatatggacatctaaactataatgctaaaagccaataattagaataagttcattttaagaaaagcattaataatattagctaacgtttagtacctgtgccaaacattctacctatgttaccttgattttcatagccagcctaagaggtactattatgtatccccattttacaggttaagaaacaggctcagaggagtttaggatcttttccaagattacatagccagtaagtggtggcactaggaaccaaattcagactctgaatcgcatgctgtttatattatattgcactcattctaaatatgtgggaatcagaatgaaggggcttgtatgacttttggctcattttttgatgcatgtgacctgggattataaatgtgaaattaggtttacgaaaggatccagtgtcattgtgcatcatgggcaaggagtacctaatctctttaattcttccctggaagcttacgatgtccatccaagtgcacatagcaaaagttctgttgtaaagtttagcagagtgactttctttgactcagagtgatgacggaggaagctttgataagattttatctgaaatgttcatggacaagagctttcaaggagaacatccagagcaaggttctgaagacagctcatgaaggtgaagcagcagacctggcacaagaaatgaagagagagctcagtgtattaaagatgaaaacaagaaaaccgaatatattgaaaggagcagagaggcaatgaaaacaagacaactgaaatgaggtaacttgcagcaattgaaagggaatttcagtacttttatagaattcttaaaaattgtttcctgctgtttattttcaattttgaacagggttatttgtccatgccatactttttttgccaaattccaaaattgtgtatagttctatagttgtctggtggagtcaatggaactttagttaccagtctaagaatgtgtctttgagattgtccagttaattctctatttccagtagctgtaataaatggtgaaaaggtttctgactcctggagaaagtttctaactccttatgactaatattcataacagacttgtgagttccttgaacatggatacacctatatgcaagagtgtattccaaagctaactcagtgatctttccatttatctattcttggattagtggtgcctttgctctttccttctgtaaatgtgaatagttaagagttgactgcagaagtgtttacactttggcttccatgcctctggaatgtttgtgctttggtggtgagatgtgagactatatttgtatagtctgcatctctcaggctgccccagaatgttgtacagtgcagtgctgaagaaagcagcaggtacacacagaaatgcagcctttcctggttaaccctgcttggatctgagttacactttgtttcctgacttcttgggacttaggtaatcagtttgccttctactctatctcattttgtactcgcttacatactacattcttgtttgggctttcgtttcttcttgtaagcagagattttttaaaatccaatatgtgaaaatacggatgcactacaattaaataaataaaatgctgttgtgtttgttttgctttaaaattgtaaaggataaacaataagatagttttatctatgtggttttcccgatgcagttaaaataaaacctaatctgctaaaattgaatttacactcaatttttctgttgtataattcttgaagaacacctcatgtgttgtacaacttcatctacattgtgaactcttttatttattgaaagtctatcttagtctttcactttttctacacttccctttacttcctcatgagatgctcagcccagttgtccctcaggacacagtatcgattggttcacttttaaaagcaactgttagaaacccaaatcatagacatgtgaattttctcagaagccattattgaaacttggatttttacctctcataccaaaataaagaagggaaaaaatagaaatcagcccaacaatacttttaaattgatttttatatttatgttgtaatgcaaataccaaagaaaagtgcctagttccttggtttatttacttatatcttgcctctgttatcttcatatcaatttttggccttagcacttttgactgcataaagaactctaaacataggcaatggtaatagaaatgctgacacatctgaactgtcaggcccagaatatattattgaatatgactgcacaaatgcctggaacctatacttagcgtaaagaataaggctgctgttttcaacttccaacaggaggagagtacagacatatgtgccctctgtttcccctctctggctctttcattgtctttcccctatgtgtgcatgcaggcaggcacacatacaaacacatcctgccccatgaagtggtcacatcttaatatctactaaggccagttagacattctgtgggccgagtgtatgttgcagttgcttaactggcctaaaggtctcatgatatcatgggcactatcgagtgatgtttccaaatctgtagaaggaggaggactggtagtgttgggcttgcataacataaagggcctgtctaccataaaacaggagcttggatttgtttttttcaggagatgaatatgtttttcacagcagtctagtgaattaagaacaatacacagaatcccacagcgagcgtgttctatttgaatctgttgatgggatttatgtatggaacaacaattttctgtatagacataattgaatacatattaccatgatctgaaaccatgcaagaatatgtatggtgtgtgggaaacctgaagacagatacaactgatgaaattattagtttacattttttattcaaaatatttgtgaagcagctattccctacatatgctctatgtagaaatgcagagacaagtagatgattataatgtgtcaccatctcttttttggactgattttttttttttaaagacggagttttgctcttgttgaccaggctggagggcaatggcacagtcttggctcaccgcaaccaccgcctcctgggttcaagcgattctcctgcctcagcctctcgagtagctgggattacatggactgaatttttaatagagcaggaatgccaaaagggaagtccctcagatctggtgtgtggctcaataatgcgctcagttccatgcagcttcttcccttagggctctgagtaaagtctctggtgccagaaggtatgagggtctcttgtatttaataatatcaagggagtacagtgttttccctcaaagcctggccagcagttactcctggagaaagaagaacaatctggttgacaaatgtgtcacccatgtaaactcaccagaaatatctagagccatgaacacctagtggggtcagcaataggtcaggcagtaattgctcagtgcctcgttcgctagcagcagtgggaactgctgtagtgtaaattggttttaggggccaaattgatcaaccaaaagaggcttagagatttttggtgtttgagttactgacgagggttccaactttctggatcacgtgatgaaatgcatggcagttgactctgctatcctctaggttttgtgtctcccttccaacccccatcagcaaccgtttcttgttcttgaggctgcttagcctaagaacttttggtctttgctgtctgggagttacaaatccacaatggcagtgaaagcttttctttctccctcatcctttgtcctttcctacttttggcctttttttgcttttgcaccagttacacttgtgtccatctgctagacacccacagcatcagggtgcttgggcgtggttcctgctgggcagttgaggagctctgggtccacgacccagctctccaagccgcctcaccttgctttccccttctgaaataccactcacctacctgcccacagagggagacagtgagactaacgagaagggcatagggagtaatgagaagaaatgcacagcgtgttctggactcctcgaagagaagtgtttgttcaaggcattattaatatttttgcaaggcacagtaacattgattttttcatccaagaaccatttcgcatttgcacagagtagtcactagagtgttgaaccattttcttttatacatggaggaagtggctcatcctcggcctaagagcaccaaatttgagttggcattttttatttccagttccaggcatgaatctttgctccattttgcaggtagctggaaaatcttctgtttgtttaaatccacgttgggtaatactgcatcattttaagttttctatctggagcccggtacaggaattcaccaatgccaagcacggactctgtgcatagatgccttgtataggctccaagctgcaagcctcccacactgatggatttaaatttttattttacatcccagccaatcaggtgtctgactataacttgaagccaattagtatttttcacagagccaggtgcaaagctgccaggtaacatctgcaagtgacttgcattgctctaatgggatctgcatatgttcagctctgtatgaagatgtttttcacttgacatgaagtcatctttggtcttgttctccctcgactccattaagcagacacacctacgtgtgtggccaatttgatccactttcaaaggaggatggtgcctagtgtttcttttcatgatctattatttatgctgatgcctcttggaaaactgtatctacccatccaaagtgctttgagaggggaggggaaggggtgtggcaacacatctctcagttactatcaaggcattttctgataatacgtggcccaacctaaattatccaataaagatttacttgaggactttgtaaatttcttttaaaaaatatatctgatggaggcaatttttttctcaaagaacatacctgagttcctttaactttgaggaacaaagacgtgggttctagtctcctagtttgcagctgatgagctatgtggctctaggcaggacagcctttgctgagccacttgcataggtgctcactgatggccataggacctgtagaaggagcacacctttccgagtcacactgacctcagtttgaatccctgaccctctctgttggcacagtcatcttgtggaagttttgtgacctctcttttggtttcctgacccatgaaatgggtataataatacatacctcagagggttatttggagagtttaatgctttcatatagacatgcctgcttagtgcctgtacatgatagcttttcaaaaactgctcatcttcacagcctgtcttttttactccactgcttttattttatttcaagtactatacaaatattccaagtggatttttaaaagaatggataactaccagtatttccaacatcctaacctcaactatattctttttttctggggtctcttctagtacatattcacataaagccttaggaattgatcttataggaaatgcctgtaggcaaatatgctcatctctagactggaaattgaaccaaagtattttacaacgacactgtggctaaataagaaaacgtgtttaacagctgaaaacgtcatccaagagcatttagaggaaaaaagaaacagtcctttggccaggattatggcaaagcaaggtatgataatattaacggctgttaattactaagtgcctgatatttgtgccaaacattctttatattatttctttcatccttatagcacccacttagctatgcatctcttttcaaataatgttttcaaatgcataacaaaaaaaaatttcacaggaaaccaattagtttaaaacaacattttttataaaattgaaaaacatttgtgatatagtaacgtatgtgcctcattattaatgcattaaatttcaagatttatttcacaaagaaggggttcaagagcataagtacttttcatagaaccacatggtcaggaaggcttctgctcccaggtcttctacctgcatagtctgtcctcttacccccttatcctgctgcctgaagacacttagggagcttaagactcttagcctaagttcctgaaaacttctctcctggcttaaagtgaatgctgggtaatttatttagtctgctcggggtagtcattcattccaacatgattgtagtccaaggacctcccttcctttcagaacatttgtcacttgtcatgttgcatttaggacgccagaggaggcatccagtgaaatgaacaggaggcacttttgtgacaaatagacttcggaagccaaagctggaactggaaaagaccttgcagatcttcaatcctccttaaggtgcagcctgatggatttccagatccgtgacattttttaaacacttgatcacagcaaaaagaataaacactgatttaaaaggaagacgccgggcctaggtgtaagagagaatgttgccatttttatgtcatcttcacagggaaatagcagatttcatgaactcagactttggagaaaggctaatgtggatttaaattccaggtcatatacttacttgtgtggctttggacaatttactgtaaaatggaggtatatcacctacttcacaggattactgtgagaatgaaataaaagtgatgcgtgtaacacattgacacttggctggcgctccgtaaatgtgtgcacaatacaattcctttcactaaaccagtgatcctctgctttgcctgtttcttagaatcccctgtgtaccttttacaagttctaatgcccagacagcaccccggaccatcagactttttggggtgggagccacgcaacagtatttctccatatccagccaacgttgagcatccctggactagatgcaggctgagtgaggcccaggcacagagggcagcctgtctgcaagggctctgcaggaacacagctcaggacggcagcaggggtcagggcctggggcagtgtggacctctcagctcactccaagagctgcaggcaggaccatccccagggcgtaactgagggcaaatcactctgagggcttttcttctgccacagcacttttatacaagcgaaacagaaaaaaagggcagcctggagaaagattatgatcaaagcaggcagcttaaagagtgatggtaaggaaaggggaaaggagacagccaaacggggtggtgagaaccagcctgcacccgcacatctgactgtgaaggctctctgactttcagtgcaactgtccaaagtgatcgtctctttcacccgctcagaagtcaaggactgggagactcattattttgaatagagtttccccgaatcattattgggaagttcaagtgtggtcccaggatcagcagtgcagcatcatcggagagctggtcagaaatgcagaatctcagaccctgccacagacctgctgagtcagaatctcgagtggtggagcctaggaatacgcattttaacaaattcacaagtgagcatgattgagaagcactgctgtgtatagtgaaaatagagcaaactttaggggcaaacagcacttttgagtttgagccctggctctttcacttactgtgtgatctttgaaaggttgcttaactcctctgaactcgtgtttcctcatttgtaaattggggatacaaagatttaccttaataatggagtccaaggaaattgtgaatgaaatagaggggggtctttggacttggattggaaaaaaaatcatttttgtttttcacaaatttctaactaaaatttagcattttcttttattatgaatgtcagcaacatttgttagcagcctgtgactttgtcaccagaacaagccacacatatttctttttctatttctttcttttttttttttgagacagagtctcgctctgtcgcccaggctggagtgcagcggcacaatttcggctcactgcaagctctgcctcccgggttcacgccattctcctgcctcagcctcccgagtagctgggactacaggtgcccgccaccacgcctggctaattttttgtatttttagtagagacggggtttcactgtgttagccaggatggtctcgatctcctgaccttgtgattcgcccacctcagcctcccaaagtgctgggattacaggcgtgagccactgcgcccctatattacattacagttgttacagataactccaaatatcatttgtattcatccagttcaaaattacagttgcttttaaacttgccgctagatatttaatgcattagtaatgaggcacatacaccatgatatcacaaatgttttttaattttataaaaactgcattttgaattaattggtttcctttataattttttttatacgcagttgaaaacattatttgacgagaggtccatagactcatggcacaaaacactttcaaaagccctccctgcctggaaagttgttgtgatgatttagtgatggaatcaaatgtgtccagcactttttagtgattcaaataacagtgccctgattgtcctccccaacattgtcacgtcttgctttgtgctaagcctgggccaaagattctctagactttcctgggggtgtgtgagaatacacactgtctggtcaactttccctgcaggcatttctctggctaatcctggttttatggaatgagagctgttgtgtgttgagtgcctgctctttgccagattggtgaagtatgctgccttgaatcacatggccagttaagtgggaaagcaggtgggtggtctccatgctgccatgtatattcctgggtggagctaagtccagatgttggcggacagactaaggactcctgcatcctcctagttcaagaagatgacagaagggctatcagtgaaatcactaagcacctacaatctcttagttcttgtacattcaataagcattaattaagcacttactatgtgcctggccctatgctagtcactgggatacgcagctggataggccgtgagccttggctctaagaagactctatgggccctgggagcagagaagggtatcccctaaaccagtggggcagaggtggggactgaaacaaggttcccctgagcaggtggttaatttgtcaaattggctgggcactgtaatgccccggtgtttggtcaaacattattctggatgtttctgtggggtgtttttggatgagattaacattctaatgggaggactttaagtaaagcagattgcccgccataatgtgggtgggccttatccagtcagtcaaagactttcataggacaaatactgacctcctccaagcaagaaggaattctgccagcagacagccttccgacttcagctgcagcgtgacttcttccctgggtctccagcctggtgacccacctggcagattttcaactttccagcctctataacctcctgagcaaatctcttaaaatggatctccccttctatctgcacctcccattgattctgtttctctggagtgccctaatacaaagtccaactggctatattcatttgtgattatgctcctatgtgctttactttttatttgattatgtctcattacacagttcctgtcctggggttctgggcccctgagggattttcattttattacatagaccccttgtgacaatggtgtatctgggctaatgtaaccagtgctgtttcactgggcacaaactatttggggtgcactgggaagcatacatgtaggagggaaaaggaaagacatttattagtgcccactgagtgccaggccctgtgcattttacactaatttcaacctctaatactcggtatacaacaaggtacacagaattattcccattgcacagacaaagaaactgaggtctggaaagggtaagtgacttgtctgagcacaccctgctaataagaagaatcaaagatggcacccaaatctcaggatctgcctgacacccaagacacccgaggccaggctctttaaaacataaaatgctgtttcacacaaaaggtgccaggccaagggaagaggagccccttctcaggacagttgtggttccatagtccattaaaccttcccaccaccaaggggccctgcagccaccccaccccctcccatgagagatcctctgcaccttgcttgaagctcatcaggaaggtcaccaaattgtaaaacaaaggaatccttcagtctcaggaggatctttgaaacaccgcacctcaatccttggccccagagcctaggatccacccagggctccagggcctcaggcatttggcccatcaagtgctgcttgactcctctgtatctcaccccattgtgaccctggcattttgctcagctgatgaggatatcatgtcgggcagcattgcagctcttgtgcagcccgggagattgcatctattgttgtttccttatctgtgtgctctttcattctatcagacaaggaaattaaattggtctggcaccatttgctctctagaaagctactttggctgctaaatccaccaaagggggtggatttatttgggtgtttctttcctaagtgagtgaacaggccttttcagagccgcccacaattaactgaaaggcccgagctgctgtgccaggcccacctgttgtggggatggaagccaaatggggcagatgggatcgaagcggggccagaaaaatagcctcttaatttagcaccagagtcctctcccactctgctccagcccccctacaactggaaaaatgtggaaggcacaaatatgagtcagagaaaaccatccaggaacctgggtgttaaaaccccacctccagactgcagcagggaacgttaggaaaaaagggctgaaaaccgaacatcaatattggttttgctcctgatgcctggaagggtctcccttgccttgtcctcttcatgaatgagcattcacctcttcatcctccaaagggggccctcgcagttttccgcagcctccgcgtccccatgtccccaggcagagagcccactggcccttttgcatctccggcatgttgaaatgacctgttggcatacttacgggctgatattattatggttttttttttttttttttgatttgccccaaaaaggagttgaggtggattacaaacttataactgaactttaaaataaatcactcacttgaaagttggtggcaactttcaagatcagggcaaaaggaaataagaaaaatttatgtaaaatatttactctggggtcttcttggtgggccatggctttggccctcagctttccagcagccaacccgaagctggtgcgtatcagttccttgattcacgctgttcacagctggtcaggtaaggcacggcttttccagttctgaggcctaagaggaactttgctcatagtttctcataaaaaggaccctgtgaggggtcatgaacagtgtccttaacatgtcatggacattgtccttaggtagacatatgtttcatgggactgtgtatcatataacatcctttctgtccgcctatggcaccacatcaccatgcccttcggggaaggcagttctacagggtggccaatacaatgggacttggctgtagtttcctgttagcctgcctagattcacaataggctttccggaatctagaggattcaggatgtagttctcgcttgcctcagtggagacttgaatgagtttatgcagtagtcatgaatgaatattcattcttaccatcgctgctgagcatctgagcccgctccttggctttgtggaattccctgagctaaggcagatcttgcctcccattttagagactgaaagtggcagctacttgcttttctagcctcctttgcagctaacaggtggccagatggcccagtcaccaccaaacagacacatcgccccaagttataaccatgacaagggtgctggtagtggctgcagaaggataatctttttagggcagcacgtgcagcacactgagtgggggcatccagtgactggagctagcagtatcagcaatggagactgtgacctcctcacttgacccaagctactgtccaggccgtaggagcctgaacttattccttctgccctcctgctgaatgtgtgatcttctcgatgtccttgtaatgagtgtatattctgcttaaatcagcctgagttggcttggttgcaagaaaaaacctgcttgatgcaagcagctgttcttctccgctccccgcccacccacatgcaaggcataggaaagtcaaactgctgtgaaagccaaggatgcgtacacgcataaggacacaagccaggtctgctcgcagagttcctgtgatagatagacggacagaaaacttgagggccctgcctgcagcacaggcctgggggcagaaagactgtcccagagcttgctagcctggaatccacagtctagatttatactgtccaatatggtagtcagtagtcacatgttactgtttacatatgaatttaaattagttaaaatttagtacgaccactatggagaatgctttggaggttcctcaaaaaaataaaaattaggctaccataggatccagcaatcccactgctgggtatatacccacaagaaaggagatcagtatatagaagagatatctgcactcctatgtttgttgcagcagtgtttacaatggctaagatttgggagcaacttaagcatccatcaacagatgaatggaaaaagaaaatatggtacataggccaggcatggtggctcacgcctgtaatcccagcactttgggaggccaaggcaggtggatcacctgaggtaaggagttcaagaccagcctggacaacatggtgaaactccatctctactaaaaatacaaaaattagctgggcatggtggtggttgcctgtaatcccagctactcgggaggctgaggcatgagaatcgcttgagcccaggaagcggagtttgcagtgagctgagatcacgccactgcactccagcctggggaatagagcaagattttgtctccagaaaaaaagaaagaaagaaagaaaatatggtacttatattaatacataatggagtactaatcagccataaaaaagaatgagatcctgtcatttgcaacaacacagatggaactggagaacattacgttaagtgaaataagataggcacagaaagacaaacatctcatgttctcacttatttgtaggatttaaaaatcgaaacaattgaactcatggacatagacatagagactagaaggacagttaccagaggctgggaagggaagtcgggggctggatagggggaggtgggtattaaaaaatagaaagaatgaataataactattattttatagcacaacagggtgactatagtcaataataacttaattgtacattttaagataactccaggagcgtaattggattgtttgtaactcaaaggataaatgcttgaggggatggataccccattctccatgatgtgcttatttcacattgcatgcctgtatccaaacatctcatgtaccccataaatatgtacacctactatgtacccacaaaaattaaaatataatgaaacaataaaaacattaaattaaattagttaaaattaaatagaattaaagatctgtttccacaggcacatcaaccacttacggagtgctcagcagccacatgcacctacagactaccattatgtacaagacacatagagaacatgtccagcatcgcacaaggttccattgcacggtgatggcctagaaccttgacattccaggctgagtggcaggatttctgcctttttgagtcacacctattgcttctggtggctgacgaggctgggagttcccaagcaatgaggcagcagttccgccctcctccatcctggtggtctgaaatccacaccagctaccaggaccacagagcactgggccaaggctctgggaaccctcttttccctgctgcatcttcgtctatgtcccttttgctacttcttgttggctgcttcagggggagacaaaagtaaagacaaccttgggtcaagttctcaccatcattctcattatcctggaacctggaccaggctctgcagcctgggctggtgcagaggccatctcaggtatgcaaatgagtgtgttatgcaaatgagtgcttcctacaaataaatgctttatgcaaatgagtttttgcattctctatctctcacactgggctgagcagggactttgtacttaccccaggacctggcacagggcttgacacatcaaagtactcaggaaacattcactgggtacacgtggatgtaacacagatcccgagggacctgacgcacgacaataatttccatgcagagtgtcttcctttcagtccaaggcaaggggggtgacacagtaataatgatgataatgagagtgatgatatgtatatgaaaaaatgaaagtatagagtatgagtttattataaaagtgtaaagaaattggttacatgtgtaaggaaatgtggagttatgggcatatttttcttttcaaattccttcaacattgttattacccatatcagagtagttaagaatatgctcagacagacatggtccccctttgtgaaatgggagctgttacctcatttggctatgtaaggactaaatgagataatgcatgaaaaaattcagcactgcctttggcatataataagtgctaagtacaagggagcaattattgttatttttgcctagaaattcgtgtgataacaatagagcggagcgggactcttggcgtccctgtcattttgtggctgttgcttccctccccactggagtggatggaaagctctgggcctgggtgtgatttctgtcctgacagcccagccctctgcccacagggcaactgggccaagtccccactgcgtgctcccagcaagagggcactgccaaacttctcatacctttttatgcttctcggtctaagccatgggggtttggagggatttttttttttttttaatttgagatctgtcatccttgcaaatgagtttgccctttgcagcaaatccacacaaaacagggacaatctccagttttctttctgttgccttttctcctcccttctgttcgagtcctgcagctactaatgagggcctctgtcagctccctgggagggcaggaagagctgccttcgccctcctccctctccctctgtctctctctctcgcaaacacacacacacagactcaggagagctgcccttctcatctggtcctccttttcctcctttcccccagcttctgccctttatcttgctgttttcacacttccttcctccatctctcctgtgactctttttctctgaatctcatcttctcttctatttcctctcgcataataagtgtgatataagtatttgctatgattatgatgtctcccccatctctttctctctttccctctctctcttcctgtgtctatctttgtaatctttctgtctctcttggtaactggctatttctgtctctcactggctctgtctatctccctctctgtatgtatttctctgtcgtcatctttctgtgtgcatctatttctgtccctctcctctgcctcgtctgtggctctctggctggctcttcatgtcccttaaatcttctaagcccctctgagggctgtggtctgagcacaggaagtaataaggaggagtatgccccaccctgaccccagccaccccaaatcctcaccacagtgcctgagaagtggatccgctccctcttggcccaagataaaaatgcatctctcttcttacagcctcttcctacagagaaaatactgttcatggggtcctgcctggaaaaacttctggttgaggaagtcattttgcgatgcttgcaaaacaaactttcagaaaccaaatttcttgaaacaaaatctttgtggctgtttaactgatttagtctactggtaggcacacagaataactaagactaacacgtttatagttaaagcattgcactttatcttcaccctttcataatctactttttgctacttcagcccactcttcttgtttctcagcataacctttttgtagtaggagaggtgccattattattatctccatttttaaaagtgggaaccgatactcataaagatgcgatgatttgctccctgtcacggagttattttcagtgccgcagggcgcagaacgcttattccctagggaccatgagcccctctcgcgcccctccatgcccctgtcagctctagggctctgtgatttccaccagaaatcccaaacatctcccaccaaacctgcccaagggagactctttgtggctttttcgcacatcgtgtcctttgtaagtcatcgttcccgctgcacacgcgcccaccatctccaggctgaacggctcagagatttaatcacgttctcggactcaggccatggcagtgaatcttggagccacgcggccggagctgcagcagaaaccctggcaacggaaggagctctctgagggtttggtggaataaattactcaaacacttgcatttctacaaaagtagtgacacttaattcctgctatgatattaggataaacaaaatgtcatctgccgcattgtccttgcccatccaaatcttatcttctttttccgtgtaagtaattgggggaaaaaaattacagaaaccttctggagtattatcgtattaggatccgattttaaccagaatgctgaaaatttcatactgaaggcaagtgcatagttgccgtaaatgcaggcgaacttcaaggtgaaggaactcccctgtacaatcgcgaatgcaaatgtttaaagccactcaacaattttccccttgcagctgcccgttttatctcttgcaaaactagtaatgatacaagcagttgattatggtttacaatagcaataaacctctcagaattggttgtttccaaaataaatagccattctgttaaatgttaaataacaagtcataaactgctgaaaacaaccaatttcttgtggattattgcctgaataaatttcagcaggaacggcagatcattaagctgtgagcgtcacagatcaaaaccgttggattaaaaaaaaatcaatcaattaacttaaatccatccaaaggaattcccattttacaaaccaagtcacaccacacatttttacatcttcttttgagcttttcctttgctggtcatggttagcttgattctggccaaaatcttttcattctttttcagagattaaagcatacctaacctgggtggttaaattggctcattctgagagcatgcagctttcctcagctgcattttctacaagtctccatctacagtgttccaattgataaaacacagacctgtccactaagttaaacatttgagtcaaggctcagtggcaaatatatattcaaactgcagctctaatagaggctgttctggtaagagaagccaacttcatcgggatgattgacagaagattcctcgccatagcaaccagggttatctctctggaataacaacattaacctccttcataaccagtttttcatccctgaatataaaaggcagctgcatgcatcttgtatgatcctttttttttatttttgaatgaacagttagcacttctatataaatgggacaagatgcagcaaaatcaaattaattttgaattcctcttgaaaaaaagcatggcaatggatcttgtaggcagaacagttagagcaggaagggttcctgtctcttctgagcatagggcagtagcagtgagatttctagtcatctactgcctctgaaatagcctcctgcattgatttgctttctgctgctgtggagggtgggaaggggcaaataatttgtttcttgttttgttcctgtcttattctttgtcctcacaactcccaacgcatgcacacacacacacacacacacacacacacacacacatccacacacatcttagaggctctcaggtgcaaggcaatgaatggtctatgggaaaatggtgggaaaatgcatattctttctgaaaaaaaatgtatattccatcgctttttttgaaagaaattgctaaatggaccccaaaccatctcctctgacttatatctaatgttttgtgaaagccgtggacattggtgccttgaaatgtcactgaagcctctcaccagcccctcacagaggtgctgtgccatgctctggacctgacttctcatgccagtctctgcaagtagcaagcatggcactcaagccacagggaataaaaactgtgacaaggaaagacagactgtccacctggttggaccactgccaagtcatgtccttccctgtgtcattccatctaggatatttttcccattggcaccaacttcattgcaattgccaccttgaaaagtggagccctcttggttgaggcttctgtgtcactcaaggtcacaatcttgttgctcaaggccctggttgtaacctcaaagaacgtcagtcctctgctgaggaaagaggctgagcagggaaaaggtgccacctgggcccaagcaaggggaacctgggaacatggcatttacaaagtgcaggacagcgtggggcctcagaggggaaagtggtcattcagcagaaacactcgggtgaatctctggcctgatctctatgtaagcagacaaactagccaaaaggcatgactggtggatttcaaaagatgttctgtgaagaaatgttatttctgagttggaagtaggaggaactctttgagatccccactgtattacacaaatgttgacagcctcctcagattccttcaaagccaccttacttccaaagctgctgcctgcccctcacacccctcaccccaccaacagcatcactgtctttgccaagccctggaactgcctggaatccagttggggccctgagtctgtgtgaccctgttaccagaaaggggtctcaattcagaccccaagagagggttcttggatcttgcacaagaaagaatttggggtgagttcatggagtaaagtgaaagcaagtttattagagaagtaaagaaacaaaagaatggctactccataggcagagcagtggcatgggctgcttgactgagtacacttatgtttatttcttgatgatatgctgaacaaggggtgggttattcacgaattttccaggaaaggggtgggcaattcctggaactgagggttcctccactttttagaccatatagggtaacttcccagtgttgccatggcacttgtaaactgtcatggcgctgatgggagtgtcttttagcacacaaatatcacaattaatatataatgagcagtgaggatgaccagaggtcacttccatcactatcttgggtttggtgggttttggctggcttctttactgcgtcctgttttaccagcaggggctttttgacttgtatcctttcatactagtcctgccaacctcctatctcatcctgtgactaagaatgcctgatctcctgggaatgcagcccagcaggtctcatcctcattttacccaactcctattcaagatggagtcactctggtttgaatacttctgataaccccatccccactgctgagcatcctcattcctggtcacttttccactccaggatttggataaaataccacagccatgggcatgggacctggcctcctgagcagctcctgaggagccagatgatacccagaaatgcaaggtgttacctccatggtgtgtgaacctgaaccaaggtaactggaggtggagagtatgtcctccctccaccctgaggtgtgattcaacctggctaatcttctgcagaagtcccatgagctgagcggacacactcagggcagtttgtgtctctagccactcaccaagaagcagcatctagagcagcaccattgcatcaccttgatcctcatctttcctgcctttcctcctctttctttcctcacctctccaaggttacacctctccaataaagcagccgcactgtaatccttgcctcagcctctgtgtggaggacggggctaggaaaactagctacatgagtcatactcagagctcctccctgtggcaagcattttaggtaaaggagtaggtggtgaaaatcatggcctttctctacgaatcagtccaaagactctccccttcatttgctaaatgacccctgatgttacagccacctctggaagctgcaagtttcccaaaagctgaggttgaggaagggtcggttggttaattgtttttaagaagcagtgtaatggaccttattacttaattgacaaagggcttgactggtggaaaatgaagcctccttgcctccaagatgttgcaattagttttctttaaaacagaaaagaaatgttcctgaataatcaaaagaacaatagcaatagtagcaacaccccaagttacaaattgcctgggctattggcctcctttaaacacacacatagggggcattgctttttcctgtccagaggaaagaaagctgatgctcttcccctctcactcaatgccctcctcacaaagtcttgctgaccctgcctcgtgtaaatatttcattatttacgggtgtgttggtttattcacgcacctgcccagccatcctgtgatctctctgtttgtgtggagcctgtgtgtgactagttggttgcagctggtgctaatgaggccaaagcctgggttcaatccccaagggggccagttaacttcacctgctccgtggctagaggctgcactcaacagctctgaatggagcttgtgttgtgtgtactgggcgacaggcacaggggtagagggaagggaggagatggttcagcatgtggtccccatgtctgctggagaaacagccacagcccttggcaccttccacccctgcaaaggtcagcactgtgtttcttgttttttttccccctaagattacttcttttatcctaaggttagaggacgtgggcatgtatgttttaaaatttcccctttttatttaattggcaagtattatgtcttatgagttaaagagtaaggcacatttttttggcctcaattcctttgggcatccattattcatttactagaacacacagcctactggagaggtgcatctgtggacatcagaaaaaaaaaaactaggaggagttacagattgtggcataaggtttggtgaaaatattcaagaaaaaaattattcactcaacaaatacttattgactgcctattatgtctcaggcactacactaaagatacaatagtgaacaaaatagattttaaaatttctgctctatggagcttaaattccagagggagaaggtggtgcaatagatagtaaataagaaaaaggtagtaaaaaatatgtattttacataaccataattttgaagaagaatagagcaggaaatggacagaagtcactaggaagggtactccaactataataggatggttaaggtagacctcagtgaaaaatgatgttagggcaaggacctgaagtaagggagagtgagctgcgtagctagcagagggaagagcaaaggtgagaagggcaaggagggagcatgcatagtgcctggtatgtttgaggaacagccgggcgggggtgcagtgtggctgaggcagagggagtgagggagaggcgatgttcctgaactgaactggggtgtgctcacctgctgcaataagatcaaacatccacacagaggtttgcagagggagaaaggagggcatttatttgcagggcaccaggcaatgttgattgggcagctcatgcttaagacctgaacccttgcaaaggtttgcaagcgagggtttttaaaggcaagggaaattttcaggaaaacaagttaatacaggcaaatttaaatcaaggcatggaggttatacattggtttggcctaagaaggtgggacaccttgaagcggggcctttacacgtcataggtgggttcacagattttctgatttgcaattggttaaggaaaagaagctttgtttaaaaatgtggggttagcagaaaagaacgttagctctggctcacaggtgtgacttcttccaggcccatcaggaagaaagaacgaagagcagtggtcggagttcagtccccggttcccccttatccaaggtctgtgtgccagcagatacatttggtgggggtccaggttttgaaaacaactcagggacatacgttaagaattaatctttagtttctatagggaaccaaacatcccatgactctaatttccttggctattgttttaggctactattaccttcttgctgatcaaattgctcatttacttctcagggccagctaagtgcctgcaatctgaaggaacttaagatttttcatttccatgcttgtggtagtgaggggggcacaggcccctaagaggggtccctgctccatctcaggatgggagatgcagccaagaaaaaagggaggaaggagaatcaggtggcgtctacaggcccttgcaaaagctttggcttctttctcaaaaagttagaaaaggcttcctcaaagatgttgcttctgagtcgggtcccaggagctgattagtgttaactcattcatctgcactccggctgaagcaggtgttgccagactgaccgtgtaatttggtagttaacatgtgtgtaccaggctgtgttttcagacttgaagacagagtggagttagcatctgctcctacccctccctcacccaccccatccccacgcactcatacacactaccggcctgggagtcatatgaagcttatatggtcccaccatgggggcccacacaaggaccgggattagtttgcccaccagccaggcaggtgggggctcagaacagataaagatttgtattatttcttgagccacagttatagatgtcagctcatgcttgctaaagaaacaaatgaaaattaactggcaaggcaaccccagggcaactgaatgagggagaaagcaaacactccccgggttccaagcaggaaggagccacatgggggctactttgggggcatggaggaaaaggtaattatagaacactttgaggagcagataagatttgagtgggtcttgaagcacaggtgagtgtgaatcttcaaatgggagggagagcatgacaagtcattgttcctttgtgaggggcggtaggaatttttggaaatgttcaggagtcaggaagaggaccatctaggctagaatggagtggctgtgtaggaaaagggctggcagagagtgaggcagattgtggaagtcccggaatgccagctggaaaagtttggacttttgctgagggtgattctctgctttggatggcaggactgtagcagacagaaccatgtctgttcccatatgcatataagtatgtgtgtggtagcctcgccagatataaaatgcaagggaaactctgttaagtttggatttcagatcaacaacaaataagttttcagtataagaatgtcctatggggccaggcacggtggttcacgcctgtaatcccagcactttgggaggccaaggcgggtggatcacctgaggtcaggagtttgagaccagcctggtcaacgtggtgaaaccccgtctctactaaaaagacaaaaattagccaggcgtaatggcgggtgcctgtaatcccagctacttgggaggctgaggcaggagaattgcttgaacctaggaggtggaggttgcagtgagcttagattgcgccactgcactccagcctgggtgacaagagcgaaactccgactcaaaaaaaagaaaaaagaatgtcctatgaagccaggcacagtggctcatgcctgtaatcccagcactttgggaggctgaggcgggtggatcgcttgaggttgggagttcgagaccagcctggccaacatggtaaaaccccaactctactaaaaaatacaaagaattagctgggcatggtagcgggagcctatagtcccagctggtagggaggctgaggcaggagaatcgcttgaacccagaaggtggaggttgcagtgagccaagatcgcgccatcgcactccagcctgggcaacaagagtgaaactcagtctcaaaaaaaaaaaaaaaaaaaaagaatgtcctatgaaatatttggcacataaatacaggatgcccaggtaaatttaaatttcacataaactatgtacagtttattttatttattttattttatttttttgagacaaggtctctctctgtcacccaggctggagtgcagtggcacgatctcggctcactgcaacctccacctcctgggttcaagcgattctcttgcctcagcctcctgagcagctgggactacaggtgcatgccaccacacccagctaatttttgcatttttagtagagatggggtttcaccatgttggccaggctggtcttgaactcttgacttcaagtgatccgcccacctcagcctcccaaagtgctgggattacaggcatgagccaccgcacccagccaaacaatgtgcaatttttaagtataattacatcttgcaatatttgggatgtagttatgctaaaaaaaattcatcactcatttgaaattcaaatttaactggacatgctgtatttttatttgctaagtctggccatcagtatgtgatgctgaataaatgctacttaccagtgctgtgaactccagggcagagctccctcctgttacactaactagcctggagagttccgccaccagagagccaatttctcggccgcctttgggtgctgactcagctctctgatgacccaagtttatgagttacctgtgagaatatctgggcccccagttttctcaagagtcagccccagatccccaattctgcctctcaaaatcgaggaataggagccctggctttttccagcagcagctggaatcaataagcagccctgatgtgtggggtgggctggaacacagcctgctaccttgagccctgcagtattgatcgcacaggcagctgtctgtaaaccaagcaggcatgctgaaatggggtagtgttgtcagccttcactttcatagggatgactcttcagatttctctcaaagcctgtcgggctcaaagggaaaaccagcaagttcttttttttcactaatgtaatgccttggggagctgccgcattacattctttttttcttttttcttttttagtgcaaagttgtgggggtggaaggcagaaaccacaacaatcctctctcttttgggactctctctcttaaatgtggtccatcattcagttttaataactgaagcacaaaatatgaaaactaaaaaaagtcattttttatcgaaagcctcaaatgtactgggcatgagagcgagcagtttgtatgtcttgtggtgttttatgcttctaatgattctctgagattgatatttattactattcccattttacagattcagaaatggaggctcacccaggctaagtaatttgctcagggccgtgcgtcccgcagtgagtctgctatggtcgaaacccaggtctgtttgacatctaacactactgtctgctcaatgagcccaagacattgcaaacactgctggcttgtcatcctagcttgtccttttagattcctgagtgatgaacatcctctgagaaactgtccctggttgctctgaaaaaagccgggtacctccctctgctctcagatgactttcttcccacctgtgtgttgtagaacctccctgtggggctgtaaaaacacatccacctttctgtgtcctcattaatccacaaggtcctccagggcagcggcaaaattgtttttctaccaagtgtgctcctctctagctgcagggactagactatcgtttagcacacaagctctataaatatctgctcgtggttattactgttttgaaatctcttttcccatttgtttagggagcttcaaggatgctgtcctgtcaccatgtttcattgtgatgccggtcttctgcgttcttacctatgttttttacaccgaattttgtattggcctgtcctcattgaggactcatctggctggtccataccaatattaacagaaagttcttccatggttgaatgactgaacaagtatggttgccatgatgactatatttgcacaaatccaagttggtcttctcaatggttcttcctataatttggtagaagggtatagaggtaaatgaacccaatgggtagccaaattcctgcacctgggatctcaaggtcaatgtttttttttatcacagtgatatagggtgtctcttggagactcaagagaaagagggttgtcaatgagagagggtaaaagatgacagagtggctttgatcctaccttctcacaaaagcttcttagaaaagtcaacctacttttgagaggagcacaggttctcacaaaaccccttccaggaagtagagaagcaaactttgccatgattctgctaccaggagtaaacatgtgatcccacatgtactctgccccttcagggatgaaagagctatgaagctgatggttgatcctcagggacagacattggctgagaggacttgatggatttcagatctgcccacctgaagcccaaacgctgaggaagtctctaaatggggattatagcatttaaacattttttatctttatgttcttctgcaggtctgaggcccttcagactaacagtgatccccctgtcacattaattcttctcacatagactgtttttcttataggtcctatctggggcaaagatgactatgacagaaatctcagcttgttcttgctgacagagttaaatttggtctgtgtttgctctgcacaagaagaaagcctgaactgtgctgaacaactgtcttgagggcacgtccagagccacgtttgtctctctcatgttcctccttttattgtttttgttcctgtacatatttcagtgatgtcaggattttttttaagcctccaccttaggggaagctcaagaaatggtctgtgttagcactggtgaggccaagacagttttatgcatataagcctggctgtttgttgatcccttggaatgagaaaccaattggaatatcctggctgtgagaaatataacccttgaccagccaaagtcatttgtctgccttccctgttgaaagaagcacatttaaaatttctcacctgggagaaacttcctggaaagaatatttcatgcaaaataatacacttcttggacctgagttgcaatttggattagaaaaaaatgacctcattatgtctgagcatatatttttgttagaagccattctgagaacaagagcatgtggccgggtgcagtggctcatgcctgtaatcccagcactttgggaggccaaggtgggcggaccacttgaggtcaagagtttgagaccagcctggccaacatggtgaaacccgtctctactaaaaatacaaaaattagccagacgtggtgttgcacacctataatcctagctattcagggggctgaggcaggagaatcgctggaacccgggaggcagaggttgcagtgagccgagattgtggcactgcactaaagactggagacagagcgagactccatctccaaaaaaaaaaaaaaaaaaagggggcatgggttattcaagggattgttgagttgtttatacatgatctataccttggagtaggttttggatgcattttgctccacatcccgaatgaggggtttgaaggttgaactgctatgttgatttaatgctgtggttgctagggaggaggccccagaaaagttcagaatgttaaaatcaagtgttaaaatatgctgggaggaaatgcagaacagttctcaatttccatcatgagagctttatagatagttactggaagaaaaaaaacctccaaaaattaaagtcagagatttatattttgtacacattttgaattttggagaatgttacttcttcctccagagatcttgttttgctttttaaattagccaggttttatgaaatacattccctaaggaacgctgaagaaatttccaatcaagattcttagtttctagtgctttgagggcaacaattgtacccaaaaaatttctctctttcttagaatctgccacttccagaggcctgtgcttggaaggcaggtgaccaagtggcatttgggtaccttgctggagaatggatgttagcacctgctctggggtaactagggttgccagtcctgctgggcaattggttatgcatctgttgcagctgtacactttgcgaaagatggatgatggggcatgactgcagaaaccttagaaattaaaaaagatatattttatatatatcatcagggagatcttgagaatttgccattcagagtatgaccgggagaaacaagactattttgaatccacaggttcaaatacagcatagaagatgcaggaagtggtatttggcctgatgtttctctcaatgtcattgacaacaacaaggatatatgctaaaaccagatggcagtgccttcctgatttctactgaggaaagctgtgcttctcgaatgctaatgtgtatatgaatcaccagaggattgtattaaattgcagattttggttcagtaagtttgggtagagcctgagattcttgcttcttgagctcccaggtgatgttgaagctacaggggcaggatccacctcctccctcactcttgccaggagaatacccaacatctttccagtgtctatcagactaggctgagcacttcctctaagatctgctgaaccctggatactcaagtttgcaacacaaaggaaggaaccaaggggtagaaactcccctgggaagagacagtgttctctgtggtagaattggggagggaacccaaatggaagcagggaccccgaaggagggagctggatggagaaaacagggtattagcaagacaaaggacagggagggatgtctccatgggaagctgaagccctttacaacctccaccttccaaagactcaagtctgcaaggctgtccttctgcaacagaattcaatggttaaatgaaatctacttaggacttctatttctcactcatggaaatgctactttgagctatatctgatctttcaataaataactttctcctggcaccactataatctcgttatcatacctatatcagcaggacacagtggggtaccaacagaaaaccccttcattttctcttactgttgtctttcaaccccaatcctccctgaccttggacagtatctaggcccaagtgcatagcttttctgattacttccaggtaatgatgtacacacttatcatcagatattaaaaacttcaaaaacaacctgatctcaaaactgtaatctctcatcctatttcaagcttctcctctctctctagctcagaccagactcctgcagaaacctgcagggaaagaaggtgtgaacaattccatgtcctcccccgctgctctgctgcttcgggttcaggttggactgggagagggcagaggagcagcaaggggagtcaggagcttttcacctgagctgttggaatctgcagttaggaatctgccctctgtgtgacctgagtcctaactcagctgtctgctagttcccaggataattccaacaggagcacttaccaagtaacgacctatatcagcactcttctagatgtcacgggaaatgaacatcctcaaagtaactctcattgcagagtaattcagagttggcaatttgatttttctctttcttggtctcataaattgttctccctctaggaaagctgtataaattcccactaaaagtggcccttgccttgaagactggtttgcaggcatgagacctttccctgggttactggcagccctttaattcacgtatgaagcctctttgtcctgcagtcacgggtccaagaagatggctcaggataggcagccccacattttttttgctcaacatatatagatgactggaagtggaactattcaaactactaaaactttcagacccctctccagaatttctaggataatgtctacaaagtacattctaggtttagcataagctactatggggaaaagaaagaagagaaaaagagaaggaagaatactccccagaagtccaacctcagaggctccgtgggtttctggtcggactgccctgatgctcagaggacaaacatcaacttggggccagtgtgaggtgctgaccccttggccagatgagctggattatattcacgcctcgggtcctgctcacagagtgagaatgaacccttaatactttgctggattcacaagagggcatctggttttaaagattcttttgctgtgggttgaattgtgtctcccctatgctccccaaaaagataggaagtcctaacctccatactagagatgtgatcttatttggaaatagggtgattgcagatgtaatcggtttaggtcagactggagtagggcaggccccgaatccagtaagactgatgtccttagaagaaggcagccctgggcagacagagacacaccaggagagctccaagtgatgatgaggccagaaccaaagaaagccacaggatgctgaaggcagagatgtaggaagggacaaagaagtatcctcccttagggctttcagagggagcgtggccctgccaacaccttgatttccaacttttggcctccagaactgagacatacatttctgttgttttaagcaacccagtttgtggtactttgttatggcaacccagggaaactaatacacctcatatggcccttacaggaggatggtaactgcatttgcttgcgagcatatctgatctcacgcaatagcgtggaagctcctaaggttccctggagcccattgcctaacacagaacaaatacagtgtgtgccagtaaattttggttgaatgaacaaatgtaggactttcaatcttaatggtagattaaatacaaacaaaatataagaattaacaagggagaaaggcatacctagattggtgtgtatatttcattcacaacaacattatataatcttgtttatgatttgcataaatgagctattatgccataatttgaaactcaaatcggtggcgtctccctgcaacatgaatgagatgaaacaagtcttcctctcctctctgcatgttaaagatgattgctgtgttagtccaatgatagatcccggtcttcactgtctcataacgtctcagcatcttttctggtttctcactggggctggaatagctgctgagggactcttcctgcctgtgagatttacattatttgagatttaaagcaaacgctatttcaaaactagcagtaacttcaataattggtggaagtgattgccccaaggtggaatctccggtcatcaatttaacttacctagttcttaatctccagaaaatagctggcctctgaatcattgctgtatacttaagaggccacgatagaagagtcccagggccttggaaaagatttgtggtgataatctcattgggactttatttcttcatggattcctttctgaatagcaacttagcacatacacaattgagagggataactgcatgtatgtgtgtgcatgtgtgttcatgcatggagtacaaccagcagaagagaaggactagaggacccatattgcaatcacttatgggaggatgcataagaaaatacaagggagataagaaaaagaaaacctaataaattagaattaattattaattgcaaattagtaaccaattcctttaataattttgtctctcttttcacaattctttatcttttgtatttaaagattctggttccatttggtgatattcatttgcttcttattcaaatgagatgaccagggatagtttgggggaattttttttggaccctgacaggggtcatgtctttcaatcctatccctaaattcatacccatatcttcttcagtccaaatttaattcagcccaacacatatgggatgatttcctatcttatgccaggctcagtgcttgacagttgaatacgaagatgagtaacacggctccagattatgaggagtttctaatctggcaaggggatgagatgcattacctaggtgtgacagggacctttcattttctgtccttatgggtgatctttgccaatccctggagggcaatcaagaggttaagacatattgcctcccaaatctggagtcttctctagcttctcccgggttgtgagtctcttctatgcagctgatcctacaggtgatctcaaaagcatcccacccaaagggttgtacaggcccatttctccttgggccaacctacattttagaccttgccaaattcaatacttgagactacaatttagacacatggaattctctaccgaatggctattggtttggagtttccatttgggttctaaccaattgagcaatggtgcaagcgttccccagggggaacaaaaagtgggatctattttattgtagatgcagcgagtgcccagtgacctcgagaacatggggctcctgggcaacgctggactgcagcattgtggggcccccagaaccaaaatctaccttccgattccttccaccagaatggaagttatgtggctcccagtgaatatcaggctgacctcattgagtcataaatgaaggagaaagatgagatagaagagaggggtgagcctgtttgggcttcccaataacaggcctgtctggtatgtgacccagcatggagcctgaatacaaaggacccatcctgcctgagcatagatgggccaagagagcaagacaggggctgaccctgttttctacttttaaagccaagcaccccactcactggcatgtgggatgtgatcccaagagtttctgcctctcttggatcacgaatcaagccagtttttttaagaaggggaaaacagtaaaatggggatccccccttttttttaagaaggggaaaacagtaaaaatggggatcaaaatgtacattcccacacttcctatcttggagtggaaatctcctttcctctatgaaaacctggatgtgctgttgggtaggggaggcagctgagaatgttcctggcaatgaggcaagcaaactactactagacaaaaacttgcaagactatttccaagtatgtagcagggattcgagttgaaattctaggtagacatttccttctcttgtaccttcccattttggccctgcatgaggaggctgtctcctcagatgttccgtgagcacttgtcctgaatttcttccctctgatcatccactctgcagctatctcctcaggtctgtgagtgcaggaacaccacatctgtgtagggaaaatgtcgtgcctctctacgggttgatttaagactcttgtgacctagagcttcagctacatgtgtaatgatgttttctgctgagtcaccgcagctgctgggtgcaggtgggctgagaactcctaaatgggacccagggaaaagctacaggtgggcttgtcaccttacaagtcatctatgaagttgcaccttgccttagagatcacacagcctgaccctataatcctacatggagaaaggggcatgtttccaatttgcctttcttttagctttgcctcttagggacagtggacacctcactgcagggcaaggaagcattggatcctcttctgcccctcccaggcctggctgccttatgaggccatcaggagaaactcgttgtcacagagtgagtgacgatgtcaagtgcggggcagtgccgtggattaaattgtttgtaggtcttctgataaaagcaggcaggaaagagggtctgcaggttgctccaacatagacacataggtaatagagcttattcaggggagggaagagtgagaccccacaggaagtatcaataagattttgaaggttttcaaagagtaaaaagctcaaacctaacaggcagtaagggatgcaagctggaggcagtgctgcgggaggttgggggaagcagatggaagagcaaggacctggggtgaaaaagcaaattcagcctcggtttgtgttcaggcaaagggagggtcagcttttggctgtggtatagaaaatcagtaaggaagtgagaagactggaaaaggcaaaggggctgaaagccaggctgcagagttgatatttcatacgggagtatcctgcagttattggaagagtctgaggagaatgatctgatcaaagcagcactttaggaaggctaatctgtcacagtgtgtaggagggactggaggagaaacaggcaggaaggcagaggtgggagaactgtcagctaggatgaggatgacgatggtgatgaaaagatgatgtaaatcgtgaaaaagatgaagatgaggatagcagctaagattcattgtttattaatgacattcattattctaagtactttgtatctgttatcttatgtaatcctcacaccctcctatgaggtgagactgttttacaaataataaaactgaaaaacagagaagtaacttgtccagggtaactagctaataagtggtggacctagggtacaatccaggtgctctaatttatttatccaggcaaaatgcaatgagctgagcaaaagcagagtggtggtcatgggaaggtggagatggattgggatgtcacagggttggaggccacctgatcagatgtgatggcaggagagaggtaggtggattgggagaaggaaaagtggaaagggccatccagcttattgccataggtcactggggacatagtgggaatatcaattaaaataggggtgcccagaagagggactggtttccaggtgaagatggcacaccagtcagccaccaccatctctgatctgcagtgctgcaattatgtctctttgtcccttacaatcattctttacatggcaactcctacatgatgtaaagcggatcatgttattccccattaacatccttcaacgtctccacagctctcgaatctaaaatccagtctccttactctggcagacagattccacaggagctgccccagcctctttctggcaccgtgtcatagcttgtggctgcatcactctaacccccaaggctagtaccttcaaatctctctatgctccatcatcagattgctttctcctccatgtgtcaatgtcagaatctttctctgggccaaatgcagtggctcacacctgtaattccagcattttgggaggccaaggagggaggacggcttaaacccaggagttcaagaccagcctaggcaacatagtgagattccatctctacaaaaaattttgaaaaaattagctgggagtggtggtgcacacctgtagtcctggctacttgggaggctgaagcaggagcatcacttgagaccagaaggtggaggctgcagtgagccatgttcacaccactgcactccagactgggctagacagtgagacctcatctcttaggagaaaaaaatctctctctgcttctcaatcagaaagatacttatgtttgtacttagggtccactctgagaatccaggataatcttcccatgtcaagacccttatttagtcaaatctgcaaagaccctctttccatgtaaggtgacatgtataggttccggggattaggacctgatattttatgggaaccattacctagcctcctataatttctgctgccctccacttactctgtgcgggaaatcagctgtaccctaggtgcctagaagggtaccaggcacattgtagatgctctactgtgatttattaaactagcaaataaatgaatatagccaagtgtattttattctaaaaagtattttccctatatgttcataatttaataacaatacatcatattgttttaattctaaaacagtcaaacagctttgatacgacagtcatcttatataaatgaaaacgtgatctaatgaaatggcattttatgagctttaggcgaagcaaccatttgaatgatcttgtttaaattaaatggcccttttgtgttcagtagtcagcatcactaagtgtgtctatcttgctaatacagtggcatcattataatctaaattatacaatttaattacatgtaacttgaagctgaaatattggtgaggtacaagtatgacctttacatcacttattaatgttttttcaaatgacatgacactcagaaaaatttaacaaaatcttatgtttttgaatcggcttatgaatcggctaaataaaaccttaagacactgacaaacccagttccaacctttgctttgccatttaatggctgcatgatcctgggaaagatatttgagtactccaagattcacagtccccactctatagagttcttgagaagagtgaaatgagttaagcatctaaaatgtgcctcccaattactagccaatattagctccctcttcctccttcctttgccacaaacataccaggaaaaataaaattctgttttagatctgataaataattcctgaaacccagcatagcaaacataaacacactgtcctaaaatacatgggcagcatagtgtgtagccatcatgagccccgcctgcttgctttcccactgcattatgccctgagaaattgccccatgtgttttctggtgtttgattctgtgccagagccattagggtagaagaatgagaaggagttgagttcagtcctttcagagaggacactctcctttgggcatctgctggttatgagggagcttcttgccacaattcaggctgcatgctgctggcagagggaacgaagggaatgcactgtcagaaggacagagagacagagaagcagacagaagcatggcgatggccaagtgttctttagggagaaacaggctacatacgggataagatttttggaacatgaaagaagggttactttaccaatctgaggctgctcaggcagtggtgccagaagtcacagaacatataaagcagagtttttcctcatgcagtcatccctcaagatccatggggtgttgcttccaggacccccttagataccaaaatccatggatgctcaagtccctgatataaaatggcacagtatttgcatataacctacacacatgctcctgcttaatttaagtcacctatagatcactaacacctaacacagtgtaagtgcgatgcaaattgttgttgcattgtttaaaagttttatgattttttcttattgatatttttaattgttttttcaaatatttttgatccgtgcttgattgaatccagattgcggaacctatagatagagagggatgacttgtttttttccttctgttctccctttattccagctcattatttatttcatagaatctcaggtttggagaagtccttagagatattttggctcaacctccttctccatgcagaaatctcctttacaacattcacgacagatggccattgtggtgttgctttgttataatttgttttatttagtaattggtttttatagaacaccattaagttaaacagtttatttttcaaggctccatggaaatggctctctttaccatctgtgtgtgcctctcatatgagattagaccctgggactttctgccccttgatggcctgaactattagtaagggcagaaaagggaaaaggacttgcctcacttctcaatcaagactcctgggtaagattcagtgccagggaacggggagggaagggtagcaatgatttaaaagatatttactagcttgagaaaggtcattctgaccttcggtgttgtttctttaaaaataatactatttgagattttctgattatgcaagtaacccaggtgcacaaacttttaaaaattattctaaaagcacacaaaattactaaatatttgggagttctgcgatgatactgcttcttcagttttatattctgccctttttacattatagtgtgtcattacatgttcttccataatataagtcctagttatgtatcatattctgtttcatagctgtggcattatttacttaaccagccccttctggtttcctctcacctcttgcttcctcatgctggtcagaaaagctgcctctggcataagcacttcttaatctgccttgactttcatccagacacataaacgcttgtcccaatgcatttggatggaatgatacgattccagagtgtttcctgggagtaatcatggtgttgctgcggagtccatctttgggctttgtgtagttgatgtgttaattacactctgtcaagccacaaacttctattccccaagcctctccaggcatgcacaatcatctgtgtgtcacactgcaagtgaggataagtctaaatggaccctttaaatcagcttggctgccaactttggctctattgacttgtcagggcccaggcaatggcacagccagcagtcttggcccatattgaccagaatgggctgcagcagaactaccagcctcgcatcctgtgacaaacgacccaggacaatgggtggtacctgggctcccgctctaggagcaggcagtcctgctaacataccaccgcttccacccctgtctggctctctgctggccctgatccaaatggggcattgtgctttgttattgttgccataagaagtggcagcagggcctggaaatgcaaggtaaacatttgcaatgggattccaggggcatctccatggcctgatgctttgaggaggacagaaataggaatactaatgtcccagaatctgaatctgtctagaactgactgcttattgatgtgggttattttgctctgtaaagggacacacacacatacacacctcaaccttttagaagaaatcctgggttaataatactccacctgctggttccatctctgagttccccattcttggtcccatttggtcctgactgaactgctgaccatgaggctgacctcggcccttggtccttggtccttgacagtcttgagtctgatgacctccacctcctcttcacatggctccacattgctggatattgtcatcttgcttcctctcacatcctttgctagatatgactgctggtttcaagaggggcccttgggtgtcaggctaggagttgttgcataaaagaatcccctttgggtcttctttgtgatgtgctttgtcactgggacttaagcagtgctgcttgtgctctgagtctcatgacagcaatgcccaggctttagcatgtggctctggagggagcaggcatgggccttcaggaaccagagcaggaaaggaagacaaatgatgatgctgtggtggcctgtggtagcaattgattctggctttccgctctctcctccctagttacagaccttgtcttctagctgaaaagacaggctcctgatccaggcctagccaatcacagtgcccctttccctggacacagcaacagcccaggcgtgggtgtgagtcccacacagagttcatcagagtctgtccctgggattgattcatagatgttgggagagaaaggtgcttcctttccactgggtttgctaagcaagggctgccatgtggtgtgccatgggttacagagaaaacaaagctggtacataaaagagagcagagacagacaaaaatgagagacgggaaaagagaagcagcacagcagaggtgctgagcactagcatggccctcgaggctgctgtgccctccactgctacttcaattacatgaaaagctgcagcatctttctcaacaatgggagcccattattctctcgtctttcataagcgagtttgtgatgggctctgacacacatggccgaaagggccctgcctaatgcactttctgatgccagcaggtgccagtttgatttgtgaatacagatgagacatccctccaggaactttaggaaatagcataaggacactttgaggaagacccatttcctgcaggcaagcaggatgaagtcttctgccataataatttggattataaaagggaagtatgaccttgtttggatatcataagctggtgagccagaaatatgtaggctattctctcaaaaattcatacacatctcttaccagattggcttctggctggacctcctgcccccggcccaggccccaggccatcagacctgcttagaaacttgtctgaaactgagccatggaggtcgcctgagctggatgcaccatctacctcacccaactcaacagagagaagttcctgcaagagaattgtgaggttttagtggacaggtgaatgtagagcaggagaaataatcaggagtagcatcaagattggagactggggaggcaggtgtttggtgaatccattaacctagagaaaagattattaagggaagaggaggtatgtgggagagactaacttagagttagatgtattacacacacagtaggtgcagaacgcctggctctactgtgtctgctgtttcaggaggtgcttggaaacataggtctccctctcagaaaagagctccaggccagcacatacacatgtgtatgtgtgtgtgtccccttacagagcagaataacccacatcaataagcagtcagttctagacagattcagattctgggacattagtattcctgactatttctatcctcctcaaagcatcaggccatggagatgcccctggaatcccatcacaagtgtatgtgaagtagaagtagacgtcactggagtgtaggtgaaatagaagccatgagggttgaataaaattgcttaagaagagcattatattggtttcccagggctactataacacattaccataaagcagggtagcatgaaacaacagaaatttattctcacacagtttcggaggccagaaatttgaaatcaaggtgtcagcagggctgtgctccccctgaagtccctaaagaaggacccttccttgactcttcctagcttctggtagttgctgtccatccttgccattccttggcttccatctgcaccactcctatcgctacctccatagccacatggccttcttccctctgtgccttcctatctctgtgtgccctctcctcttcttacaagcacattggtcacattagatctagggcccactctaatcccataggacctcatcttaactatttatatctgcaagatcctaggtccaactgaggtcacattctgaggttctcagttggatctgaatttggggttggggagtgctatttaacccactataatggtgaagagagaaaaagagaaagctaaaggcagaatcatgagacgcacgaacattctggtcgttagtagggaagtgttagcaaaggaaagagaaagagagagagagagaccacattcctagctgctgagaggccgggtggggatgcaagcaggtaactgtgtgtgaccatcagaaaacactggtaacggcagttgggtgactaactaatatatttcacccaggactagagtggcagtccaggatgcagaactttcggtgctaaaacccaacagtaccaagcacactggaatggttggacactctacctgggaaccagcagttctattagaactgaatgtggggagaacgcacggctgaagcttaatggcttggggaatgagtaagccttaagaaatgtacttgcctggggcgtgattctggttgcgttgtttttctgacaattcaaccacatttggaattttcttacgtaggatatgggcttgagtttttaatttaaagtcttcgggtaaggtcagctcagtccctaaccaccggacatcgtggaacaaccaagttattggagattaaagtgtccttcaactgtcatgaatgccactctgaccctccttgtctggaggggacctccagggcatgctatttaaatgaacccaattttgaaagttcacctatctctactgaatgtgatagctatcttgctctgccttcagagcacttatcttcaaagtattcagcgccaggcaaaagccttgatttttccttgaaaaagaaattgtcaggatgtctgaatccatccagacctttgcatgtgtgatttcattattcatagtcagcattcctcttctggcttttgatctgtagtttacagaatgtgtgcataaggaggctctctttcccataaactgatctctttaccctctcagcccggaataactttccatttattcttttgataaagcgttgatgccgtgagccagcatacattaaatttatcatgatacaaacacagcactacactcttatccagcccagatcagcaaccagatcactgccagtgcccctcaagtgtctctgatgatgaacagcaaaggggacctgtggaatttctcacgaccatcaaatctgaagaaggaattcttctgagagcagtttgcaaagtctatcaccagtatcctgactctattattagcttgcaaggtagttaaagatatcttctcagccttgactcactaataagcacttttaaatatatatcaaaaagccctcttaattaaaatgcttcaactgctttctacctctcttctgataaatgccaatatcattaacatggctgctcagaaccctgcctgcctctccagtcttgcctggccccagactcctctttcccttctgctacttcccctaagttgaatatttttcattcttctttcacctgcttatctcctactcatccttctcttgtcatgtcaattatcactttcttgaggaagcttttcctaacccaccccatgtcccatccacctacttgcccctgatccccaggatacgttagagacctttgctttcacagaactgctaccaagtcaagataggctgacatgtgaccatagcaagcaccaccaaaacctcagggtggatgaatgaggatccacactgcttgagacactcagcttccaaggccaagtccatgaacctgccctctcctgggagcgcacggtgtatacatgtatatagatgtgtatttataacccaattattgtaacaaattatttattagatatagacatccatatcttatctacatttcaagatagaagtactttggaaataggaagatactgtgtctgtttcacctttgagtctcccactgtgcctataatctgcactgacagacatgagatgttccataaaggtcaattaattaatgaatgaaatcatgagcaaatgatttttgaaatcattttttcttacatatttttgagaaatgtaagcatctttgtgttttcccatcaatatttttagaaagcttcatttttcaacagctctgattaataatataattgaaaagcaaagaagtctttttaaatatgtactgtataagtctgtgatacttttgatcccacagagagtcaattccatttagttcaattcagcaagtgttaagtgcctatgatgtcaaatgcctgtagtgtggcaacagaatgcttcatttcagtgggataatttgggatgaaaaacttctaaacacgtttcagctcctaagtctgacttcagcagtcacaaagcaattctcccatgtttagactatagccattcattcatttgttcaataaaactttattggacatctattagatatgatcatgactgctctggattagatctcttgaaaactgtgatacaaaagaagagattgtgcaaggtctttcccacttggaaagaaaagttaaatagataaagcacctgagtaagagtaagcactgagtaaaagacctgggtttaatttcccacctcattctgttgttaagtagtgaagtgagcttagcaagtcactccatagctctgggcctcaatttgttatctgtgtagtaagggcagtagactggatgatgtctaaagaatattagagattagaaagtcattgtcctggatggctcacaccagtcactggagttgcttggcaggaaggcataacagcattttgtacatctagagctctgtccctctcatggggcaagtgatggaagaatccagtggcaaagttaggtttagcaggaagtcctctcccaataccaggggtctgagtcccggtgccatgctttgtttacctctatcacttgcaaggatgaaaaagcatctctaggcctggcccaatgtatggaatctaattcatgggactagatattttattagcatttccagctgaatgagtgatttggggttggacaatgtgacagtgaatagatgacatattccttaactagtgagtatgaaactgcatagaaataagatttcacaatgttatgatattaatgtactttctaatattttacatgatccatatgaagacatataatttacagtttagggtagatgtacataggtaacaaaaataactggagactccttttggagaagtctgcaattggatcaattagcatacattcccttacaagtgactcaaaacccaactagcaaagacggaaattttaggaacatttattgtttacccagcaagatgtctgaagagggtggttccaggtgtcagggcctggatttgtgtctctgccattttcttgctttttcccagtcacaagataactaacacagctgcagatatcaaatcctcacatgactgatgactgtaactacagaaaggaagcaggggagatgaacagacctctccctttgtacctctctcctagtattagagagaaaaacacctttccagaagcttccccagctgacctctcctctgtctcagcagcaaagaaagtttgagaaagcagaaatctgtggttttcagcctctactttggaaggaagacaaattaaaagcaagttggggatgtctgtggataggctgccaaagtgcttaccagaatccatcccacaggccacccaccatctgtagatatctttcctctcccacagccactgtgggtggaatgctgtggcccattgtctgagagagaactccacaggatcatccagttactgtagctagcaccaaatcttgcacatctgggtgatttgtagtctccatgccatcacatctcggtgtagattcctacggtgtagcagttgataactaaaagaaaatgtgtctgcttcaaatgcaatgatgctgaagtttaatttacctttcattaaaacttgcaattggaaaaaagaatgataggaaacacaatcgtcactgtgggtttttttccccccacatatctagttttgttgatctagaataatgaggttgagagaggattaaactccttggttagcccatctggcagcctataatactgatctttgggaaaatgttcctcattcatgtcctctgtgacccacctgagacattagagaagacgctccccttagaaattgcacagcctttccagctcacttcgttttagatcaaggttttgggatcttgatattgtcttaggagttaaacagagctcaatggtcatagcctgttgttgaccagccttagagtctatctggtcatgcaattgcttcaaaatcttagtgggctttctgatatctttgcttcaagtcaatttctgcaactaatgtgtctgtttgggttctttaggaagcagaacactgagatggagttaggagtgtaagcaatttatttttaggtggtgacacttatgaaagctaaaagttaaggaggctggattggaaagggagaaccttcagactatgatgtaaatctcacacctgtcacaagagatggggtagaagtaggattgggcaggagaatcctcagactatgacacagatctggcagaagtctttgccaactcaacagggaactgcagagcaaagacagctcattaagagagctacacattgggcagaaatagcccggaccttggatgcctactgtacttgtcattatctagaagctgctcagaaacagtatgatttccactccaaagtggagcaggatcccaaaggaactggcggctgtcagctaaccactctcactgcaagttctttctcgaagggagatctgattagggcacctccatggtggccatggcccaggatctggtctggctgcttcatctgtctcccctctttataggcttaatggtggttgttctgaagcaattcagaataagaggttgggtgcagaggctctattttgatcagacctttgccagcagacttgccttctttgcctgtcgaagaatgatggatgaggggagtttgggaacttgggaatgttgtcagtcttatttcttgttatgtctatactcccctgcttctgactccagcatgtctccaaattatgaaactctcagttaattcagacctcacactactaacagagaacatctcagaagagttccttctctttcctccctcctgacagattttctctaatctgtgttcatcttcttcttgcaggactttgccaaaagcttcaagaagtagccaacataactcaacatccaaaatgtctcctgccatttcccttaacactacagcctcagctggcacgtgattggaatctcaaggcatgacaagcaagagtccaacgcaaatgtcttgccgccacccagcaagtgttacagacatccagcctattctagctggaccctcactgctctctgccctgccacctcaactcagccattctgtattttcagatattatctgtgctgctctatttactgcaactaaattcaaaggaatgtgtttggctacaagtaacagaggataggtcaataaaaaggattttatttagtctacaagaaatctggacaaaggtggttccagggtaagtttagcacttccatgacatcaaggcaccaggttgttatcttagccagtctctggccttcccctcatggccacaagatggctgccacagcttccagggttatcctcacctaacaacatccaaaggcagaaaggagggtcacagaagagtgttatctttgcatgcctccctcctgtgatcagagaagagaaatccttcccagaggcctactggcatagttctgttatactgccttcagttgcaaaggaagcttgtaacatgaatctctggcattttcattctttagagtgggaggaggacaaaggcggagagcgatttggagcacagccagacagcagcgtttgccatgggatcatgcctattgatcttagttttccaacctccaacttggaaatagataaaccatctgtcttcccttcctggggagtagcaggttatgaataaattatgctgccagagcccagagagtccttaaaacaaaatactgtcaatccaaggccctcatttcattaaatccatattagtttctattgctcatttgatggcatctgattgttctctgggatgggaggtattggcagaacaggaaaaagggagaaaattagcccaaatccaccttccccaccaccctcttcccccagtgctgaatagtcatgaggtccccaggtacttgttatttctggcgagctagtgagctgagtacacaagtccatggctgggggatagatatattccagaaaactctgtgctggagtgctggagagggctgttggagagaagacacattactgatggagcaaattcagccaccatgaggaagttgggacagtattggggggcactatgccttcattagcccctgaacctacatcttataaagctgctgatccacctttctgcacacattattctttttttaaaaatttattttaacaccaacgccacttgccaaataacagtattcttatctcacaataattttatcttcccaatttctgtaatctcaggattcttaaaagggttatgagaaaattcccttttgtttccagaagatgctgcctctggaagcaggcctggttgatggctgattgtagactcagaggtctaaaccagtcagagtgccttgaagaatcaaatgcagccacgtaatcattattgccatttctggcagaagccctttaaattggcccagccttactatgccaaagggctggggaagcaaatgcaaacaactacttgttcctctgtcctcatggactttcctctcaccatccctctcacagttcttgttttggtcttccctccttgggtcctcactgctttgccaacatgtctccactacatctctctgacaccagtttctgcttgctccctggtggctgggggcacacacacaggcctccactgaccacccaggcttctagagacctgactccttgggcctgctcaggttactcaagttcatcattacaagccaagaaaagaggttgtaattgtggatactgcctggaccttagaggtccagcttaacttgaactggcttcttcgggactttcctggatctggcttgcaacttttctagatcagggtcagttcctctgctaccctctcacattcctaacatctggctagtgctggtctggttcccagagatgggaacgatgcatgccctccatgccagggctgtcccaatgggctctctcctccacgggctgatggggcttctgtttgtgagcactgatctgactctggtttccaagaacacggaaagactctgcaatcaaaactcagctcagccccaatttcactcatttgaaaactgttaatcacaagatatttgtaccccagatgtcagctggggtccttttgacttttgagattcaaatgacattggcttcagagtatagtgaacaaaaatgtgagtcctacatatggctagccagttttcccagcaccatttattaaatagggaatcctttccccattgcttatttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgtctccagctttgttcttttggcttaggattgccttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttataagttggattcctaggtattttattctctttgaagcaattgtgaatgggagttcactcatgatttggctctctgtttgtctgttattggtgtataagaatgcttgtaatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccgtgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggccaactggatcccttccttacaccttatacaaaaatcaattcaagatggattaaagacttaaacgttagacctaaaaccataaaaaccctagaagaaaacctaggcattaccattcaggacatgggcatgggcaaggacttcatgtccaaaacaccaaaagcaatggcaacaaaagacaaaattgacaaatgggatctaattaaactaaagagcttctgcacagcaaaagaaactaccatcagagggaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaagaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacattcacacgtatgtttattgcagcattattcacaatagcaaagacttggaaccaacccaaatgtccaacaatgatagactggattaagaaaatgtggcacatatacactatggaatactatgcagccataaaaaatgatgatttcatgtcctttgtagggacatggatgaagttggaaatcataattctcagtaaactatcacaagaacaaaaaaacaaacaccgcatattctcactcataggtgggaattgaacaatgagatcacatggacacaggaaggggaatatcacactctggggactgttgtggggttgggggaggggggagggatagcattgggagatatacctaatgctagatgacgagttagtgggtgcagcacaccagcatggcacatgtatacatatgtaactaacctgcacattgtgcacatgtaccctaaaacttaaagtataataaaaaaaaatgtgagtcctagagtccatcagcccagatcctacattcgggtactcttcttaccgtgctctggtgcacgtgatttaatttctctgctttttgtctataaaatgggcataataatacctgtataagtttggggtgctgattcaataaactattgcaagtggagcattaagaacaatggcgagcatacaatgttaccattcgctctgccccatgaggaagaaagaccctgttggatgaacttacatttcttctagtaatctttggctctgagtttctgctgcagccaaaacagaccagtttcaggaactgtattgacatatcatgctctctgattcttttctgtattgtcaccccttgctcagtgccaccttgattccttcactcttccagatactttctgaccgataaagtcgggtatgcagaggcttcctgaagtattagggcaatgagaaaggatttatattgcggcattacacaacttagatttgaattgaagatatttagttcttttttcttttttgagatggagtctaacactgtcgcccaggctggagtgcaatggcactatctcagctcactgcaacctctgtctgctgggttcaagtaattctcctgcctcagcctcctgagtagctgggattacaggcgcttgccaccatgcccagctgattttttttttgtatttttagtagagacggggtttcattatgtcggccaggctggtctcaaaatcctgacgtcatgatccacccatctcagcctcccaaagtgctgggattacaggcgtgagccaccgcgcctggccagacgtttaggtcttaaaagtcctttgactccacagtccccagcctctagccctctcctcctctcttttctggttgtctttttccttaactttgcttatttctctgtctacttagaataaaattattaggggtttagcttctacaccaaaaattcctagtacagcactttcttgctcttttaaaaaaatttttttttgtttttatttattttgattttaattttttttaatatacttcaagttctgggatacatgtgcacaacgtgcaggtttgttacataggtatacatgtgccatggtggtttgctgcacccatcaaccggtcatctacattaaatatttctcctaatgctatccctgccctagcccccgaccccctgacaggccccagtgtgtgatgttcccctccctgtgtccatgtgttctcattgatcaattcccacttatgagtgagaacatgtggtgtttggttttctgttcctgtgtttgttgagaatgatggtttccagcttcatcgatgtccctgcaaaggacatgaattcatccttttttaaggctgtatagtattccatggtgtatatatgctacattttctttatccagtctatcattggtgggcatttgggttggttctaagtctttgctattgtgaatagtgctgcagtaaacatacgtgtgcatgtgtgtttatagtagaataatttataatcctttgggtatatacccagtaatgggattgctgggtcaaatggtagttctggttctagatccttgaggaattgccacactgtcttccacaatggttgaactaatttacattcccaccaacagtgtaaaagcattgctatttctccacatcctctccagaatctgttgttccttgactttttaatgattgccattctaactggtgtgagatggtatctcattgcagttttcatatgcatttctctaatgaccagtgatgatgagcttttgttcatatgtttgttggccgcataagtgtcttctttggagaagtgtctgttcatatccttttcccactttttgatggggttgtttatttttttcttgtaaatttgtttaagttccttgtagattctggatattagcccattgtcagatggatagattgcaaaaattttctcccattctgtaggttgcctgttcactctaatgatagtttcttttgctgtgcagaagctctttagtttaattagatcccatttgtcaatttttgcttttgttgccactgcttttggtgttttagtcctgaagtctttgcccatgcctgtgtcctgaacggaattatctaggttttcttctagggtttttatggttttaggtcttatgtttgtcttaattcatcttgagttgatttttgtatatggtgtaaggaaggggtctagtttctgttttctgcatatggctagccagttttcctaacactgtttattaaatagagaatcctttccccattgcttgtttttgtcaggtttgtcaaagatcacatgtttgtggacgtgcggcattatttatgaggcctctgttccgtttcattggtctatatatctgttttggtaccagtgccatgctgttttggttaccgtagcctggtagtatagtttgaagtcaggtagcatgattcctctagctttgttctttttgcttagaattgtcttggctatatggtctctttttggttctatatgaaatttaaagtagttttttctaattctgtgaagaaagccagtggtagcttgatggggatagcattgaatctataaattactttgggcagtgtggccattttcatgatattgcttcttcctatccatgaggatggaatgtttttccatttgtttgtgtcctctcttatttccttgagcagtggtttgtagttctccttgaagtggtccttcacatcccttgtaagttgcattcctaggtattttattctctttgtagcaattgtgaatggcagttcactcatgatttggctcttgtcttaaagatagttctagtcctgaaaggaactcaagttgcagctttttaaataacaaaaattctcctctatatatgttgatgatgataactaattatgacaatcaaatatttaaatggcactaataataaaatggcaactaccaactatcattagcatgtgttttacagcttagaaagtactttcaaattctttattgtctcatttgaatgaatttccttttcagtttatgcctggagtatttgcaaataagggctttgtaacagaggatggccacacatacacatgcacatgcacacacatgcagactcgtgtgtagcgctctgtttcatgtgatgctcatgtaaagctccctgagatagaaggcctctgtcaatccatagacaaagtcattggttcagtgtctattgatcctgggtcctgggctggtaaccctgacacaacaggccaccatgacgagacattacggccttactttcttagtagatatgtctatcgagtttctgaaaatacagaggatggatgggctcatcttcctctgggattattgggtcatttctcagcatgtctgaagccgaacaggagtgaggccctgatgaatcacagtcagcatgcacagttcaagcaggagaaagctgaaatttcaacaaagatttaagtacttccaagcacacagcctttcatctttaaggactaattcacagtgtgcattttatacatctttatagggtcatgttaccattcctggacccttatttcttggcaaattgggggtggagtgacatttataagtgaatgcattcagtggagagcttgccatgacatgtatttcattgggagaggccataaatattttttgcacacatctgtatatccatgtgatgcttcattttggaaagcaacaataacaactgcgtcattaagcaacagagaggctaatgcatcagctggcctagtaggaaagacaaacaaggatcatcttgtcaaatcaaaatggattgtgctttgccaccagctgcctgcttttttgtaggtcccacagttcaagggtttgaattgaacctgcagttgtaacttaggatattaccacatcaggcaactcaccagcatcctttctgccctccaaggtcccggccctgactgtgatgggaagttcctagatgtccacagtgtggaccaattattgcccaggccttttcaaagtgtccctaaatagctgctgaaatggaacacactcagacatgtccctaaggctcttggctactgtcatagcttttaacacactgcattgtaattgtcttgttgaggagaaaaatattttttcctctccatcttctgtttatggcagagttctctgttacaaacgacagattaacaagagaaaagcaaacatatttatttaatataagttttatgtgacacgggagccttcatagggaaatgaagacccaaataaacagttaaatttgaatgtttttgcagtcattttgatgaagagtggagcatcatggagaaatatgatagggcaacgagtgtgatctaatggtaacaaattggcagaacttagcaagcgctgtttattcagattcttctctgtgtccctttgccttcagagataaggatattcttttcctcctggtatagggagggtacctcccacatgaaagtcttatgacctgcttcagaggaatatcaagaaatccttcctaggttttatgacctgcttcaggaaagaagggcagaggaaggtgacagtgatcttcctgcttctgcagttttctcaaatttcttcagcttaaaatactgttaagtagtgtgtcctgaacaccactgtcaactggagaatcatggagtttgtaaattttgaaagaagagcttttattcttataaagagttgcagcctgcaggctggctgttccacaggttgagaagtgtagcctcccacagaaactgaaagcaggcacttcaagggagggaagaatgagacagaaatgtatgctgaatgggttagctaagtatatatattcaacaggttaaaagaggagctatgggccaggcacattggctcgcacctgtaatcccagcactttggtaggctgaggcgggtgggtcacctgaggtcaggagttcgagacaagcctggccaatgtggcaaaaccccatctctagtaaaaaaaaaatagaaaaattagccaggcttggtggcgggcacctgtaattccagctactcaggaggctgaggcaggagaactgcttgaacccaggaggcagaggttacagtgagctgagattgtgccattgcactccagcctgggtgacaagagcaaaactctgtctcaaaaaaaaaaaggtatgaatattcatgtaggggcatacatatgcatagtaagcaaacatccatccatcccatgtttgctttggggtggagccttaacatttaaatatattaaaattaggctttttacatcaaaaggtgaaatagaagacacagaagcacacagtgtgcagcctctgtaaaccagcctgaacaagtccacggtcagcagcctcttatcaggaaggaacgctggttgtttgttgtgttgaaaccacaaacaaggaggggagtctggcaagtctttcaaaagggcttagaaacccttggaaaagaaagtctaatggccattagtgggggagggggtatactgaggcatgtacgacctcccatcccatcatggctaggaactcagttttaaggttaccttggggttctcttggccaagaggtggtctgtttagttggttgatggagttaggattttatttttatttctcaccatcaatctgatcacatctcaatctccattattagatcaaaaactccatgaagacagagactatgtcctatttctatccatgtactcagcatctaatacaacacctggcatataataactaatcaataggtttgttgactgaataaatgaatagtcctgtcccaacagggcaaaggaattaattttttttttctgaatgaaattattcctctatgacaaagttcacctccttaaatttcctttggatcactttgtctcttgcattgcatgtaggtgatgaatattgagaacatttatacttcatttagtcattttctccccaaacagatatgacaatgaataattttatcataaaatcaaataaaaagtgaaagggaagtatattgggttggtagcatagaagaaaggatgcctgggattgccgtgaggctgggctcaatggagatgtatccttcagctaagaatgggtctcagccatctcctaggggctatgaaatgtggatggctgtgtttatcatgactagaaggaccttgtgtctcttaatgggtggggctcagggatgttaaacatcctgtaacattccagtcaaatctttatgatgaagaattttctgccttaatgccattaatattcaatataggaatcatcttttttttttttttttttttttgagatggaatctcactctgtcacccaggctggagtacagtgacgcgatctcggctcactgcaaccagcctcctcctcctgagttcaagtgattctactgtctcagcctcccgagtaactgggactacaggcacctgccaccatgcttggctaattttttgtatttttagtagagacggggtttcatcgtgttagccaggaaggtcttgatctcctgaccttgtgatccgccggactcgacctcccaaagtgctgggattacaggcgtgcgtcactggacccggcgggaatcatcttttatactttaagttagtttcacttcaggatatgccgtttgtttcctccctccaccttttttattcttttttccctttcttccttttcttccttatttcattcttttcttcccttcctccttccaaaacttactaaatatctactaagggaaatggatggtgatgcttacgaaaatgaatcagacataggcttggcctcagggattaaactcatgcaaggaaagatgtgacatttgtttaaaaataaagagaattgggcagaaagaaagtggagggaaagtaaaggtaaaatgttatagatcagaggagagagagatgtccctgatgttttaaatgaaatgcatcttataaatcaacatttcattatgttttgcagacctctatagtttacaaaggcctttcctatatgttctttcgtttacattaatacttactgtaacccaacaaaggtactttatttgccctcagatttattcctcactgtttctctgctctgctttgtattagcaggggccagaccttgcaaactatgcccccatccttattagctggctgccatctgggtttagctaataggaagcaatgggagatagagccttctcccttaagcagcaggtagctgctgcttctctggcggtccacttcctacgagaaaagccttttgtgtctggactccagaactctgcttcttcccttttctctcctgctgaggagtagtatagcttcctgttgttgaaatctctggtttactccaccattcccttatgactcttaaagtctccaccacctgagtaagcaatactttgtattaaattccctgggctgtaaatatctgaaagggattttgttttttaaattagatcctaagtagaaagaaagcactactcttaccactttagagataaggagaaagttaaacgactttcccaagttcaaccagcaataagaggcagagtccaggtctgtctcctgactccaaatccaggcttttatccactgcctcatactgcctcccttagagactataacaatgaaaacataatacaaataaagacttttccaagatcatataaaagacatatcagattgtagaattttgttttcccctgtgtgcctttaaattgagatgagcttcttttgtttttattgttcttgggaaaagttaatgtattagctagattaggagaatgtaacacaagtacatatggatattagcctgacatttgacaaagtcattcacgatagcctactggaacaatgcatgttggtacagtcacatggattagtaaatatttgatgcaaggttttaaaaagtccacatagtaccttatgctgtcatatctcataatatttctacgattatcattatgacctcaccttggaatgaggaaaagtaaaagtcatattgaaaatgttttcagtttagaaagctttcataaatatatgaatcagagatacatttgtccaggttaccataccctggctacaaggatattttaattatcaaatattactaaattagttactgaatgttaccaatcaccaaaataactaatttactaataattataaagccctattctctgaaaagaccttatggggatggaccaggatctgaagtaagggcttggggatatgggcctggcaaaaacaggaagtggagctctgtgagaaggctcagtttggaggggctgcttgttcagattttgctatgatttgaatcctattctttctcctggagaacaagaaactaagaatgggaatccagaagcatcaggtcacattccaagagtggttacttacaccacatctgtcatcagccaaatctattctgccttgaaacagaggagagaaataagaggaggggcatttgagccttatttcataaagtgcatggtgttgaatgctaaattatccatgtctttgaagggctgagtttgaatgagttcacatatacatcccagtgattctcaactgtggatcctagataacatttggaaaattgcagggttgtttttgttagaaataatcgctacaggtggttcagtacatgttagttgttacgacagttccatacaacaaagaattatcctaaaattatcacacctacctcctaggtgctacgtatggtactctgttaggattgtctgattaattccatgaaggtctatactcctggggtgagggctgtggctggggtctcccctgaaaaagaaggacttcctaagtgtcgcttttctggagaagaggtgatttattaggtaaaactcccagaattatttggtgcaaaacatccaagaatgtttctgcttggaacagatgtaggcccacatacaaaagagggtcaacgtgagatcatattagagaagctggacttatgaccaattcctttgggcggtggaagtaataagttgacctatttcatctaactccactaatgtccacattgttaggttgggggaatgcgtgagtcttcctttgatgggtgtctcttaggggctgaagcagcctccaatgtccaggtggtgatggcagtgatgtaaatgaaagagctgcaaaggaaggcaaatccagagaggaaaagaaaacaactgcaaaggtcattcatctcttctcatttggggaggagtctcctcccattgcctactttttttttttttttttttttgaaacagagtcttgctgttgcccagcctagagtgtgatggtgcaacttctgcctcccaggttcaagtgattctccagcctcagcctcctgtgtaggtgggattacagatgcatgccaccacacttggctaatttttgtatttttagtagagacgaggttttaccatgttggccaggctggtctcaaactcttgacttcaagtgatccacccgcatcggcctcccaaagtgctgggattacaggtgtgagccactgcgcccagaccattgccaactttggaagattgaagtgttattatggtatggctagatgttcatcagtcctatttcctcttcctgggcacatagacaaaatttccagcacttggtttggagccatatgactggtacggctcataggatgtggttgaaatgatatatgacacttccagacctggcccttaaaatctcctgtgagattcttgactctctctctgttccctatcttcatgtacggtggagccattctatgggaacaacccagtttcctagatactggttaaagcaaaactgtctagaggagtcacaaccaacactggactgatacatgattgcaaattaaacttctgttgcattaagttactgagatttgagggtttatttgttacaacagcatagcctagtttatgtaccacaagtttgaaagggcattaatcaataaactgtggctgattcctggagaaaagtgtatagtggtatatgacaaggctctgctttctgcctgttaatgacctgggtgagaacactggtagaatactgatcaaattggaaactgataggaaacaggaaggaatacttcgtgtatctggtaataacataagaatatttctaaaaataactagaagattttaaacactgaaccaaatcaaatacatttctgtagggctaaatggaaactactacacttatatccaaaaagcctatcttacaagtatagaatagacgatatgtgaaaaatgacttcaaggcttaaagtgacagtaaggtcaatatgagctaacatgttgcagttatgtgatataatcttcagctgcattaatataaatatgaagtctgaaactgtagatagtaacattattctattttttagtgattgaaccaatactgtgctctctaaatgcttcagtttaaactttaggactatccctgtaggaaaaaaaatagtcaccattattgtaggagcttgaattaatggtatgaggaataatcaaaagaactggacaggtttactttggagaaaacttacttaaagggaccttgataatcactgaaaatacattttattgatatacttcacataccattacactcgctcttttaaattatacaattcaaattttttttatatattcacaactagatagatcaccactatctaatttcagaatatttgcatcatccaaaaagaaaccctatgtacgttagcagttacttcctacttccctctccccatagtttctggtaattgcaaatctgctttaggtctctatatatttgtctattctgagaatttcatacaaagggaatcatgtaatacgtggtattatatgtctcacttctatcagtgagcataatgttttgaagattcacccattttgtagaatgtatcagtacttcattcttttttatggttgaaaaatattgcattatatggatataaaacattttgtttatccattcatcagttgatgaatatttgggttgtgtccaccttttggctataggaataagtcttccatgaacaatgcttctattaacacacattttaaaaaaattttaagttctggaatacatgtgcagaacgtgcaggtttgttagatagctatacatgtgccacggtggtttgctgcaccttttgacctgtcctctaagttccctctccttgccccccaccctgcaacaggccccagtgtgtattgttcccctccctgtgtccatgtgttctcattgttcaactcccacttatgagtgagaacattaacgcacaattttttatgtgacatatgtttttagttcttttgagtattgatatgatttggctgtgtgtccccagccaaatctcatcttcaattgtaatccccacatgttgagggaaggacctggtgggaggtgactggatcatggtagcagtatccctccatactgttctcaagatagcaaggtacttctcacaaggtctgatggttttaaaagtgacaggttgtttttttttcttgttctgctctctctctctcttctgtcaccatgtaagatgtgccttgcctccccttggccttccaccatgattgtaagtttcctgaggcctccccagctatgcagaactgtgagtcaattaaacttcttttgtttagaaattacccagtctcaggtagtatctttatagcaatgtgaaaatggactaatacaggtatatacttaggaatggaaatgctgggtcatgtggcaactccatttaactttttgaggaactgcccaactgatttacacatcagctgtactgttttacattcccaccaacaatgacaacagtttcagtttctccacaaactgtctaacacttgctatcatctgtattttttattagaaccatcctagtggatgtgaagtggtatcttattccgacttgatttgcatttctctaatgattaatgatgttgagcaccttttcatgtatttattcccatttgtatatcattttttgagaaatatctattcagattatttcccaatttttattgggttatttgtctttttattatcgagtaatacttcttttaatattctggatactagaccctgatcagacatataatttgaaaatactctatcccattttgtggcttctttcaatttcttgatagtgtcttttgatacataaattttttttaattttgaagtccaatgttattttttctttggtttcttatactttacgtgtcatctctaggaaatcattgcctaatgcaaggctgtggaagatttaacctaagctatcttcattgtccataatttaagtctttgatgcattttgagtaaacttatgtttgagtaaatatattttgagtaaaaatatggtataaggtacacacccaactttatctttttgcatgtacatattcagttcactatttgttgaaaagactattctttaatttatttacatcctgatgtattatgtcctttcttctgcttgctttgggtttaatttactattctttgtctagtttcttaaggaaaaagattaggtgattgattcagaatcttatttcttttttaaaatacaaatacttacagctgtaaatttcctcctaagcactgctttcatagcctcccttaagttttggtatgttgtgtttttattttcatgcaactcaaattaatgtctcatgttttattttttaacccattggttattgagaagtgtattgtttaatttctagatatttataaatattataaatttccctctgttactgatttctaatttcattccattatggtcagagaatatactttgtatgatttcaatcctttaaaaatacattgaaacttattgtatgtcctaacatgtgttctatctcagagaatgttctatgtgtacttgcaaagagtttttattctgctacttttgggtggaatattctacagatgtctgttagctcctgctggcttacagagctgttcgtgacttctgtttccttcttgatcttctgtctagttgttctgtctattattaaaagtgaagtgttgaagtctccagctattattgttgagctgtctatttcttcaattctgtcagcatttactcttatgtattttggtgctctgttattaggtgcataggtgcaaaaattttgttttgtattgcattgaattgatacatcaatttagataaattgtcatcttggcaatattgactcaatatgtgtatataagggtacttcaaaacatttgtggaaaaaatgaaattcaaagataaaaagtataaactttatttccaatataagctccatcaagttcaagatatctttataagttatggtatcagtcatttagctcatccctaaagaattgagggtcttgggaatttaatcatgtcaatgcagtcattttttgtaatattaactgaagaatggtaggtgccctttaaagatattttaagataagaaaaaaaaaaaaaccagaaaaatgtcagaaggagccaaatcaggtctgtaaggtggattcctaatgatttcctgtagaaattttcacaaaattgtccttgtttgataagaagataggagcattatcgtggtggagaagaactctggtgaagctttctcaggcatttttctactaaagctttggtaactttctcaaaatactctcatcataaggagatattattgttctttggaccttgggcaacccaaaaaactgttgccatgacctttgctcttggccagtctgctttggctttgactgaaccacttccactttttggtagccatagctttcattgtgctttgtcttcaggatcatactggtaaagtcacatttcatctcctgttacaattctgaaaagaaatgcttcaggatcttgatctcagttgttttaaaattttcgttgaaagctctgctcttgtctgcagctaatttaggcacaatggttttggcacttattaagtggaaagtttgttcaactttattcttttagtcaggattgtgtaagctgaaccaattgagatgtctatggtattgactattgtttctgctcttgttggtcttcttcgattagagtgcaaacaagataaattatttccctgaaagaagctcttttcaaactgacgtcttatacttcttagtgcatcaaataggattcggttcagacatgttataactagtacaagtttatttttgtgcaaaaagattttgaaatccattcatagttttttcataatacacattttccatgaactttgtgaagaccccttgtatggtatatctctccacttatttagatattttctaacttatctcagtaatgttttattgtttcctatgtaaaggttttacatatatatttttagatttttttcatatttattacaaatgggatgttattgcaaatggaatctctttaaaagttttattttcctttttttctagtacaaagatatataattggtatatttaccctgaaactagtacttataaatcataaattttagtagctttaggttactttgaactttgtacatatataatcttaccttctagaataaaaagaaaaaagcaaccagttgttttattttttcctctccaactcttaaatatttatttattattctggctgcattgtactggctataatctttattacaatatgaatataagtggtgatgtcaagagtccttgattcatttcaaagctcagagcaaaatctttcaacaatttaccattagctgtgaggattgttgtaggtttggataggtattctttaatagatacaggatattcctttctattctttgtgaacaaagaggtttttgttttgttatttttgatttttttgtttttgttctcccctatctgactgtcatttatttctacaactcctcgagagaagtagtcataagtggcctgttccatcttcataacagagaagggcataggatacttaaagcctacctattcaaagcatgaattacaatatattccacaatgaaaaagtgatgactatctcaatttcgaagttgattgttaagcaacacaggcttttaaaataaaacaagagcccattccaggggttgcaaacgggtgaccagtagggtaaatctggctgtagatggttttatctggtccacagtagttttaagcttttgttttttcttaattcttcaccagggatacaaaaattttacatttacatctgtgatttctgccttctcttttttaaaaaagttggtaatgggccttaatgcaaaatcggctggagaataaagatcccttttttacaagacgtgttcttaaatttgccactgatagtcacatatcaaatttctccttctaattttgttgtatagttttgaatctgggcagactatctgcaatttggtgaaaatgttgtttagtatgtaaataaacaaaaacacctaaattttacatggttatagaatgctgaataatataaattgaacgaaaacagaaaagatgaattaaaggacggggggtggggggaagtttgaacttaaagattccaaagcaagtgagaccatggtacatagtttagaaaatgttatatatgtacaacataaggtggactctgaggctaactttaggaaaacattagtaatttgtgagggaaactgacagactacaaaggttgtttcctttatcttcctaacctatcaatatcccactttgatattaattcaaaatgtttaatgaaatgacttctctgatagttaagaaaatttacatattaaaacacttatttctgaggatacagtctatcatttgaatgagaagacccaaagaatgccttactaaacagtaaactgcctttaagtatatcatctgtgatcaattcagtaagactaagtttattacacttcaattccaggcataaaatgactatctggtaaactacaaagagctccttacaaaagaagtccatataattacagatattgtagaattccaggctcttctctgaaaaatgcaaaggaatcgatgttcgagtactacggtaatccacatctttctcaggtcagactataccatatactgcagaaatgtttaatcaattttggcagctcaggccatgaagccccaccacaacatcctgaactgttacagtctaactcttgggtcgctgttaagaactgtaggatcttcaaggctttctgggaagctttgctcagtttgcaaatcacataaaagggaagagttgcctcttcctgtttgcctggcttcccttctgggattgcttctcttatcagtttcaggctctttggtatttctctattttaaagatttcaaagggatgtgtagggcatgagtcaaatgacacatatccaccaccatttgaggcctgatgtcccccgtaaggttggttgtctcagaatccagaagtggcttatagtctgtgatagaaatccaatcctcagcaactgcagggagcagcactgaggacccacagaaggccttgtagtcttccagatctgtcactgtgggcaggccccacaagcacactgcaactgtatactatggaaataccctatgaacacatctaagagtgagaggtgaagccagttggacttctaggttgggtggggacttggataacttttctatcttacaggaggattgtaaaatgcaccaatcagcactctgtagttaggattgtaaaacgtgccaatcagcgctctgtggctagctagaggtttgtaaaatgagccaatcagtgctctgcggctagctagaggtttgtaaaatggaccaatcagcactctgtgaaatggaccaatcagcacactgcaaaatggaccaatcagatctctgtaaaatggaccaatcagcaggaggtgggccgggacaaataagggaataaaagctggccgcccacaacaagccaacagcaacccactagtccctttccaggctgtggtagctttgttctctcgctctttacagtaaatcttgctgctggtcactctttgggtccgtgccacctttcagagctgtaacactcacaggggaggtccacttcttcattcttgaagtcagctagaccatgaaccggcaggaaggaaccaattagggcacaagagcaacaggctgctactgcaaagaggcccaaacagcagagatctcagcacttccagcatccgcaggcaaccctacatgttgacccctgtctcactgccaccccctgatgttccccccacccacgctccatctgcccggttggaagtggtttgggggaagaggaagggatagcaagtggtagactatcacgtggtcccccaagcacaggagaggttggccagcatttattaaccacgtggtgaacggcatgttgtctgaacagtcaccatcaggtcctagcagcaggccagatcagcgcagtgtcgtgagggcccggacttagggaacgcatccatggccaaggtgaggtagcagaagcagaaaaggccaaggcccagcaggccagccagcccctcaaactgcagcccgcactgctggtacatagtcgttgtgtgcaaacttcagccatgccagcgcaggcagcactagctgttggctgagcgcagtctcgacttggtggccttcggaagaccgaaccaggggctcgggctcaggctctggctcgtgctttaacagaagcctccaccggtgtctgcttccgcgaactgagctcctcctcctgctgggcaacttcagttgcaagatgagtgtctcctccctagaggccatggtttggaagtcattttcaatacaatgatttcaatacatacattcaacacatacatttcattcaatacattgatttttgaatgtgaaatccaactttttttcttaaacccaaattgttcatggtgtgttatcatttttgtagtttgctatatttgatttactaaaattttgtatatcatttattgcatctgtgtaaatgagagagctggagctctagttttattgtaatgtcactggcaaattttggtttcagtgttatgctgtcctcataaaatgatttggtgagtattgtctcttttaatactttacagaatttgtctattttatgtaattttttccataaatatttcatggaagtcactggtgaattctggatctagaattttcattaagggaaggtttcaatagatacagaactattttgagtttgcatttcgttttgataagttgcactttccttagggtttatttcatctaaaattttaaattaatcggcccaaagttgttcacaatgatctcttatgagctttctaatgtctaatgggacctgtaataatgtacgctttctcagccctaattttagttgtgtgagcgctctctatagaaactcacacccctgaccagggctcatttttttgggctggccagctccagccctgggccaactctagccttgtgtctgtttttataaaataaagttttgttgggacacaatcatacttattcatttgtatattatctatagcagcaccacaatgccagagatgaggagtttcacagagaccgtaaagtctgcaaagaccaaaaaaaaaaaaaaaaaaaaaattttttttatctggtcctttacagaagaagttattttattcctgatctaggctattagtctactgaatgaaccaactttttgtcttagtttctcctctcctatgtttatttcagtaatatcttttattttttatttaaatttaatttgctttttaaaaacttcttgaaatagtttctcagataaattgatttccagttcttcttgactggcttattaagccataaatttccctctaaataaggctttgactgtgattcataagctttgatatattttcattatcatttagttcaaaatattttctaatttgcattataattttttatttgaatcttgggttatttagcattggatttcttaatttccagatatattttctagttattgtttgtttttaatttctaggtgaattttagagtcccctgggaatacagcatgtatgattttttttttttctttgaaatttttgagacctgccccattctccaacatatggtcaattttggtaaatattctgtgtgcacttgaaaaaaatgtgcattctgaaattgtgttcagtgttctaaatatgtcaattaggccacgttttgtaatcctgttgcactaatctgtatccttactgatgtattgtttgcttgttctatctgttattgagagagttatgttataatctctcattgtaattgtgaattttttacatgtccttttacttctgttattttggctttacatatttttcatacaaatatgggttaggtacatataacttcagaattgtatgtgatcctggtggattaaccattttatcttgtgaaacatccttatttatctctggtaattaaccctgcctcaatgtttattttcctgatatttaataaattgtagcagctaattctttgctcaaaattccaatgtcctatctcttccttctttttttatctgaccaatggattcacacatcacacaattctttactttcaatatttaaatgctcttataattagtacctgtttcctatcagcaatatatggctgatttttattaagtctaatctaccagtctttatatttcattttcagtatttagtatagatttatgtatttactgatatattttagtaaaggctatttttcccacttgttatctttctttttctaatctttattgactcttttgaattatttctcataattcaaatgttctctgttaatatttatgttattttagtagttatcttaaattactgactttttagaaaataaaacaatgcctttacctctcccagacaatgtaaggactttaaatctattccctctccatcaacttacgtgatattgttgtcatgtgtgttgattctatataaattttaaatcctagaggatgcgattgtgttatagagtcagtattcttttacatttacccatattgtcactagttctattggttgttactccttttggcatctccttgcttcattgagaagtcatctttcttcaacttaaagaatacgtcagtattggctgggtgcggtggctcacacctgtaatcccagcaatttgggaggccacggtgggcagatcacctgaggtcaggagttcgagaccagcctgcctgcccaatgtggcgaaacctcgtctctactaaaagtacaaaaattagctgggcatgatggcgggcgcctgtaatcccagctacttaggaggcagaggcaggagaattgcttgaacccgggaggtagaagttgcagtgcactaagatcttgccactacactccagcctgggcgataagagcgagactccatctcaaaaaaaaaaaaaaaaaaaaaaaaaaaaggatttcctttagtgtgaagcttctgtggtggttttttttccttagctttgtttgactgaaaaatgtctttatcttcttttttttttttttttataatgagactttatcttcctgcctttctaatttcctcctggtttttattttcaaaattttaagtgtgatattttctaggtgtgatttccttctatgtatctttcttgtggctaatggagcttggttagtatcctttttctgttggaacattgagggtcatcgttatttcttcagctgttacttttgctctattttctctccctggaactcccattataggtctgtcagacttttcaccatgtcccatttaattcttaagtttttttcctgtattttccatctttttgtccctttgtgtcaatcaatacattttattttggcctatattccagtttactaaacatctttttaatagtatctttttcctttcttttctttttttttagagacagggtctcactctatcacccaggctggagtgcaatggtgtgatcatagctcactgtaacctcgaactattgggcccaagtgttcctcctgcctcagcctctcaagtagctgggacaagaggcgtgcaccttgaactgtacctaattggcttttaaatctatccatttggaatcatgctatgaggatttttttaaaacagctttattgagacattaattcacacaccatacaattcacccatttaaagtgtataattcagtggcttttagtatatttacatggttgtgtatccatcaccacatttcttttttacatttagaacattattagaacatttttattacctggaaaagaaaccctgacctcttagtcatcaccacttaacctcccatcatgcccacctctgggcaaccactagtctgctttctgtctctatagatttgcttgtttttgacattttatataaatgaaatcatgcagtatgtggtattttgtggctggtttctttcacttagcatagttttcaaggtggatccatgttgtaccatgtagcagtcttcatttgtttttatttctgaataacaatgtatacatgtaccatattttatttattcatctgttgatggatatttatgttgtttccatctattgagttttatatttcactgatagttttcagctttagaatgtaatttgattattttttatattttctggttctaactcttgtcagaacttcttgttaatttattgaacatatctagctgtgtcttacagctacagtatctggattgtttttgttgtcgctgctctgtttctgtttctttttctctcttttttttctctttagccttgcttttttgtatacctatttattctttattgaactcttcagatatttttcatgaaaaatggcagagataatttgtggctctggattatgctatcccctccagagaggatttactttgtttctggcaggcatttaggcaaggaagttgatgaccttaatccaatcaagcttgacttaagtgtgaggtgtggtctgttgctggttcacccacgcattttaggcctccaatcctgaaagcccagggtgcttaccagggccccttcttcttagtgatttccaagttttgactgttaaatctggagctgttaaaagcccttctctgtttctcagactcttagctgccaccttgactttgaacatcagtaacagctgtaagtatcaacgtgactctgaattgtgggtttacatttttttggttttctcctcttccatatctttgcctcacaagtcttactttcttgataggtctcatgtctttaaaaatatttttaaaatatatattatcctgcttctctggttattctcagccagaaggcttctttgaaactatctagttggccgatgctggaaacagaagtctacccacgaatttgttaagaatcatttctttcaaggatatggtaaagcaagcattcttacacatggctgattagagtataatctagttcacctctctaaaaagcagtgtttcagttagcccatggccttaaacacattataccctttgactcagccattctaattctgtgagcaaatcagaaataaattattagagaggcagaaaatatatttacatacaaggatattcactaaaactcttaatagagaaaactggatgtcaactaaatattcaatgataaggatgataattatggtacatctatgagatagaatagtctgtggtgattcaaaatcatgtattgaaaaatatttattgatatagaagaataagatataaagaggaaaatgatacatacttttcatgtagcatgattccaatttttaaaaaagttacatgtttagggaaaatgctggaaagatacaaaccaatttttaatgaacttaatgttagatggtgagattaagggtttttaaacattttcttctttatatatttttgtattttcaaaggtttttaatattgagtgtgtactatttttataatgaagaaaaagtcacaaaaaaaccctaaactcacttttaatctggcagattatattccattcttttaatacagactttagcaagctagaaattctttacatttttaaagtcttagaaattaagacaaagacacttgcagaaaaccacatgggatgttgctggagagatgacagtgagcatcttcatcatgctccagggagcagttggctgcatgactctagttgttgtttcaatagttgacagaggtttcagcctttgtagacttggtggtcttcagactcttactgattgaaaaaatacttctctacaaaagtacaacagattttggagtctttttcattgtgaaagtcatatatccaaccagattttattagctacagtttttgttttcaaaacctctgggtgttattagggaaattctcttcttgaaattcaaaattgattttccagctggacgcagtggctcatgcctgtaatcccagcactttgggaagctgaggcggacggatcacttgaggccaagagtttgagaccagcctggctaacatggtgaaatcccatctctaccaaaacattagctaggcatggaggtgtgtgcctgtggtcccagctacttgggaggcggaggcaagagaattgctcgaacctgggaggcggaggttgcagtgagccaagattgcgctgctgcactccagcctgggtgacaaagtgagactttgtctccaaaaaggaaaaaaaaaaaccaaaaaacaaaacgcttcaaatccattttcataagaaccaatttttcccactgttctttacagaacaggtcatttatgaagggatcttatcttggaagagggagggtaagaagagacagtttggttatttgactgattacatagcaactccatatgggatgttttatttcacattcttgagttaatccttaactaatttctcatatctgacctctgttttctttgaaatgttggtgaacatgtcaaacattcttcccacccacctcgacactttactttcttccccagcttggtttcagataactggcaaccttatgatgtttattgcttcagatatggacagtttaggaactatccaaagtttctcattgctcatctgtaataatacttttcatgatggcactagaatcctaaattctggtctgattcaggaagatggtctattttcatatttaaattggcctgaaaaaagtaaggccttgttgatacaggtaggggtccactaccctgaaatgttgctcaaaagcacatttcaattttattcaaaagctgctttgatgtgtattcccccaaagcaccttagctgaaaatcaaattttattttagagctttgtacagaccaatgtctctttctagcttcctgtacaccaataaaattgtgtatttcaatttaacctcaatctgcctgtgtttaaaatataaagctaaggttaagggctttcactgctagcaaccctacctggacatctctatttctagataaaaccttttactgagaacattttattagtcctgcagctcaacgctgccatatatgccagcctgtcctattaatccttagctacaaaaatatcagaatcatttatgagctaaagttttttttttttttttagctttttaattttctgagcctttgtggtattatttgggtcagtttggttgctggggctccacctcttcccacctgcccccaacccagtgtctctgagttggggagaagagtctcaggaccatggggaccaagaggctttagggctgaccacctactgtaactggctgtctcatgctggccccttggcctgatttgggatgcgagatgccccatcactttccttttgtgttgttcctcaagtcctggaatcccacagtagctcaccttgtttttaccacccttttctcttctttggggcctactgcactatttccaaattttatagtgtgtttagtgggaagagctgggagaaatggctctgcaccattttgtatagactagctctttttagctatataaaaggtttcttctattcagacttctcctcttgttcataaaatgacactctaccttcagagaccacatgtgattttaatgccaggattccaaggcttgttctctgtcatatacaaaaacaatgattaggttgaagtggtacagaaccttgaaatactctctggaccagttctccagctgagactcaggatcacctaggacccagttccagacatcatactcatacttcaatgtcatactcaaatgagcttggcagaaatgcataaatgtgttagaattagggcctgaggaaccactgtcatgcttctttctgccctttcatggttaacaaaaacagactgactgctgagccagggatctttgtttcttggaagattttgcctcacctaacagaagcttaggtgggttcttgcctcctaacagaagcttggctgtgtccacatttttattcatcaaagcaggggtctccagtgaagtgtggacgtcaccaatgggctttaggaatgtttggtggctcctggagaactggtagaacagactggaaacctgagtgtctcctggaaaacaacttcagccacatccactgctggagttcagacagaggcatatgctgttcttgactcttctctttcatttaccttccatatgtaagacatccacaaatctgttaccaccatcttccaatatatccagaatccaataacttctcatcagctcccttactacctccctgacaagccaccatccactctcagtggactactgcactagcccactagctcatctttcctcccctgtatctcccctaccccagaaatgcaagtcagatgatgaaactcatctgtttaaatccatccaatgttttccatctcattcagggtcaaatgcaaagttcttcagtggcctatagtgcctggcatgatctagccctgatactttactagtttcatttgcttcttctctcctccttgctcatttctctccagcaatgtcagtccttaaacgtaccaagcactcccccacttcagcacccttatccttgaatcccccaaccgcaatgttcttcccccacacatctgcatggctcactcttcacctgctcagatagcaaccctgtcaggttttgcagaccactctgtaaaatttgttctctactcttgggttgctcttaatccccttatcctgctctatttttcttcatggcacttggcatcacccaacatagatatgtatctgtttgcctctttgccccttatggaaatgagagataggactttaatgcattccttctgtgtatccagaacctagaacagagcttggcatgtgatgggcttccactgtttaatgaataaatgaaggagtaaatgaatcaagataacctcgtacatctcttcaaggtggaactggaaagcctcccagaggaactcgtcagaaagaaataaggcctacaagagttttaaccagtaaccgagaaaggtaattctgaaaacagtataatgactgtctttaggcccaatgcccactggacacatgtctggtctttggaaaacaataaggttgtaaataagatcagaaagattcatttacctgaactataaaatatgagtgcggaaacgacactgctgtgggagtgttgttcttccccttttgccaggcattagttttctatcctgtgtaacacaataccagacatcatcattatgtcacagttctgtaggtcagaagtccaggcagccttggccgtgttctctgcttagggtctcatgcagctgatgttagggtcttggttgagctggactcttatctggaggttctggggaaaaatctgctatcgagctcattcaggttgtggcagaattaagttccttgcagttgcagggctgagggtcccatgttttttctggctgtcatctgggagccactttcagcttctagaggcacctgcatttctccctacgttgcccatccatcttcaagcaagcaacagcacctcaaatccttcttgtgctttgaatctctctgccttctctctctaccattagctggcgaaaactctgcttttaaagagttccttaggtttatgttggacccacccggataatctttcttttgcaaataaggtagcataatcacagaagtgatagctcatcatatttacagattccacttacactcagaaggacccacactgtgagtcattcttagaagtccaccacacatcacgatccagctaggcactaagagggttcctgggatcagagtgatacctgatggaggagcagtggtccccactgtacctgcaagaccattagtgggggactgttttgccatggggcatattgaagagaaatgggctacttctgggagtggcagcaagatcctttaagcctgataggctagaggcacttgcaggaatagacctgtttatgcgcctatgatgatgactttatagagacctatagaaagacttgcaaagaatttccaaaggttaagtgatcctgcaaggccacagatgaatcaaatgtgagttattactgttcgagtgaccatgtttgtgtgcatacagtagtgaggactggaaaaatgttccccaggtcagagcagatgttagtgacttaatctaatgaagtcctgaagatctgaaggaccaatgacccttctatgtccttgtcctttcaatttcaagattctaaacctggtaaatagctaagccagtattcaaccacaggttgtcaagctcaaaagcccatgaattttctcaagaactctgccagggatgggaaatgggtggcatgcttaccatgacgcagcactcctgtgccctatcactgaccactcaccaccttcctgcagcctaggaatcatcacgactgctgtcgactaccactggcaattaaatcagagttgaaatccagggcagaacttaactcccatccctggagaccacactgtatctcaaattccagcaatgccagaaccagaaagatttccgccaatttcttactcagctgcaaaatcatatattgtaaatgttagaggaataccttgactctctctattgtgtacctttagttgaatctgactaggggaagggaagttaaaataactgaaatcttttatacatttttggactattaaacttataattctgggattttcctctcctagcttttcttttttttttttttctaagtatttcactgattaaaatgaatgagaaaggaattaaaatgaataaatggcaggaatgtagacccaaagaggatacactaaagccatttgtgctatttaaacttcttagagggaactgatgttaacattaagaggctgtgctctgttcccacagagaagtagccttaggcaagctgtcaggaagctcaagttgatggaagttactggaagctctgagaggcggagggggagggggttggggggcatctcttggatggtgcagcagctgtatttggaactgggaaggtagggaaggggctactggagtgtcatgtagtcctatattttgaaatgcaaagttatcttctttgtattgatatttctaggatgcattcacatgatgcagccatctcacactaaagatcagatacttctttccagatatttcttgttcagacaaccgagacaaaaagaaaaaccatacttgagcctcaaagacagcaaacggaggttactcttaaattggccttataagcccgtgatctaacccctacctactccaccatcacttctcaggatctgggcggaagcctcactggcctcaaggttttcggtgtggctgttctccctttggcctgctcttgcctacctctttgtcagactaactcctatttagtggtgcatgatagacacatctgatagcaataactcaacgtaagcataccctgagaatgaccctgagaatggcccttatggcagacacatctgaatgtggttttcaagctcgggaatctgggagcggccaacctggagattcattccttatctatgaggaacacctgagcccccagcccgttttccccccaccgccccggaacctgggtcagacagtggatctaggccctttgtgttgggttaaattaaggttgccaggtgggggttgttgggagagggtgctaagtgaaggtgctgtacaaactgcatgctttttaacaagcaacggtggttctcttgtctagcctgctgtcactgcaccatctctttgggtaagtttcccactgataaaaccctgtgtcttgtttgctggttctgggactcttccttggcttcttgaacttggtgttgtccctactgaagtgaatagggatccaacatgacaagttctcttgtcttaatttaggtgcatgccttgtggggctcttctctgccttgcaaaccttatcagatgccccagttacacacttgcctagagccttgtactttgcctcagtcacacttgtggttactgctcagtaatgcttattgaataattaatttattgtgtgctgtagttctttttataaatgagattgtcaatttcttgaggccgggaattaagtctctttcgttcactgctgtatctgcaaaacctcgctcggtatttaatactcagcaagggcttggcaaatatgtgttgaatgaattaccgtgagaaacaaaaaaactagaaccctggagcactggctatgataaaaacatgcagcaggtgggttttgttttcaaggcacttcttcctctggtagcatctctcttcctgcatacatccacacatgccaggctcatgttcatagggcttagctcccagttgactgttaggtatttcctcaactaacgaactgagttgacaatgaccagggctgttttgagctatatttggagaattttaaacaacagagatgtttctaaactttcagctgcttggaagattttaaattggtaaccaaggtagtgatctaggagatgtcatgtgctataaggagattctcccccatactattaaaggaatctccaaaatgaggccgcatagcagatgggggtaggtgggagggaaatttttgtggcagtggtgatgcaggtggagtgaattagatcagctgtttttgtttttaacagaaaattgtgatggttgaaactgtctgacaagacagctggcatttttattaaagccttcagcaactacacacctcaataatatgaggaggggccctgcctggttgattggtaggtggatggttaattggttgttttcttctggtcaagcttgactttctaaatgtgtaataaagtcataagacttccatgcgtttgcccgaaatgagcttttctggtcagaattaactatgtgtaggctggtgctcccagagtggttggtagacattttatttggttttgtgctcccccaacagggagtagcccttttaggacaggaagcccatttcccagatctgtgtccagagcctcaagcccagtgcatcacgagtcactccttaagacggatgtgttgatttaaacccaaacgaatgttttagaggagccgcctggcctggcctctctcactaccaagcgttggttggccagggagaaacaagtctgaggtgtctggtgtgcgtgcgcatgcgcgccctttctccttttttccttccgagtttttctctcctctctcctgcctttctttctcttctttcttcctccttgtctctatctcagtttctgtttctgagtgattcttgtctgtttctctcccttttcctccattctctgtgacatgaagggtttataagttgttaagtgcacaagcaacccttggcaagaggagaaaagagggcagaaatccagctacactatactggctgaggcataagtgctggcatgggattttgtctgcccagagaaggcatctttttctaatgtacacaaaagtgttttgggggctaacagcggccctttctttccctagaatattaccagggaaaacagtcattttctactttcctctggatccgggcttcctcgtatctcaaaaaacccgtcattaccctccttctctcatctgctgaccaaacctgggcaggttggaattgcatttctattggaaacgtattattaaaaaagtgttttgcagtatttagggcttgtgtctttttttctgcttatcttttatttttgttgggctcttttgagtagaagagctaaacttttaatcattttccttagatgtttccctctaattttctcttcccaattgtctatataactaaaccctcctaagctcttgttgatcctctggcagtgaaggtgtgtttatataacagtggtgtttgttccataatctctgactgaaaatattgagggtgggaaacctttgcatctgcaagctgcctgacaatcagaactgcagacagggaagttggcgttttgagaatgctcttgagattgaggtccatttctaattatctcttgtatctttagttcctggcacattgcttagcacataacaggcattcgtaaagactgctgaatgcctgaagaagtgagtgaataaatcctcctctagccacaggctatttaggagactcacactagtattaggagtagctggtataaatccaggtcagggcaggcactgtcccttacattccactgacctgagctgcagtgagatgatacttgtattaggctcttgtgagattcaagaaacaggagcatgctaaggttaaccccttaaagaacataaaatacatggaagtcagggagactggaaaccagctcagtatgtatagagaaggtctcccgcaagaccacgcagatcaagagagcaggagagattgttccctgacctgctgctccaccattgtgatgacagtgattttggcctgcctctgctattcccgttgactgctgcttgctcttctccaacctcacacctctgcctggtgtctggccttggagtttctcccagtttctgtggattctcctttctggtggctgtcactataggtcccaccgtccagctcttctgactgggttgtccagctatgtccaaaagaggtcctgctgtagaatgcagagcccttgtaccaggctgcatcagggacactgttctggatgtggcaagcccctcagacagggactattggggcaggcatttgaggcttcccagaagtacttgggctgtgcgctttgtgaagattgctgctgtatcttgagtgtcaaaccagaatgctttttcagtttacagtcatacctcattcacttagggctggctgtctcaggaatacttttatgatacacacaaatgcaaatccatgatggtgccaaaccttatgtagtcagtaaaaagacaaaagaaccccaggttgacaatagagggagcactttcgaagctctcaggcaggggcacctgcaggtcatagagacctagctctccttgatttagggtcacttttcctcagctgtgatctgtccttatgttcttcacccacaatgcctgacaaaagacgctggaggtacctcaaaagtgccagaggtggttttacgaagtttcagtctctttcaagaaaatgattgaggaaacagaatgaggctattagggattggcagaaattctttgacaatataaaagaaggacatcataagactcgtcgcagcctgggaggactgcctgatgatcatacagtattggaaagaatgatgttagaggttgtcaaacttcaggggatttgaggaggacagtcactgtctctttaatgattatgctgtaatgactgtgtgcattgcttatctcattttggggaaagcattctccccaccctcaagctatttcccaagaaatgaacacaggaaatttccaagaaatttcccaagcattctcctggacagttaccaggagaagagccctcatctttcctctgtcttcacaaaactggggctcactgacattttctttgccaatgtaaagggctgaatctgttctcttgttccacggtgagtgtcgccataagtccagatactgtttcccttctggggacttggcagctagcctgaacctcctgcctgggattagcagggaccgggggatggaggggaggctgcccaggtcattgtccttgttccccttgatctctccctttaagcagcagactcagtcactggcgccatcaatctagcacatttcataaacagtaaattcattttaaaaacctgctgctgagcagccatctgtctccatttttgtcaatctgctgttacagcaatgctagtgtactgtgaggttgtctttcattaaagactccttgatctgaaggtgagcacgttaaacatggagaggagctctgggccagctgacagcatttctgaccactagcctttcatcaccggaacctggagtttaaaacttatttttgacctaaaatgatgatattgatggtttctgtatcttgctgtgcttgatttacatactttaagattacagagtgttctaacatcctaacttactactgataaggtaggaagaagactgacaagtcttattaccatttaagtattactgtagataaacaggcacagagtagttaagtgcccaaggtcacgtagcaaggatgagaactgggaatatactggagctatggtctccctcctgaataactgagtcatctctatctgttttttttttttttttcatgtgaccatttcacaaaatctctacacatggacattttgctctccagagaccagtctgagcatagcaaagaggattggaaccagctctgagctgagttgtaggaagaagctgacacctggatcccaagccagtttttaatacataacatcctacaatgtattctctttgcagcacacaggacctctctccactaatcatttttattaggaggaaaacatattaaaaccaaaaaacctcaacaacataaaatcactgaaagcaagccaaggatgcagacagcaccagacgggattgtaggcagtggaaacactctcctgcaaaggaagcgtgttaacttacgctcaggccccataggcttgtcactagatgaaataatctgaaggaactcagagggtattttcctgtgcttaccacccctaagcacccttacaagccattttggataatagaagaagaatctaggtgggaagctggttcagagcccatcagaattccattatgcccatgatgttggcatgccctgttaacatgttaacatttagacctacctaaaataagtcagatctaatctccaagcatagatttcaaggcagtaagccatgctgctgttcattcctgcggcatcctgggttgtcactccctgcattgctccccaccaccttcctttgaggaaagtgcttggctttgacgtgttccctctagtgtctgtgctaatcctctttgtggctcttctactgctttgttcttatttttgacacgttgagcaaagcacctggaattggaagagtcagcttctctttgagcaatcagtggatgccaagaataatacttctgccttattcttgttccttggggtgatggtgaattctgtgtgtcaacttggctaggctgtggtgcccccttgtttgttcaaacacttgtctagatgttgctgtgaaggtaatttttagatgtgattaacatttcaatcagttgactttgaataaagtagattaccctccataatatggatgggcctcatccaacctgttgacggtcttaagaacaaagaccagtttcctaaagaagcagcagtgtttgcttcaagatggcaacatagaaattctgccagagtttccgtcctgctggcctgccctgaagattttggactcaaggctgtagcattgactcttatctgtatttacagtctgcctacctgccctacagattttggacttcccagacttcatatttgcatgaaacatatcttaaaataaatgtctgtctacctatccatccatctacccactcaaactatttgttctgcttctctggagagaggcacgaatacactaagcaactaatacacttagttaatttcaacatttccttctctacaaaggactagaagctaattagaacattctggagctgccccagccctgcctcttattagccctgcctcttgtgtgatcttggggaagttgcaaacatcactgcctctgtttactcaactgttaaataggagtagggtatttgctgctaggttgttatgaggattaaatgaggatgtgccacagagtaaatgttacgtttttaaaattaaagcaagtatattagaacatatccagcactttgggaggctgagatgggtggatcacctgaggtcaggagttcgagacctgccggggcaaaatggtgaaaccctgtctctactaaaaatacaaaaattagccaggcatggtggcatgcatctataatcccagctacttgggaggctgaggcaggagaatcacttgaaccttggaagtggaggttgcagtgagccaagatcatgccactgcactccagcctgggcaacagaacgagactccatctccaaaaaaataagaaattatttgatacaatatcaaatctattgatttgatgttgtaggcgtataaagatgttcatgtgtgttctagcatgtgaggaaggcgggaggaaatgtggaatgcccttcacgttgttcctgaatcattgcttctcgttttctggaggagtgtggtggtgtgttcgtaaaggaaaatgtaggggcattggaggtggatcaatccacccttaaatctttgttctcccatcttaccactttatgatttaaagcaaaggttactacctttttgagactcaggactttttaagacccttagtttgaccctagctctgtagaggtggaggtcttgagaatgtgcttagatgggtccgcagagaattcaccctgaaaaggaaggaactggaggacacaagcttggcacatgaccttgattagtcaccactaggacgcaagacttcaatgtgcctactccccaattttgccactaaattcatcccaaatcagtcaagagtgatggctataaaagcttggagaacattctccccagtggaagcctaatgaagagctataaaacctggtgaatagagcagcaaaaggtgttggcagtcgaggacaagtagaaaagagaaaagaactgctgttaaatgatgagggtttttagtgtgaacagctgttgagatgtctcagttggacacaagggcgggggcttggagggaagcttggcaccccacggtcattacctggtggtggtggtggggggatcaatttttaccaaaaataaaaatatatatttttaaaattttttttcttttctcgtactctggagcagctgttcttagccagtggagattttgccccccaggggacttttggaaatgtctggagtctttgattgtcatgaaggggaccagggttgctgtagtcatctagtgggcatctagagctgctaaacatcccacaatgcacagagcagccccacgagaaaatactcggctcaaaatgttagtagtgccgaggttgagaaatcctgctgtggcggccctccgtgccttaaatgaagagtaagcagccccggtacggactgttacactggtggcaataacagcgtaggagtcgcatggcttctcgcaggagagcaggaggctcaaatgtattttggatgtttcctctaagacgatgaattggcttgaatgtcttgtgtggtgctgtctcacccaaaccaggtgtatttcagaattgatttgaaaatgacttggagaccagttcacctattgcctcagcatgatggtaacatatagccaggacagagtccatgacagtaaaatggctttgatgaagtgactttgttcctgctcttcagctggggcttttggctcctcatttgatctccccagttagagtgcagactcagagtggccaagggctgcagatcctccctttcctgggcctccctccattcctcacaaagggcaggacctcaagaaagaaatgtttcatagaggaaagtcaccccctactttaatatacttcaacaggctgacaacctgaaaaaaaaattaggacaggaaggagaaaaccatctcagtgatgaatgttctaaaattagagtctacaatgcaggtattgtatttcttcagaatattaatataccctcactggaatatatcattgagatttcactggaaaattagaaagggcaagggaagagtttcagcctgaaggctattttgaatatcttaagtgattgaaataaacaaattaaaaaatgaatttgttatgttcggtactagatttatgacagggcagtacgtttgaggtcatttttactgtggcacatgaggaagcctcagaagatttctatgtcccaaagactgttcacaaaaatcttttccagattcttctagctgtatgggagcatagagaatggtgtttcctatcgaaagtgtttaagaggctgtcacttgctcaagatcatttagtcagtggctaagccagaactaaagccagcttcctggctgtgagaccatcaccctgtgctgctctgcatgccatttgtcatggtgtctgacattccacccttgacaggtagggagataaagagatgataggtatttggaatcaggcagatgtgaggatacagcacagttttgctcctccttttctgtggggcttacttaacttttctgattcttggttttctcatatgaaagtagagaaaataattattattagtggtttacttagctgtgtcatgaaaacgtctaggcctcgaaaagctccttactataatgcaattattacagtgactttttataacatagacgggtgttactcagattgtgattcacgaaacagttctcaagatgtgtttaagattttcaataattaatgtgtttcatggctaaataattgtaggagacaccagttaggtcaaggtaaacagaataggaattcttagagccttcaataggctaatgggtatgacttaataagagaatgtaataagaagcatttcacaaatatgtatgaccatagaactttttttaagtggaacatctgataatatcttgtgggatgctagtttccatgggacacagtttgggaattatggtaggttgattatattgatgtgtccactccttttttctgggctcagatacgtgacttattttggctgatcagcagttaactggcatgatgcaagcagagactgagaaagtccttgtgcattgaggcttgctgtcttgctgctctttataactacaaatcttaatcttccctggctccttcatcataactgttgtatcgaacccctgtagactccactggggatggtaccaggttcaagaggctgaagaagagacccagagccagggaatgagacatgagattttgctgggggcttacatacgggggagagagtccagtgttgacgggctggacagaattattgcatggcctagtggtggtgggctgggcaggagaatcacaactgcttgcaaaaaaacgtgtggcttttatagcattttcacttaacaccctttacctgacagcctccacttggcaactttcatgcaaccccaatctccatgtttcactggacagatagggagctcagatgttcctcatagacaaggaatgaatctccagattggccactcccaaatcccctagctcagaacacacattcaggtgcacctgccatatagggtcattctcagggtgtgcttaagttaatgctgtcggttggcatttaccatgtgctaaccatgagtatatgctagggttagcctcctggaagaatgagaaagatgtggggggagagtgggattgacaaagctgaggtcatttgaccttattgccccaagataaccactagccaaccaccatcagaaatgtgagtctcagctgagagccaactgacctagaaaacatataagtgagcccaactaggatcaggagaattttccaacttaaattacaaacttgtaggcctgtgagccaatcaatgatggttgttttaggccactcatttttgtgtggtcagttatgcagcattatgtgtagcaatgtaaagctgatacaggaattagaatggaaactgataggaaagtggaatgttcacactctggccccaactctttcttttattcccataggtaaaatacactctctccctcctcccaagatccttaaaggtctcatctaatcattccatcaggctcaaggtccaggatctcaaggtgttaaacaggtcctaatgcagttccttgggtacagttgctttgagttgaagatctatgagtgaaaaagataagaaatctgaccttcaaacctaatgcaatagggtaagaaaggacagaataagtatagtagacaatcttattcaaaaagggaaagaatggaaagctagtaagaggcactggctcatagcaatcctgaattccatccctgaaaatgctgccaggaccttctcttccagaggagggaatattcttgattaggcctcggttctgcctcgtggaagtgacttcccagtccattgttttctaaggctgtgttctgtaccatctgggttgtcttttctacccccttggctactcctgtgtgctttaaacaactttcttagcctgtttccagattgtggaaattagagacctagaggttttcttacattttgaatagtctcaatatcttttagtataaactggtgatccttttgtcaatatagtaccatcaaaacttttgtgagtttcttataaatctaatgggccaaaagcaacacctacaatagttttagagctagatctctctctagattcaaccatggttatttgggcaagttaagtactgtgagacagtgctcttaaaactcctagtagcacatttgttgagcttagaggatctgctgttttctgtcctgtttctttccagggtcttaatagacggtcttaaagcaagtatttgattagatccttgtctcaggctatattttactttaagactcttttgccagctgaagagacagatgaaaagcaattttcttttccaaccaagaagtcctagttcccctatggtctctctcaatttgcttaggcactggacagttatttttctagccctttcatttcttatagaatcttaccagtatgcagcagacactttcaacattatgcctggaaatgttattgctcaaatctcaagtttattaggcacattttctaccatctgaattgacacatgtagcagttttctcatttttttgttactgcataacccatgctgtcatctttccattctcttgtagcagtttcctcataatttttctagcctctgcccattttttttttgttatagcagccccctaattctagataacagtttcaatgttagttacttgttgccacaaataatgttgcatgacaagtcaccccaaaattcagtggcttaaacaatcatttatttagctcacaagtctgcagatcaactattgaggctgcattgttcttgtctctgacatattttcttgaggaatcaactgaccatcagcagatccagatggccttggctggggccacttggctaagctgcacatatgtgtcatggctagcccagtgagctagcccaatgcattctcattagcagtgtctgagtacaagagtatgcaaacctaaccatgcaagagggcaagcacaaatgcacagaggcttctccagcttctgcagccgtctcattggccaaagcagcataaatgatcaagtccagagctggaacaggacaagattacagtgttacagagcaagaggtatggatatagatagaccattaaatagtgccgttaataacctctgtatgccatagaaattatttctgtgtaaatataagaatttctgccaggtgtggcggctaacacctgtaatcccagcactttgggaggcggagcaggcaaatcacttgagttcaggagttagagaccagcctgcccaacgtggtgaaaccccatctctactaaaaatacaaaaattagctgggcgtggtggcaggtacctgtaatcccagctactggggaggctgaggcaggggaatctcttgaacctgagaggtggaggttgcagtgaacagagattgcaccactgcactccagcctgggcaacagagtgagaccctgtctcaaaaaaaaaaaaaaattcctgagttagaaccttgtgccagtgcctctctggaacagagttcactgatgtccttgtgggttaacggtgtcagtttattttccttttccggctctttcataaatttgtttgaagtattttcaatcctcctacatttcctgccagtatcatcttttcaaagtaaattccatatgtttattacctacagggttgagtgtcaccttctgttatttgtcctaagttagtcatcctactggggaaagtgaatagctgaaagaaatagagggaggagagggaagaacctgaggggtcaaaaatgattgccaaacccagaggtatctggaggtcagtgaagttgtgaatgtgtgtaaatgtggctacatatgtatatgtttgtaccagatgtgatgtttacatgagtgtgtatacaagaatttttattagtgtgggtatgtgtggatgtgtatacatctgtgtattagtgaatgtatatgtgtgtggtaatgagtattccttcccagttcattgaaaatcactatacgtgacctgattaatcaatgagccagttacataagtactcacagagcaaagccctatgggaaaagaaggaaatatgaaatacggagtcaaaaaggttgtaagaacaaagcaggagttgggggctcttacaccccagctttaacttccaagtttgagaaattctaaatggcattaaggaccatttaactccttctctccccacttccttcctccggtctgaacatggggagatatgggataaaaacaaccacgttgccttcccataaagtaatatgaaacaaaggagcacaagatggattttatccctttgattctcccaccaaagtgtcccatctttactggagatagaggacccgggagaagatatctagtcccttctctgtctcaagagtgggatgatgttctatttcctccgaaatactttatatttgagaaaacataccaggtatgtctttgccaagactctcttccaagaggcctggtttgagttaggagcttgcctgttattcactggtttcgtgagttctcagaatctctcagtgaagcgtcaggaatctggggttctttggaagtcctaattctagttccacacagtgcacaaagctcttaagacaggtgggagattttctgttatgttgtatgaaagcatttgttgttctagagaggaatcagaaagttgattccacttgatgtattagtggtgatctctgaggggaaacacctttcaattgggaggggacggtgaagtcatgagattgaaaacttttgcttgaagaattctgtaatcctagatgacctagtactacttagtcaatggataaaattacagaattactctataagggttagtattatcccatttcaggattaaacctcaaagagattaaatcatgtgcccatgatcactgaattgggatgattccagaagaatgctcttgggcacctcactctactgcctctatggccggtgatctatcccctccagagcaaatggctatgcacttcatttaccagtcccccatggtagagcagcaatacaaaaatgggttgactaggccggggcacggtggctcacgcctgtaatcccagcactttgggaggctgaggcgggtggatcacaaggtcaggagttcgagaccagcctagccgacatagtgaaaccctgtctctactaaaaatatgaaaattagccgggccttgtggtgggcgcctgtaatcctggctactagggaggctgaggcaggagaatcgcttacacctgggaggcagaggttgcagtgagctgaggttgcaccactgcactccagcctgggcaacagagtgagacttcatctcaaaaaaaaaaaaaaaaaaaggttgactataggttagcacagtctagatttcacactgtcccccgctgtccacagtctaattgcatacaaggctcagcctacaaaaccttgtcttagatacacattgaaccaaagttccctttatctcctcaaggaacagacagtgaggtgcaaaatcctaccctgttgttgctcagccttagacagtgagaattaatctaagaattaatagtacttcatattttaaacttgatttactatgattgcaagtcttaaaaatgatgcatgatatgttgattttgatataataatgtctgtttaataaaagacccacagtaggttttcatacattgtctccacctgaagataatgtttgacttcccagaccatacttgctattctatctcaagaaatactagagaaacaaatcctcacttatgcataaacatattcaaaggcaaaagatttctttattgatgagagcctcaaattgacccatttttagccttttctctgaaaagaaaaatgttttccaaaatgagattgctaccagatgtagtgaattacatagcagtttctcagatatgaaaagcagatgaaatggaatattctggtttctgattcagtcctattcttatctacacatagctcttcttaagtgaacttgacagtgttgtgggctgatattaagatggactactttagtaaacaagaaaaagggtttcactctgtgcaatagcaaatgagctttataatagaaatttctttgtgcaggagaagatattacaactttcaacacacactaaatatatttgctaggcaaaaaatgcatttcattacatgcagtgcacttgctattgtacgttaaccacttttttgccttgtattgaagacgtaatattttctactgtaaaatgtctgcaatttatttttatgcttctgtttttcccatgaagtaaatagccctgtactgataaatgtacgttatataaaaggtgaaatgtgcagagcaaacatctcagcttgtttgggtatctgtacggtttcgtgagcaggcaagagttaaaattttggaccacagtagctaattttattaatacaaacagtctgtaattactagatttactggagtcttttactttgacagtctcggcaactataatagatgtgtatgttctctaaaataatactattgcagctacaactataatttttcctgacaatgtctctgctggcttaaaaaaaccataattaatactttatttaatctttgcatactgtatacctagttgaccatcattcaaaatggcagtagcccagagcatagtttcttcacagctgaatgtatttgaccctaattactgcttattggaaatataccaaacaagtaaaaagggagctgtaacaaagaattgaggctttaattttgtctgtgatgagagaactttgatggtcactacttatttgtctgtaagagttgcggaagtctttgcaggttagagaattacaattatcttgctaatttcagtcttacacttgaacatgtttaatggactattgatggggattatgcttgttttatatttattttatcttgtatttagaagcgtatgattgactgtcagtggtcaggataggcataggctgatagggaaagggtttgttcccttttctgggaatgatgtagtttaagtactatttttgtagaaacaaatgccttcagtctgcctggctctatgttagggggtgctttatgcatgctgtcttatttagtcatcaccctatgacataggcattaacgttcccatattatagatctgggactagcacctcggtgtggttaagggatgtgccatggccacaaggtcagtgactgttgggccgggcttgactccagtgcagcctgagtgctcgcctacacagtaggagacatttccaaacatttgaagcctgggaatgaaagaaagtctgcttgcaaatagaggaggaaattgggaggtgatggaactagagggacggtgttttagtgatctaatatgtaaacacattcactatagcttgtttaaaatgctcattttcggtgcgctacacaggacagtttcttcagctacttatgacgggcttatttaatatgcgtgtgaaccttttaccatttcaatgaaaaataagtcaagctataagattcttagagatgtgatatctctattttctcagtttatgagaagaaactgagtattatgggaaaagaggtcttatgttttggagataaaccacctattattaagtccaataaataaacacagtagccatttcctgaaaagggctacaaccccccccaacacacaaaaccccaagaaccaacctcaaagtaaaatatccccgacccttaccaagaaaaaacaacttgttgtgaatcataatttgttgcatggacatttgtttagtctcattttctatacaattactaccaacatcttctatttttttcatttcatttttaccctcaatgaaaatgaactgtttattgagttaaaaataagcttccctacactttcaaatgttgtttttgatgtggtatttaaatattttccaacactgatcaatgactttttcttactgtaataggttaaaaatacctaagccagcaagaagagttcttatacaatggaatattcttctttttttttttaaccttttttttttttttttgaggcagggtgtcactctgtcacccaggttggggtgcagtggcgtaatctcggctcactgcaacctccacctcctgggttcaagcgattttcctgcctcaccctcccgagtagctgggattacagaaatgtgccaccacacctggctaatttttgcattttagtagactattaagtatttagtagagatggggtttcgtcatgttggccaggctggtctcgaactcctgacctcaagtgatccgcccaccttagcctcccaaaattctggattacagatgtgagccaccgtgcctggcctattattcagccttaaaaagaaatgaaattctgatacatgctacagtatggatgaaccttaaaggtgttatgctgagtgaaagaaaccagacacagaagggcaaatgctgttaagattcctcttacatgagatacctagaataggtgcattcatggagatgcagggaatagaagttaccagaggttagaagggtaagaggatgaggagttattgtatagtgagtacagaattttgttggggataatgtaaaagttttgggtataaatagtgatgattggttacataatattgtgaatgcatttaatgtcacagaattgtacacttatgactggctaaattgttaagtattttaccacaataaaaaagaaaaattaaaaaataagggttctgccaaggtattacaatgaagagacacaaagttctagcctctaatgctggacctaatacctgaatagattctgattcaacaacttcagaaagttcctgtgggcgttcttctttcattaacgttgataaatatttatttaaaagtaatgttatgtcatgtcagactctgagggactagagggatgagtaagggaggtctactgcctacaggagtggaaagacagccacattaaaaaatgattaaaatccagtaaatgggctgcaatagaaatgtaatgaatagtaggggaagcccaggagaagggctcctgagggaatcagggcctcgtagaacagttgataattgatctgggtttgaagtttgaataggaattgggttattttttattttcttatttcaataatatgcagtacattctcactcacatttcccaccttggaatcttggatctaagatatttgcagtcttttcaaatattttgtaatattttccccttgggtaagtataggcagattggtccctggaggtagaaaaacatcttgatcattctctgtcctactttctaaatatttgtaagcaaaaccactttgagaaataattcaaagtaaatgagatgtgttcagtccatcaaagagcttgtaatataatagggcaaggacagctgggtggcaagtgccttcagaaagtgtgggatggctgtgcagaggcaggaggagcgacttctgctggggcacgaaggcttatttcacatttaaggttgggtagaactgtgataactagatgtgaagaagattgtttcattcaaatagatgaacaaaagaagaaaagcaagaaaaaagatgaatccttttcagggaaacagtgaaaaagcaagttagagaggccctttggggccagatcacagggatctccaaaccttcaatattctgcttattctaaggagagaaaggcgtgaagagtcttcacccctctaccaatgtgaaaggatggtggagaataaaggagaataaaaagggatccaaaggcactggatggcattgggctcacaggtggatggaatgggtcgaactattaatagaagtatgaccagtgaaaaggagaatatgttttggagccagttagctttaggttcaaatcctgattcaaaagttactaactgcaaagttggacaaattacttaaaacttctgagcctcgttatccttgtgtgacaaatggggatgataatattatcttcatatagagttatcaggaggattaaagaggatggggtgacagatatacgtagtctccagaccactctcataggcacagatgttagttccttccccaggtgatctccaaagtcccatctaaacttgagagtctgtgaaataatttagaggatttaaaaaaatccaaagataaatgattcacataattgaagttaaaatatataaccaacatatttctagacaagtaacagaattcatttcaagtataaataaaaaatttacagccaaaacagatttttctagtgcagcagcttatctccagcaatgactctaatgtttttggaagctgaattaaccatttcactcccccaagttgccccgtagggctcatatccacgtgtttggaaatgatatcttcttgtcagatctaatatgaggtccctcagctttgtgtgagcacagagctcagagttgggggtttaccctgtgcaggatgtctttctgctaatgtgactgccagtaatacttgaaagtatcaatgcatgtttgaggatatccaccatgctttccattagaaatagcacaggctgtggtaccttcccctgtatccttactagacttcatgactttatagaactagccactttactgaattcttttttccttgttgtttttcacgtgaactgcttaggttttctattttacaatactagcatcatctgtaaatgatgtcttctcctttctgactgttgtgtctttatttgtgtctcttgatttggatataaatctgtcaggatgatggtggtagcaggcatggactgatggtaagggaaggtgtgtagggtttaatatgatatggacatatagtttgaatgccatagcacctgtcatatctttcttgttaccagaatcacatcatatagaaatttttgggaaaatgcctttttcttttttcttttctttctttcttttttttttttttttaagacggagtcttggctctgtcacccaggctggagtgcagtggcgcaatctcagttcactgcaacctccacctcctggattcaagtgattctcctgccctagtagctgggactacaggtgcctgccaccacgcccagctactttttttttttttttgtatttttaatagagatggggtttcaccatgctggccaggctggtctcgaactcctgacctcaagtgatctgcccgcctcgacctcccaaagtgctgggattacaggcatgagccaccgcgctgggccgaaaatgtctttttcacactgaactctgagcacattaaggagagggtcttttcttacttacctttatattcatagtgttagccctgagcctgaacaaaacacttgtgtagatatttatgggaggtatgagtaaatatcttaatttattagagatcagtaaaggtacttatcaataaaggtatcaataaaggacaaaaagtccaataagaaattatgaatatcttttcataatatcagagaacattaactgtttagctgtcttcctaaaaaatgtttcaattacaattaaggatgcttgtcttttttgtgattcttatgtaggatagcaggaaggggacaaaattttaagtcatatcccatttgttattaaaataaagaggggaagcccaaattctatctaaattgttggtccaagtgtggatcccttaatttcctttctaatgtgttttccagtaaacatacagatacataaatgcaagagttaataagattaatgggctactttgtatctgcccaggaggacacaaaacaaggtaaaatttattatttgtggatgctatgtcatactatttttaaaaatctactctaacactgtatattaatgctgtataatctcctttcttggtaatttccactccacaatttttatatattcctatttgaaataatgttttatctcttaatgtcactcatttattttatcatttttaaacaataggatatgagatgggactgaataatgagaaaaagatttcttaagggagaaataaaatatatcaaagaataatttgtaaaaccaatatggtagaagtcatatttattgaaaaaaattaatatctttgctataaaatttgtaacaggaatatttactgaatgtttattttgatgcataaacctgaatgttacataccaagtacaagacaataacactagtttttcctttatttacactttatgaaaactgttatgcagtccatgttaaaagaacttatgatggagaattgttacattagaaaaataatattcttgataaagcattctcaatgtgtccaatcatattttctgcctcttcaataaggcaaaagtccctggaacagcatataacttaatttacaaaatacaataactgtttagacacatattcaagttttcttttggtatgcttttccctcactgtaaaactttttcttttttctttttttctttttctttttctttttttttttttttttttttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatatt

SEQ ID NO: 353 - DNA, 359270 bp, Homo sapiens
atttaatagcagcacaaactcttcacttttgtttggggaatattattgcttgcaggtctcacacatagcactgaatcttacaggtaaggagctggtgctaccctgttctcctttgttctcctgacccctgagaattctgggaaagtggttcacaagagagacttgaggttggattcacctgactgtaaaagtgctgacaatgggtgttcccactgttcctgtgacagagagcccaggcttcagctgctgaagaagaactcagacctaaccctccagggcgggacctttaatttggcacagagttggtccttagccaaataaaaattgaaaaggggagattttaaattttcatctaattaagactttatataatggatctttttcttattgtggcaacaagaggagagattgcattcttgggcttttattgttggaacttaataatactggctattctactgctcttgtggaattgtttggtctatgctggtacatggtacttgctatgaaacactgtctggtgagctggataggcaagtagctaaagaaaacgtcataagaaacagaaataggagttgagtccaatctctctcctgcactgcaagattctgttgcagtggtacctacacctattgccatagcaccccccaaattttctttaaagctaagaaaatagaaatagaggatggattctcaaatagatatacctagagttagttaagtaaagtctgattttgattctttcagaggtttggatgtcttagttatctcaggctgctgtaacaaaataccatctactgggtggcttaaacatttatttctcacagttctggaggctgagatgtccaagatcaaggtgccagcaggtttggttcttggtgtgagtcctcttcctagcttctagatagtgattttttttttttttgtacagtatttaccctggcaataataatcttatttttccatttggttagtttttcatgtatttattacttaatactagccaatttctccccagctctgtaaatctcccctcaacacatagaaacacaaaatcattttgattggtttgcctgcttgtatgtttgttcaagaaatttttcctggcccagcgtggtggctcatgtctgtaatcccagcactttgggaggcccaggcaggtggatcacctgaggtcaggagttcaagaacagcctggccagcgtggtgaaaccccgtctttactaaaaatacaaaaattagtcgggcatggtggggggcgcctgtaatcccagctactcgggaagctgagggcaggagaatcacttgaactgggcaggcggaggttgcagtgagccaagattgcaccactgcattccagcctgggcaaaagagcgagactccttctcaaaaaaaaaaaaaaaaaaagaaagaaagaaaaatttttcctggcacatttctatctgttccgttctggatgacttgctcttcaggcttatcccacagctgttatcataatatctctctttactgcaccatcttgggatttccatcgcctctctcttttgttagatcccctgcttcatggatctcaagggggttcattcttcactcacttcttccttttgatgatgcatatcctccaaaacctcctataaagtggttaccttagaaataaactttttgagacactgcatgtctgaaaatgtctattatacccatacacttaattgatattttactagatagagatacatagagataggttgaaataatttctctcaaatttttaaaagcactgcttttttttttttttttttttgaaacagagtctcgcctcgctccgtcgcccaggctggagtgcggcggcgggatctcggctcactgcaacctccacctgccgggttcaagcgattctcctgcctcagcctccccagtagctgggattacaggcacccgccaccacgcccggctaattttttaatttttagtagagatggggtttcgccatgttagccaagctggttttgagaggagagcactcctcatattgtcttatacttaatttcttgtttgctgaaaaagtggaggttgaaagaatgggcagaagtgaaaatcgtggtcagacaaccgggcgccacatttcgggccttgttgttaaaattcaacccctgacctcaccacttgcgctgtctataaattccagacattgtataaaaacgcattatgaaactcccttttctgttctgtttcgttctgattaccggtgcatgcagcccccagtcacgtacccctcgcttgctcaatcgatcatgacctctccctccacccacagcccctttagagttgtgagcctttaaaagggacaggaattacttattcggggagctccgtttctaggacgtgagtcggccgacgctcccaactgaataaagctcttaccttccacaatccggtgtctgagggattttgtctacgacctctcctgctacagtttcaaactcctgacctcaagtgatccgcctccctcggctttgcaaagtgctgggattacaggcgtgaaccaccgcgcccggcccttgttgtttactgtttccctatagtctttttttttttttttttttttttttgagacggagtctcgctctgttgcccaggctggagtgcagtggcacaatctcggttcactgcaacctctgcctcctaggttcaagcgattcttctgccttagcctcccaagtagctgggactacaggcatacaccactatggccagctaatttttgtatttttagtagagacggggtttcaccatattggccaggctggtctcgaactcctgacctcgtgatccgcccgcctcgggctccgaaagtgcagggattacaggagtgagccactgcgcccggcctactgttttccatagtcgtttctgagaaagaaaaagtaacccttttctgctctcagctagagctggtctgataaacacctaggccatgatgttctccggttcaaactaaaaatttcacaacaccaatatcagacaaagctaccctctcaccaagatgaaagaaagactatttcacaatcatatttgagcacaaacagaacactgttcaaaccataatatgatcaaacattcccctttcccagctactaatagtgactgttaattcttttattttttatttttttgagacggagtcttgctctgtcgccaggctggagtgcagtggcgtgatctcggctcactgcagcctctgcctcccgggttcaagcgattctcctgtctcaacctccggagtagctgggactacaggcgcccaccaccacactcagctaatttttgtatttttagtagagacggggtttcaccatattggccaggctggtctcgaactcctgaccttgtgatctgcccgccttggcctctcaaagtgttgggattacaggcgtgagccactgcacctggccttattttttattttattttatttttttgagacagtctctgtcacccaggctggagtgcagggacgtcatctcagctcactgcaacctctgcctcctgggttcaagcgattctcctccctcagcctcttaagtagctgggattacaggcatgcccaaccatgctcggctaacttttgtattgactgttgattctttaccaattatgtgtttagttctgcaaccattcctcccactttctagataaaaatatcgagattcccaggggaagaattgtcccacaatttccccatagtgtttgctgtctcctctgttgcaatgagccaatatactcagatttgactataggtttgttcctgatggttatagactggagcgcctcaacaccgtagagaagatggatgccgttctgattctttgttatttgccttaaactgttctcccagctcccctcccaaaagcttatagaatcttctacctgttcctactattctgaaacttcatgatctattttcatccaccatgctgggtacacagtgtgctctttcaatataggaatgtatattttggaggtatcattccaaagatgtttatgcatatacagttaaaggtatatatttatttcctgcaactaccatcacccttttgatatacttttgctgcataataaaccatcccaagcttattgacttagaataacaataagttattattttgtgaaggcaccaacatttgcccaaagcaagtcacatagccaatcccagattcaaacagaggagaaatagactctcttgatgagagaagctggaaaatataaccaacatttttttctttttctttttttttgagacggagtttcgctcttattgcccaggctggagtgcaatggtgcaatctcagctcaccgcaacctccgcctcccaggttcaagctattctcctgcctgagcttccctagtagctaggattacaggcatgtgccaccacgcctggctaattttgtatttttagtagagacagggtttctccatgttggtcaggctggtctcgaactcctgacctcagtgatccgcctgcctcggcctcacaaagtgctgggattacaggcgtgagccaccgcgcccggccatgacacaaagtttaaaagaaaaatttttaaaaattttttttggtcaggcgtgatggctcacacctataatcccaggactttgggaggccaaagtgggtggatcacgagtttgagaacagcctggccaatatggtaaaaccccatctctactaaaaatacaaaaaaattagtcgggggtggtggtgcgcacatgtggtcccaactactggagagactgaggtgggagaatcacttgaatctgggaggcgaaggttgtagggagccaagattgtgccactgcactccagcctgggcgacagagattcagtctccaagaaaaaaagtttttttacttttatagatattgtcataaggcaccctgtagaacttgtaccaacttatcctccattcacaaggtatattaaccttcccgccgggcgcggtggctgaagcctgtaatcccagcactttgggaggccaaggcgagcggatcacaaggtcagaagatcgagactatcctgactaacacactgaaaccccgtctctactgacaatacaaaaattagcagggcgtggtggcgggcgcctgtagtcccagctactcgggaggctgaggaaggaaaatggcgtgaaccctggaggcggagcttgcagtgagccgagatctgccactacactccagcctgggcgaaaatgcgagactctgtctcaaaaaaaaaaaaaaaaaaaaaaaaaccctctccaacataaactttaggaaaatttaccattagtttgggcacagtggctcaggcctgtaatcccaacactttgggaggctgaggtgggcatatcgcttgagtccaggagtttgggaccaccctaggcaatacagtgagccctcatctctacaaaaagttaaaaaatcagccaagcatgatggcaagcgcctgtagacccagctacttgggaggctaaggtaggaggatcagctgagcctgagggaggtggaggttgcagtgagccaagatcatgatactgccctccatcttgggtgacagagcgagatactgtctctaaaaaaaaaaagaaagaattccttggatatttctccttggtattttccttttgaactttataatcatattgtctagtttgaataaaaaagaaaaaattctttggacagttttatgaaaatcatgttaaattcagacaccaagtaaaggagaggtgctgtctttatgatgttgagtctcctatccaagaatatgatacaccctcggttaatagggaaggaggctgccctaatgcagtggttcccaaacttgaacattccaaactccctagagagcttgttaagtaacagattgttggggccaccctcggggtttctgattccataggtctaaggtggcactcaatagtttgcgtttatctcaagtttccaggtgatactgaagatgattgtcctgggaccacactttgagaataactggtcattttggagatggttggtggactatatgtaagtgagactaaagcatatttacactcttaaaaaataaaaagtactggtaaatgatccttagggaaaggaggtggaagatctgtaggaggagttgaaaaggaatgttcaggccgggagcggtggctcatgcctgtaatcccagcactttaggaggccaaggcgggcagatcacctgagttcaggggttcgagaccagcctggccaacatggtgaaaccctgtctctactaaaaatacaaaaattagctgggcttgatggcggtcgcctgtaatccccagctactcgggaggctgaggagggagaatcgcttgaacccgggaggcggaggttgcagtgagccgagatcggggcactgcactccagcctgggtgacagagcgagactctgtctcaaaaaaaaaaaaaaaaaaaaaaagaatgtctcttgaatggtgccaatcttggcttccacccacctggcaaaccaacttaacctacgccagcaaaagcaacagttaaagctaatttagcaggaacaaatgtaaggcaaacaactccaggctttcgggaacagaaaaaagttctccggtggatcaataactaattcaaagtagtggacccagcactctggagtggcagcctatattcatcaaataagactgcaactgttaactccctactcgctgccctacccgttcgtctttgctcctccttttctttgctcttccgcttctctcctccgcctcctcaacttcttttctagagccctctcctctttttcctgaccttcctaaaatggttgtattttacagccctttgcggctgatgaaggcttcaaaacctaaaaagcaaacagatgctccctaacacctagctgagaatattttaactcactacaaaggcctttcaaaaccccattcaaaatttcccaccaacaagaagagaaccagtatttccctctggagccgtcctaaggctgttctccctggagcagtgtcggagcgattttggactcttctcagagctgctcagcttgtctgccttcgcccagttgagaagcccatcgtggattcgaagtatgtggtcactacagacactagaatccccagattcctcttttcttttttttttcttttttttgagaccgagtgcaatggcgtgatctcggctcaccgcaacctccgtcttccaggttcaagcaattctcctgcctcagcctcccgagtagctgagattacaggcatgcacctccacgcccggctaattttgtatttttagtagagaaggggtttctccgtgttgaggctggtctcgaactcctgacctcaggtgatccgcccacctcggcctcccaaagtactgggattacaggcgtgagccaccgcgcccggcccagattcctcttttcttgatgaatttggggtgaatggagatgatttctggaatcagttaccataaaaggacagtagccgctgtggcgatttagaagttcatgtttccatggtagctaagcgagagggttaaataaaaacacagcgcccaacgtggggctcgaacccacgaccctgagattaagagtctcatgctctaccgactgagctagccgggcactgattactggcgtcttcttatgtggaatcattttccactgacggagcggttgtatgatctaattgcatattattgcgtgtgaaagaagtttcaggacctaggactggtggacacggcagtagccttttcataatagctttttgccatgaaggaattcggggtttagagagcgatgggggctgcagagagccaggaagtctcgcggaggactcgggaatcacgagtcctgcctgaaaccttagtgttttccgcacattccttccactgagggaacctcctcacccacttcagaggagggtgcgaaagagcccaaggaaactcagatgagaggcgcaaagacctctctgcaaagcattttaattctccatcctggaagaggcactgagttccagagtcacaagggaagggttctctcctctgctcaagtgaaggccaaaagaacaaccgtggtcccagctccgtgggcctccatatcgctctaaagcttcccgcctgggctgcttagcaccttggtgggcgagccgcagtgtgagccaactggaactattgttgtttgagacagggtcccgctctgtcgcccaggctggagtgcagtggcgcgatcatagttcattgcagcctctacttcccgggctcaagcgatgctcccacttcaccctccctaagtagctgggaccaaaagcgcccgccaccatcttaaaaattctttttctggccgggggcgatggctcaagcctgtaatcccagcactttgggaggccgaggcgggtggatcacgaggtcaggggttcgagaccagcctgaccaacatagtgaaacctcgtctctactaaagatacaaaaattagctgggcgtggtggcgggcgcctgtaatcccagctactcaggaggctgaggcaggagaattgcttgaacccgggaggcgggggttgcagtgagccgagatcgcgccactgcactccagcctgggcgacagagcaagactctgtctcaaaaaaaaaaaaaaaaaaaaaaattctgacattgtggggaggcgtctcaagctggtcgcgaactcctgggctccagggattctcccgcctccgagacttcccaaagctgctgggattacgtaatggcgcgagccaccacgtcggcctggagctattgttattcaccgaatctgtggactgcacttccgcggggatgccttaagcgaaggcagaattacaagcatgtgtcactcttttaaaagtgttaattaaaaaaaaaaaaaaccgccaccccagcaagttagaaccacctgccgtgactcggattcgaaccgaggttgctgcggccacaacgcagagtactaaccactatacgatcacggcgagccactaaccaggcggcgcgctacagctggatttaatgcctcttgaaataggaatggctatttcgtgctacttttatttggccagtccctgacgtccgcatcaatcaattccaaactttttcactctgcaaccttgaagctccgacacctgaatcagtttcttagactctaaatccctcgatgccagcgatagcaccacccgctccgctgggcggcggcgggccaaggtcctgactagagggcagaaagcgtcagctgcaacccgggaccacgccgcctctcgcctctctcctctcacctctctgcctccatttccctcttccccctccaaggaatcaagctgcttcgcccagggatgagaggggcagcctcgaaggatttttcaaattacatctgcagcctgtaccacggaattgaggtttctcttcccagaatggtggaaccggaagaaaaacggagctagtgagctggggaggggatgagagccccgtcttaatttcttgcttccctcacaggtacaagaagcgctgtgtactctctggcattgtgggagcttgtgctgacttcctcatcttgactcataaatatatcagagccacctctgccgattcagaaaaacaaatccaaccagcctctatttcagacacttccttagacccctaggagagttattgttaacttccctagacccctaggagagttattgtttggacgccagcggccgaacccatcagacgggctaggcgcgcacgtgcagttaccaaaatacagatgtttactgtgggagggacagaccatactggtgcagacctaggacacaaaagtggtcaaaactcttttcctgtgttccctactttgctcggtttccaggcctactcagtctaaaaagctgaagagaaaaactgacactgcgttggccgggaatcgaacccgggtcaactgcttggaaggcagctatgctcaccactataccaccaacgcatctgaaatacacttgattcctttagagtatcagaactaaataatcaggtttgtcttcccgtttatttctaggctaagcaatttagactgcaggaaaaacctacaagaggaaaattaaaaggaagctctctggaatttctcctattaaaaattctgtagtagtatcttgtttcacagctttaagaaaagtcaattctagtttcctggacatttattccacacatgcgcaaaattacatatgtacaagaccgtatatgacagcatttttttttccaaagagcaaagggctagaaataacctaagtgtctataataggaagctggctaaactaattatggaaaatccatacaacggaatgctatgtgccagaagaaagaatgaggaagttcttcatgtctaatctgtaagtacttccaaaatatactgttaaatggaaaaggcaaagtgcagaaagtgtgtatagattacttccatttgtacaagggggagagaatgtttaaatatatatacgtatgtatatatgcatgtacttgcatttgcataaaacatctctaacatcatgaagaaacttaacagcggttacttcattagagagaaaataaatggtagaggtgaaaggtttatcagttctgcccttttgtatatttgaatcctaaaccatgtaaatatattaccttttcgaaaatccagtaattaaattgaaagaaaatacgttactgaaggatatttatttccactgcaaagtgttagaaatacattgttaaccttaaaaatagctggtgttggccgagcatggtagctcacgcctataatcccgtcactttggtaaggcagaggcgggtggatcacctgaggtcaggagttcgagaccggcctcaccaatatggtgaaccccgtctctactacaaatacaaaattagccgggcgtggtagcgcaggcctgtaatcccagctacttgggaggctgaggcaggagaatcgcttgaacccgggaggcggaggttgcagtgagccgagatcgcgccactgcactccagcctggggcaacgacagcgaaactccgtctcaacaacaacaaaaacagctggtgataaaatagtattatagcatacttccactttgtttcaaaacctagatattgagtggtcttcgggtgatagaatggtgagcgatttctttatttgtgtttttctacattttctgtatttcagttttcagtgggatggggaagattgactagcagataacgtttatttaaaagatcctgagagaaagcagtaaaagaagatgttactctttccctgaccgggaatcgaacccgggccgcggcggtgagagcgccgaatcctaaccactagaccaccagggaagctgctaacccttcccggttgcagctatatgattctactaagtgctgcggttcgtgcctgtaactgctaaacactgaagccaaagtggccagattgctggagctcctagttcgagaccagcctgggcaaagtggcaaacccgggctctatcaaaagcacaaaaaaattagccgggcgtggtggcgcttgcctgtagtcccatctacccgagaggccggatcgcttgagcctggtaggcggaggttgcagcgagccgtgatcgtgccactgcactccaacttgatgacagggccagagccttcctcaaaaaaaaaaaaaaattacattattctaactaaaagtttatttccacttattctttttcatattatttttcactgcctagattctgagattcttgcatactgggcctttcctatgttggggcttcttcccggtacttctttcctgcagtagaaaacattgtgaaagaattctccagcccggctctcagagcctagggagcatcgtgtacacgtgattacagtccccaagaccagagaccaatgtccggagagaagagggtgagacagagaggaagctcacctccttgtagttgcagtgatttccgaaattgtgaacattagaaaagtagagacccagctacgtctttgccaaaaacaaccaggaacttttccttaaggaacataaaagacgtcatgcgagtaacactaggagatcctgggcccactgtaccttttttcatgtcgtgtgaattgtaggccaaactgttaaaacaaatattacagacgagtgaaaatcactcagcctagaggtacttggtgctcagcaggatctgagctcaactcactagtgggagactaagagaaactcagggcctttaacctttaaaaattacgaggtcccgggcgcggtggctaatgcctgtaatcccagcactttgcgaggccgaggcgggtggatcacgaggtcaagagatcgagatcattctggccaacatagtgaaaccccgtctctactaaaaatacaaaaagtagccggcgtggtggcgggcgcctgtagtcccagctactcgggaggctgaggcaggagaatcgtttgaacccgggaggcggaggttgcagtgagcggagattgcgccattgcactccagcctgggcatcaagagtgaaactttgtctcaaaaaaaaaaaaaaaaaaaaaaaataaattatgaggaagccgggcgcagtggctcagacgcctgtaatcccaggactttgggaggctgaggcgggtggattacctgaggtcagaagttcgagaccaacctggccaacatggtgaaatcctgtctctactaaaaatacaaaattagccaggcgtggtggcgcttgcctgtaatcccaggactttgggaggctgaggcgggtggattacctgaggtcagaagttcgagaccaacctggccaacatggtgaaatcctgtctctactaaaaatacaaaattagccaggcgtggtggcgcttgcctgtaatcccagctactcgggaggctaaggcaggagactcgctttaacccaggagacggaggttgcagtgagccgagatcacgccattgcaccccagcctgggcaacaagagcaacacaaaataaaaattgcgaggaaggaaaagagggagtgaagagaaagaaaactggggtgcatgcattaatgtgttgcaagctaactttatgagcgagaaaagaaagcaaatgcgggctggatacagtggctcaagcttgtaatcccagcactttgggaggctgaggcaggtggattgctttgagcttaggagtttgaaaccagtccaggcagcagggtgaaatcctgtctgtaccaaaaattacaaaaaaaaaaaaagaaaaagaaagaaagaaatcttagtgaattgtgtttgccatattgtactttcagcttttctgtaagcttgaagttttaaaaaataaaaggttaagaaaaaaatgaaacaatcaaaagcctccccttctggtcttttttggtcagatgaccccaagtgatgaattctgtgcccatgagttcaagcagaaatttttaaaagcaaccccactccccaaacacactcttacatcagaaaatatttttgataatgaatttaaaaactgaaagattgaatcatcaatggtgtctgtatatcagcaaggcctgacagaaaaaaaaaatggatggtgagatacagagtttggggggattatcatagttgttgttttgagacacggtcccactttgttgcccagactgtagtgcagtgctgagctcctacctcagcctcctgagtagctgggactacaggttccggccaccacactcagctaattttgtgtctgtggtagcagagatactaggcctcaccatattgcccaggttggtcttaaactcttgggctcaagccatcctcccacctcggcctcccaaagtgctgggattacaggcataagccacgaagcctggtcttgtttggcttccaaagtatcaatgttaaaacgttgttcaagaaacgttgtttaaatcttccactcatccagtctccacttttctatgggtttaaatgccataaaataggaagacgagtaactaaatgttagacatttattttcacaaagacaacaagaatcctgttgtcatgtcaccaaggagcctaacagagcccacttccttttactccagctgttttcactggaccaaggctgaaaaacaaaaagcatctaaccttcagaacaacatctcaggatcttacccagagtggggacaaggcagcagaatttatttttctatgttgcagaggaaatcagcctcctgttttggtcaacagtactttttcatcaattattctgccacctgctggtaattttttgttaaggacagaccgaggaaggacagacagtatgagctatgggagctagccacttgtctcaacatcaaagtaccagaaggaatctggtcaaagcaccaagacaggattaagcctcctcttcttgccggtaatgcatacctaaagtggatgagggaggagtgtggctcatttgcttcactctgagttctattttccttttttttttttttttttttgagacagagtcttgctctgtcgcccaggctggactgcagtggcatgatctcagctcactgcaacctccacccctgggttaaagcgattctcctgcctcagccccctgagtagctgggactacagatgcccatcaccatgcccagctaatttttgtatttttagtagagacgggatttcaccatattggccaggctggtcttgcactcctgacctcaggtgatctgccagcctcagcctcccaaagtgctgggattacaggcatgagccaccgcacctggcctattttcctttttaaaaacatttacagatcatgtgccagacgaggtattgaaaatctaaaaatacacctaagctgggtgttgtggctcatgcctgtaatcccagctacttgagaggctgaggcacaagaattgcttgaaccccggaggtggaggatagggtgagctgagatcatgccactgcactctaggctggtgatagtgcgagactctgtctccaaacaacagcaaaacacttaaagagctgaaaatctagtgtaaaaccaaataaacaagtgaataaaagagaatggatcagggaggattgagtagatgtgatcttccctcgtcctcctccctggacattatatataagacaaccctaagaagactgaaatgtggagagaaggaggtagaccagctaggagccccagaaacaaaggcaggacacaatgctgatttctgtggactttctttttgcctcatatatgccatacttggagctaaagaaaccagcaacctggaaatcccaataggagcagcctaaaaattccctaacaaaagcctgttctctctagccaaaggatcaggaatgaggcagtctagcaaaacagaaaacttttagacaataattgcactattccagccaaatgccacagaaacaaactgtggcttgtcctctcctattctggcaaagactgaatggggtgcctagacttccaccaccagcaagtctattaggaatcatccctctctttcctgttggggtggtagcagaagaaacttaatagagagtcaggactttcacccaaactcagtgagtggtaatgaggctaccccctaaggaaagaatcagtgaactgaaagaacagtagaaattactcaatctgggtcaggcgcaatggctcacgcctgtaatcccagcactttgggacaccaaagcaggcagatcacttgaggccaggagttcaagaccaggctaaccaacatggcaaaaccctatctctactaaaaatgcaaaaacaattagctgggtgtagtggcacacacctataatcccagctacttgggaggctgaggcttgaacctgggaggcagaggttgtagagagcgaagatcgtgccagtgcactccagcctgtgcaacacagtgagaccctgtttcaaaaaaaaaaaaaaaaacaactcaatctgaaaaacaaacaaaatagactgggggaaaaatgagcagagagcctcagggacttgtgagattataacaaaagatttaggccaggcacggtagctcacgcctgtaatcctagcactttgggaggccaaggcgggcagatcaccaggtcaagagatcaagacaatcctggccaacacggtgaaaccccatctctactaaaaatacaaaaaattagctgggcgtgtgcctgtagtcccagtttctggggaggctgaggcaggagaatcgctttgaacccgggaggcggatgttgcagtgagccaagatcgtgccactgcactccagcctggcaacagagcgagactctctctcaaaaaaaaaaaaaaaaaaaaaagatttaacatttgcgacagcaaatttcctggaaggagaagaggaagagaacacgacaaaaaaagtaccaaaggatttggtacagggataaacctacagattcaagaagctgaatgaactcctaacaggataaacccagactacttcaggccaagacacattgcaatagtttggatgtttgtcccctccaaaacttatgttgaaatgtgatccccaatattggaggtggggccaaatgggaggtgtttgggtcatcagggtggatccctcatgaatagattaatgtcctccctcaccagcaaatatgttctcactcttagttcctgcaagggctggttgttaaaaagagcatgtcacctaacctcttttctttcctcttctcttgccattgatctctgcccaaaccaacttctcttcaccttccactatggttgggagcaatctgaggcccttgccaaatatagatgcccaattttgaactttccagccatcagaatcgtgacccaaataaaccatttttctttataattacccagccctcaggtattcctttatagcaacactaaatgaactaagacacacatcatagtcaaactgctgaaggctaaagacaaacaaaaaatattgaatgcagtgaggggaaagcaatttgaataaaagcagatttctctctctttttctttttacttattttgttttgttgggttttctcccatgttcaaccaagttagaaagccattttctcatcagaagccatggaggccagagggaagtggcacaaaattgttcaagtgctgcggaaaaagactgtcaactcagattgctatatccagtgaaaacatcctttaaaaatgaagggggtatgattcaacaacaaaaagacaaataacccactgaaaaaataaatatgtgaaaaaatgctcaatgtcaactgggtgcggtggctcacgcctgtaatcccagcactttgggaggccaaggtgggcagatcacctgaggtcaggagttcaagaccagcctagccaacgtggtgaaactatactaaaaatacaaaaattagccgggtgtagtggcacacacctgtagtcccagctactcaggacgctgaggtaggagaattgtttgaacccgggaggcggaggctgcaatgagccaagattgtgccactgcactccagcttgggggacagagtgagactcagtctcaaaaaaaaaaaaaaatgttcaatgtcattagtcattagggaaatgcaaataaaatcacaataagataacacttcaccaccagaatggctataattttttaaaatggaaaataacaagtgttaggatagggagaaatttgaatcctcttgtattgctggtgggaatgtaaaatggcacacctgctgtgaaaaacagtttggcagttcctcaataagctaaacatacaactaaatatagaatatgattcagtaatttcactcctaggtatataccccaaagaactgaaaacaagcacttaaaaaaatacttgtacatgcatgtggatagcagcactatttataacagtcaaaaagtggaaacaatccaaattccattaatagatgaatggctaaataaactgtggtatataaatacaatggcatattattcaggcataagaaggaatgaagtattgatacatactacaacttgtataagcctcaaaacattatgctcaagaagccagacacgccgggcatggtggctcacacctgtaatcccagcactttgggaggctgatacaggtggatcacgaggtcaggagatcaagcccatcctggccaacatggtgaaaccccatctctactaaaaatacaaaaaaaaaaaaattagctgggcatggtggtgtgtgcctgtagtcccagctactcgagaggctgaggcaggagaatcgcttgaacctgggaagtggaggttgcagtgagcagagattgcgccactgcactccagcctggccacagagcaagactctgtctcaaaaaaaaaaaaaaaagccggacacaaaaggtcacatagtgtattattccatttatatgaaagtcaagaacaggtattaataaatctagagagacagaaagcagactggtgatggccagaggctgaggactgactggctaataggtacaggatttcctttcagggtgatgaaaatgttatggaactagatagtggtgatgttttgatggttgcacaacattttcttttcttttttctttttctttttttttttttttttgagatggagtctcgctcttgtcacccagcctggagtgcagtggcacgatctcagctcactgcaacctccgcctcctgggttcaagtgattctcctgcctcagcctcccgaatagctgggattacaggcacatgccaccacacccgactaatttttcttatttttagtagagatgaggttttgtcatgttggccaggctggtcttgaactcctgacctcaggtgatccgcctgcctcagcctcccaatatgctgggattacagtcatgagccaccgcgcccggccgacaaaattttcaatgtactaagcgccactgcattgtatacattaaaatagttaaaattgtgaactttatgttgtgtgtattttactacaacaaaaaaataatgaagggggccaggtgcagtggctcatatctgtaatcttagcactttgggaggccgaggcaggcggccgggaggtggaggttgcagtgagctgagatcatgctactgcactctagcctgggcaacattgagcattgagtgagtgagactccatctaaaaaaaaaagaagaagaaaggaaaatcctagcaggattttctacagatacagacaagattattactattactattattattattatttccttcgagatgaggtttcactctgtcacccaggtggagtgcagtggcgggatctcagctcaccacaatctccacctcccaggctcaagcgatcctcccacctcagtctccagagtagctgggaccacaggcgcatgccaccacatccagctaatttttttgtatttttggtagagacaaggtttcaccatgttggccaggctggtcttgaactccggagctcaggcgatccacccacctcggcctcccaaagtgctggaattacagcatgagccaccaccttgttttaaaaatctgtaactttaagacaagagaccgggcgcggtggctcacgcctgtaatcccagcactttgggaggccgaggcgggcggatcacgaggtcaggagatcgagaccatcctggctaacacagtgaaaccctgtctctactaaaaatacaaaaaatcagccgggcgtggtggcgggcgcctgtagtcccaggtactcggaaggctgaggcaggagaatggcgtgaacccgggaggcggagattgcagtgagccgagatcacgccactgcactccagcctgggcgacagagcgagactgcgtctcaaaaaaaaaagacaagattattctaaaagttatatcaaaggcaaagaagcggacatagctaaaacaatttttaaaaataattaaatgaggttgggcgcggtggctgacacctgtaatcccagcactttgggaggccgaggcgggcagatcacttgaggtcaggagttggagaccagcctggccaaaatggcgaaaccccgtctctactaaaaatacaaaaattagccaggcgtggtggtgtgtgcctgtaatcccagctattcggcaggctgaggcaggagaatcacttgagcccaaggcagggaggttgcagtgagctgagatcatgccactacactccagcctgggcaacagagggagactgtctcaaaaaaaaagaaagaaagaaagaaagaaggaaagaaagaaagaaggaaggaaagaaggaaggaagggagggagggaggaaggaaggaaagaaagaaagaaagaaagagaaaaagaaagaaagaaaagaaaaaagaagagaaaaagaattacatgaattaaagactgtgtggtattggcagagggataaatatacagatcagtgaaacaatatagaaaacccagtagtagacccacacaaatatacccaactgatttttttttcttttttttccaatgagaaaatgctaaaacaagcaaaacttcatgaagggacatctcatcaaagacgatatacagatggcaaataagctcataaaaatattttctacatcattagccataagggaaatacaaattaaaacccaaattagatatcattacacacctatcagaatggctaaaaaattgttgacgacatcagccaagtgcagtggctcacacctataatcccaacactttggaagtctgagggggcagatcacttgaggtcaggagtttgagaccagcctggccaacatggtaaaaccccaccactactaaaaatacaaacaatagcctggcatggtggtgcacacctgtggtcccaactacttgggaggctgaggtgggaggatcccttgagcccaggaggtggaggttgcagtgagctgagatcacaccactgcactccagcctgggtgacagagtaagattctgtctcaaaaaaaaaagaatctttgttggtaaattccttcaggttttggtgtgtttgaaaatgttttacttatttttaattctggaataatattttagctgagtatggaagtctaggttggcagttactatctcttggcttatcagagccacaccacaactgtattctcaacaaaagagagatgacacaccactctgctaccacaaaaatgaccagataatcccctcttcagactaacatgagtaactaatgcttttttctctttaccaatttgggttataatcctcttgcttcctaggtaagaattatttagacacccaatcactgaaacgcccccacttcttaacagtattcaatcccaaattagtcctcattcagagttttagagactaggaaaaaacaaacaaacaacaaaatcagccctcactattctaaactgtagttcagaaatatccaacagaagctgaaactctataagaggttccttttaacctctccttagggaaatggtcccataattcctttggggcattctctcccttgctacagcaagccagtagatttaacttttttgactacagatttgtttccagtggtgtttagttaatgagctttgacaaagataatggtcaaatttctccaatatcaattgactatgtgaagaatatatatatatatacacacacacacacacacacacacatatttgtgtgtgtgtatgtaatatatacatatttatataagaacatattggcagggcgcagtggcttatgcctgtaatcccagcactttggaaggccaaggtgggcggatcacttgagcccaggagttcgagaccagcctggccaacatggcaaaaccccatctctactaaaaatacaaaattagctgagtgtgatgacacatgcctgtaatcctagctactcaggtggctgaggcatgagaatcacttgaacccaggtggcagaggctgcagtgagccgagatctctgggtgacagagggagaccctgtctcaaaagaaaaagaaaagaaagaacgaacccaggtcatttgtcctgtagagtattcacaaagtctgaatttgcacctttgagttaccacttaatgtctcctgtatttcctgtaaattagtagttagctctaatcagattcagactggtttgtttgtttgtttgtttgtttgtttgtttttggtatggctacttcatgcaaggtggagttatgtactctatgatcaggaaaacatgtttatctctgttttcatgatgaataacagccactgtttttttgtttacgtagagatgggctcttactatgttgtccaggctggttttgaactcctgggcttaagcaatcctcccacctcagcctcccaaaatgctgggattacaggtgtgagccactgtgccctgccacagtcattgttgaccattgcctagatatattaattcatttggatttacaaaatgttgatattctaattatattatcccttcttcaattatttactggaatgcttctataaagagaaatttccccctcatcttgagatacagttcccaaaagaaaaccaggataaatacttgattctttccaattaccagcagtttttaaaataatgagttgatctgccagcattctccaacaatgaccaatgggtttgtatttttaagtatcattgtgaattcatggatttaaacatattttatgaatttcaatccattgcagatagtatccattttgatacttaaattgccccatctttggccaatgggaactattctagttggctcctaagttcttttattacaatcctaacactctttgaaagcttccttgcctatcttggacaatacctgccccaaacctgaaatcagccacttatccaaggagttgtttgttggtcccttttaacagaaaatggtatttacatagcacaatttgagtactagaggtgtttatttttactggatcattgtttccaggcctttttagggtaaagctaggaaaattttaaggataaaataaaccatgagttcagagttatatttgcaatttaaattcagaattacggagttttctcttaacttcatcaatcgtaaatatgtatctctttattccaccccaaaaattctggttctcagagacactaacattattaatcatttgttttatctcataactaaaataatctcagaataacaataccaacactaacaccataatatggctatttaaaaatatttttgcatttattttctggcattatagtatatcccacttaggctgtcatagtcaaattattatgttttaaagtcacttgaatagtttggttagaagcattttacatttctataatgaaactgcttgtgatatggcctctaatggttgagaaatatttgtcatatatatatacctgagaagtatatatttgacaaaaatatttgtcatatatatacctgagaagagtgctatgagggcctctagactctgtattaaaatagagccaactggtaaagatggcttagtgattgtgttggttattactgagtgtcaatttgattggattgaaggatacaaagtattgatcctgggtgtgtctgtgagggtgttgccaaaagaaattaacatttgagtcagtgggctgggaaaggcagatccacccttaatctgggtgagcacaatctaattcactgccagcacagctagaataaaaagcaggcagaaaaatatgaaaggagagactggcctagcctcccagcctacatatttctcccatgctggatgcttcctgcccttgaacatcagactccaagttcttcaattttgagactgagactggctctccttgcccctcaagcttgcagacagcctactgtgggaccctgtgatcgtgtaagttaatacttaataaattcccctttatttatatatctacctatatagatatccatatctatatagatattaataaatctagagagacagaaagcagactggtgatggccagtctagatggctagatagatagacatggatatagatatagatctctatatagatagaggtagatacagatatagatatatgccctattagttctgttcctctagagaaccctaatacagtgaccgtatttggaatcggtccttctgttaatttcacttggcaagtactaaaagatgatgatctcagatatacctatggctgcaaaaacatgacatggctaaatcccttggttgcagtatctcttttcttttttaaggggggtgggggggcgggtctcactgttgcccaggctggagtgcaatggcgttatcatagctcactgcagcctcaaactcctgcgctcaagtgaccctcctgcctcagctcccaaagtgctgagattttgcaatatttatggtcacaagattatgttattccataaaagtatctttctgaggctaggcatgttggttcacacttgtaatcccagcactctgagaggctgagatggaaggattcattgaggcaaggagttcaagaccagcctggtcaacatagtgagacctcatctcggaaggaaggaaggaaggagggagggaggaagggagggagtgaaggaaggaaggaaggaaggaaggaaggaaggaaggaaggaaggaaggaaggaaaagtatatttttgaatctttttctatttctccaactctttctttagaagaattctatttccattctttcttcacctctttgcctttgttagccttctctccaagcaaatcgggagcctttattttttgtgtattcatgagggagaggaagatgaattgctgtacaaactaaagtaatgaaaatggagtaggtaggaggatagacagctgcaaggatctgagctggatagactgaacaaaccctcatcctaagcaactcacagctcagatttcttctctggacagctggcttttttcgtccttctgaaatactctgcaaagataggagaggggctatgaactacctctgctatggatcttattcaaagtcagctacctcctagatactatctgtagaacctaaatgtaatattcagcatagcagggatgaacatggtaaatgaaaggtatccaattgcccactgtaatttttaaaggccaggagctcaacattattgaaaatgctggagggctgcctggagtaggcagtgaccacagagtcacacaagctggaattggatatccaacttgtctgtcatatttctctcctccctccctgacttggcactcaatactccatattctttctaatcctctaaccctccccactcccccaactcccacaccctacccccaccaacgttcctggaattttggacttagctatttttaaaaccgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacagtaagtcaaaatgaaattgcaattcctttaataagcttttatattgaagttagacttttataaaattacaaacacctacttggatgtctctcgtccaaatgctgggatctctccctaccaaggtgccccaatctccatttctctttctgtcttatttctttctggcctctggcctctagctttttgaagtttaattctctgtctctcctctggcagtcttagccctctctttaccttattacctcaagactcctgatgaagttttagaaggagttccctacgtcctctattctgtagttttcttaccaaggccaaatatgacctcagatgatgagtcactgatacccttctatcctgcccccacttagcaatgcccttcacattgagattccaagcatgggggctgctccctgtaaatgatttctccccacaactctagtccctccattctattctccctcttgcaggactcttcccccaatcatatccttacccataagataggggagttaggcaggagggatttagcccctctccaactcctgtcatcataaaagactgagaacttcagaatttgaaaagaagagattaatggaaggagtgatatttgggaaaatacaagaactgttgacttagaaaaaacaaatattgatttgcatgtttggtttgcatcccattattccatgagagagggagattaaaattgcagctctctagagctgatgaaaagagattggtttccttttcatttgaatactgatattctagacgggatgggtatgccacccttaatccttcttgtgttctgacacaaaggaggaaaagaaatgtatgactcctagagggcatctcctcctaatggagagggacaaataagaagtatgtttctgaaatattttcaggtcctaattttactagggtacccactaggattactggtatctgatctagccccatgattcctccatctttgacatacctgctgtttggtagctcagaatggagcaatacagtggactctgcccccttgagttcactcaaccttccctccacccccacctaggggtattgcacaagggccctaaaagtggccacaggaacagggcaaagaggcttaactgccacacttatagtttgaggaactccaatctccccaaattccagtctgttcatccttttcttgatctccccagattcactccacattatccttaccaatcttcaattcttctctctctccatgtccagccaaatttcttttttcagtcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatggtaaggaagggccagggaagggtttggggaaatctagagggtaggctgctatgtaggggtgggcatgtgagcctgaatgagtgaggagagataggcgctgagagtcccgatcactcgccctgctctcaaatactaatattttatttcccgttcagtctggggaaggccactggggaagcccttggtcgacaggcagaagagatgtggcaggcttacacacttttagtaagacagccgagagaactagggactagggggttgggggctggggaaggcccttagttaggttttaggaaggctggaaacccctgatgagatttggaagagttatgagcaaactacactccgatagagcagaggtctgaggaccgtctcacaatcctctcccttctgtctttagctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaaggtcaggcactcaatcttccttccgatccacctcatgagattcttccacgggcaccattcctccccatccccactattcaacagcaatgctccctaattcccttttcttcctcaacctctcccccatctcgaatcactcccttctaccaaacacctggagctgtaaatcacttccccttgatgggaatttgactcaaatgcagaaaaccttgaagagacagtcggagagggcggacctgaggagtttcagaagggaaacttttccctctcctaggaagttgccacgattaagtagagagggggttaagtagggatgaggtaatactggaacataaataggagaagggatcaaggattgagggccatagtagtcctgcatctctacttggatcagatctctaactatgtatgaggtctgattggggggaagatgcactgaacccaaaatgaactgttttccctcttgtcctcacagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatcctctgttgcctatgttgaatctctttacagatgcttgaaatggagtaaatgcaatgtgttcactccactgaaagagggctcggaagtatcagatactgttgctatctcagggagtttacaggctattggagagacaaaaccaattcacatgaaagagtgatgagtgtgtaattattcactaaatcctacagtatggtacattcagatgggaagatggtagatttgaactaaagtaataagaataataaaaggtaacagagaagatgggatttgaagtgagctttgaagactgggtaagattcaaattgttaacgatcttccaggcaatgaaaaccatctggagttatgcatggattcatgattcagcaaggaaatgagcaaaactcaaatgcagtagacaaggagtaatgggacagaaggttagatgggcagaggccagattatgaagcaccttaaaaagggggtaaggggtttaaatttgattaatatctaacacttattgaaacttaaaatctgccaggcaatgttttaaacacttttaaaacattgacttaattctcatagctctctaaggaaggtggtattcttatctctatttttatataaggaaacttgcctccagtcacacagctaacaaattatggaacttgcctccagtcacacagttaacaaatggcagagccagaaactgaacctatgccgtttggatcccgaaacttaatttttaatcactatactatattgtcaaggaagcagagagccattaaagattctggttgtggagctggtaaagattctaaaaggggagttgtggtggtcaatgtcaccacaaaagctactctgaggctgggcgcggtggctgacacctgtaatccagcactttggtaggccaatgtgggtggatcacttgaggccaggagttcgagaccagcctgggcaacatggtaaaaccccatctctactaaaaatacaagaaatttgccaggcatgatagtccatgcctgtaatcctgtaatccaagctactcaggaggcagaggcatgagaatcgagaattgcttgaacccgggccaggaggcagaggttgcagtgagctgagaccacgccactgcactccagcctgggcaacagagtgagactatcaaacaaaaaacaactactctcttctcatattctcatataaagccaaaaagagagagttggaaaaggagggaaagcccaaagttgaaggaatctagtttgtagaagaaagactgagaagaaatgctgttctagatgagggtgctctaaagtaacaatgctgctctgaacaaaattatgaaggaggtaacttttacatttaatatcttccctgtttctggtctcatcctcccctctcaggtactccataaccgaggacctgtcctccctgccctaatcaagtactcaccattatcttccacctctcctctcagtccctgacacccgacaatactcccctgaacaaatattacagtagggccctttgtatctactaattctgcatccacagattcaaccaaccacgcactgaaaatatttgggaagtagccgagcgcagtggctcacacctgtaatcccagcactttgggaggctgaggcgggtggatcacaaggtcaggagtttgagaccagcctgaccaacatggtgaaaccccatctctactaaaaatacaaaaaattagccaggtgtgctggtgggagcctgtagtcccagctattcgggaagctgaggcaggagaatggcgtgaaccccggaggcggagcttgccgtgagcggagatcgcgccactgcactccagcctgggcgacagagcgagactccgtctcaaaaaaaaaaaaaaaaaaaagtaataaggctagctctaagcccgcgcgaaggaagagtattacatgacaggtgtcatcaaagaatttcacttaccacttggctgtgaaattcttttttttttttttttttttttgagacggagtctcgctctgtcgcccaggctggagtgcagtggcgcaatctcggctcactgcaagctccgcctcccgggttcaggccattctcctgcctgagcgtcccgagtagctgggactacaggcgcccgccaccacgcccagctaatttttttgtatttttagtagagacggggtttcaccgtgttggccaggatggtctcgatctcctgacctcgtgattcgcccgcctcggcctcccaaagtgctgggattacaggcgtgcgccaccgcgcccagccgaaattcttctcaattcacttgaaattcccacacctgagggataaagttactcttttaagagaaccaatacaaagagtatttcttcaaaaggatgttttgagttaaaatacctatattttctgtgaagtgaagagacagccctggatatgtctcttcccccaatttttttttcttcattacaacacattattttctccattagctaaaggttactttggaaagcatagagacagtgctttgagggaatggcagaatggctgtggtccttaaaagaggtggagaggagggaatagaggataaagaattgcaggagaaatttgaaatggcagaccagatacgtctcgaactcctggcctcaagtgatctgctcgcctcagcctcccaaaatgctgggattataggcatgagccaccatgcccagcccaactagccctattattaatggagcatttttaaataggtagctcaaaataagcatatgaaaagatgctcaacatcattagtcactggggaaatacaaatcaaatgaaaacaacaatgaaaaaatactacatacccactagaatggttaaaatggaaaagactgttaaataaaatacaaaatgttaggaaaatgtggagctttcatgtgctgttggtgggaatgtaaaatggtacaactactttgtaaaacagtttggcagttcgttaaaaggtaagtgtacacttaccatacaaaccagacattccaaacttaggtactgacccaagagaaatgataacatgtgctgcacaaaaacttatatacaaatgcttataacagttttatctgtaataaccaaaaactggaaacaactcaatgttgaaatggtgaatggatacaccaattgcagtaaattcacataattgaatacacagcaataaaatgaaattaattcctgatatacacaacatggataaatctcaaagtaattatgcaagtgaaaaaagctgttgccccgcaaaaaaaaaaaaaaagagtatataccatctgcttccattcatatcaaattattaaaaatcttcagcagatcatggactgtaaaaatatataaaatgttagcaaacatatagtgagaaaaggtgatcaatggttgcttaaggaatgggcagagtgaaggagggatggcttacaaaggggcatgaagtaggccggatgcggtggctcacaccagcaatcccagcattttgggaggcttaggagggtggataacttgaagccaggggtttgagaccagcctggccaacatggcagaaccctgtctctaataaaaagccctgtctctactaaaaaccctgtctccactaaaaaccctgtctccactaaaatgccctgtctctactgggtgtggtagcatgagcctgaaatcccagttactcaggaggctgaggcacaagaatcgcttgaacccaggaggtggaggttgcacaaagccgacatcacgtgactgcactccagcctacgcgatacagcaagactctgtctcaaaacaacccaaaggggcatgacgaaactcatgggggtgatagatatgttcatcattttgattgtgacagtggtttcatggatatatatatatatttgtatatgtcaaaacccatgaaatgacacaccttaaatatgtacaatttatcatacaccaagtatatgtcaataaagctgtagtttttttttttttttaatgagtagcacatctttctctcttttcttggtagatcagacaaaaggcttagaatgaccatagcatgacaaggaagattacaacagagacttttcttcttctaggaaacatacaaaagaagaggataacagaacaaaggaaagaccttatttagtgattttatattctccgctactcctatgacaaggaccacattccttcctccagaatgtcattctcaaagtcagagaccacagaaaggagattttccgatttaagaacatcaaccctgtgaatcataattctgtctttccacttcaccaagagtcagcaggtggtgctagtgactaaaaagtgacttggcagacaatgaggcaagtttccaggaaaagaaaaattatcgtctaagattatctgatatgttgaccatttgaaagaaaatattaataggcatttgccagaattgacatttaggaaataaactgaagataggtacatagtaaacaaagtaaaattttaaataaattataatttaacaataaagggttgttcaagacatgaaacaatcaatatatactacttggctcctcaatggatatcatttacacagtaatactaatgtaaacactgactattgattcagccagaactatgctataactttctattgggaggatgaggtaaggggaaaggaaaggtgggaatatagcatgatgtaagagttaaaatttcaattactataaccataagagagtagatatgtctaatatttattttgtttccttttttttttttttttgagacaagagtctctcactgttgcccaggctggagtgcagtggcgcaatctcagctcactgcaacctctgcatcccgggttcaagcgattctcctgcctcagcctcccaagtagctgcgactacaggcatgcaccaccaggcccgtctactttttgtatttttagtagagatgggtttcaccatgttggtcaggctggtctcaaactcctgacctcaagagatccatccacctcagcctctcaaaatatatatgtaatgttagcacatatatagtgagaaaaggagctcaatggttgcttaagggatgggcagagaggaggagggatggcttacaaaggggtatgaagcaggctctgtcgctctcgctgtatcgccagactggagtgcagtggcccaatctcagctcactctatcctccatctcccgggttcaaacaattctcatgcctcagcctcccaagtagctgggattacaggcgtgagccaccacacccagcctagttgtatttttatattttcaacacctagtctggcacatgatctgtaaatgtttttaataaggaaaatagtccaggcacggtggtttacgcctgtaatcccagcactttgggaggccaaggctggcggatcacctgaggccaggagttcaagaccagcctggccaacatgggaaccccatctccactaaaaatacaaaaattagcccagcgtggtggcgtgggcctgtagtcccagctatttggaaggctgaggcaggagaatcacttgaacccaggaggtggaggttgcagtgagctgagattgcgccactgcactccagtttgggtaacagggcaagactctctctcaaaaaaaaaaaaaaaaaaaaaagaaagaaagaaaaagaaatatgaagtgcataccagatgaaaaagctgaaagaggcagggtgcagtggctcatgcctgtaatcctaggcatggatttaagaggcctaggtagatggatcccttgagcccaggagttcaagaccagcctgggcaacacagcaaaaccctgtctctacaaaatatataaaaattagctgggcatggtggtatgtgcctgtagtcccagatacttgggaggctaaggcaggaggtacacctgagcccagaaagtcaaggctgcagtgagccatgatcatgccactgcactctggcctgggtgatagagtgagatcctgtctcaaaaacaagggggcgggggccgggtgtggtggttcatgcttataatcccagccctttgagaggccaagtggggggaagatcacttgggccaggagttcaagaccagctggcctacatggtgaaacctcatctctactaaaaatacaaaaattagccagacgtggtggtgtgggcctgtaatcccagctatttgggtagctgaggcaggagaattgcttgaagctaggaggtggaggttgcagtgagccgagatcgcaccactgcactccagcctggggctgagattgccccactgcactccagcctgggtgacggagtgagatcctgtctcaacaaaaaaaaaaaaaaaaaaaaaaaaagaaagaaagaaaaagaaaaaggggcttgggcttgaggactgctgttttttgtaaaatcatttaatatcatgtgatttttaactacatgttacattacattgattaaaaagaggagcatttggctgggcgcagtggctcatgcctgtaatcctagcactttgggaggctgaggtgggaggatcacctgaggtcacgagttcaagatcagcccggtaaacatggtgaaaccccgtccctactaaaaatacaaaaattagctgggcatggtggtgcatgcctgtaatcccagctacttgggaggctgaggcaggagaatcgcttgaacccaggagtccgaggttgcagtgagctgagattgtgccactgcagtccagcctggagacacagtgagactccctctcaaaagaaaacccaaaaaacaaaaagaggagcatttctgggcaggtgcagtggctcacgcctataatcccagcattttgggaggccaaggcgggtggatcacttgaagtctgaagtttgagagcagccgcggacatggcaaaaccctgactctactgaaaatacaaaaattagccgggtgtggtggctggcacctataatcccagcggcttgagagacttaagcaggagaatcacttgaaccggggaggcggagattgcagtgagccaacatcatgccactgcactccagcctgggcaacagagtgagacttcattccccaccctcaaaaaaaaaaaagggagcatttccaccttggcctgagctttttccccttaactttgtggccatctcaaccacttctcagatcaaacaaacacctccctccctactatactccaccctatgtacttcatggcaagttccttcccacatttcttctcaaggaaacagatagtagccatggcccagtaattatagttttcaaaatcagtgccaggaaaccataccagcactaaggaagggaaagaagacataaaactaggaaataaaaggccttcctcaatttttctgtgtactcccaaaccaaattactaatcatttttccaacaattaacagaagaaataagttacatatgtttcctcagataaaagttatataagtggagggtgggctttgagaaactgaaaaagaaaaaccaggaagaataactagattctacctccaatacagggcgattttggaatcattctttgctattggttcaaagaactaatttttttttttttttttgagacaggttctcacttcatcacccaggctggagtgcagtggctcaatattagctcactgcagccttgacctcctagattcaagcaatcctcctgtctcagccccctaagtagctgagactactgtgctagccaccactcccatctaattttttgttttttgtattttttgtatagatgggttttcgccatgttgcccaagctggtctcgaactcctgggttcaagcaacccacctaccttggcctcccaaaatgcaatgattacagccttgagccaccacacctggcacagaaccaacatttttaatattaagcgtttcacatagtcagtctttgatacaacacttctacctttgagaaactaagtcatattttcaaaaaagtaggctggctgggagcggtgtctcatgcctgtaatcccagcactttgggaggccaaggtaggaggactgcttgagcccgggagtttgataccagcctgggcaacatggtgagacccccgtctctacaaaaaaaataaaaaattagctggctgttgtggcatgtgcctatagttccagctacctgggaggccgaggtgggaggatcagttgagcccaggaggttggggctgcagtgagctatgatcgcactactgcactccaacctgggtgacagagcaagaccctgtctcaataaaagaattaaaaataaattaaaggccaggcgcagtggcccatacgtgtaatcccagcactttgggaggctgaggtgggcgaattgcttcagctcaagagttcaagaccagcctgggcaatatggcaaaaccccttctctacgaaaaatacaaaaaattagccgggagtggtggtgtgtgcctgtggtcccagctactcgggaggctaagttggaaggattgcttgagcccaggaggtcaggaggtcgaggctgcagtgagctgagattgcaccactgcactccagcctgggtaacagagtgaaatactgtctcaaaaaataaataggtaaaaatttaaaaattaattaattaaaaatgaaaaataaatgtagaaatcagagaaagctttacaaaggagatgactttttttttttttttttttttttgagacagagtcttgctctatcacccaggctggagtgcagtagcacaatcttggctcactgcaacctctgcctcccgggttcaagtgattctcctgcctcagcctcccgagtagctgggattacaggcacccacaatcatgcccggctaatttctgtattttcagttgagacgaggtttcaccatgttggccaggttggtcttgaactcctgacctcaggtgatctgcccgcctcagcctcccaaagtgctggaattacaggtgtgagccaccacacttggacaatcttggacttaaaaaaaatctttttttttaaggctcagggactcactaggaattttgtcctagctgtgtgatcataggcaagtcatttgagttctctgaatcacaatattctcttctgcaaaatgtcttcctgcttacctggtgagaatcaaatgtttgtgcaactgcgttataatgcatatatatagatatatagatgacaaaatataattaacaaagaaagtactggccgggcatggtggctcacacctgtaatcccagcactttgggaggccaaggtgggcagatcacccgaggtcaggagttcaagaccagcctgaccaacatggagaaaccctgtctctactaaaaatacaaaataagccaggcgtggcggcgcatgcctgtaatcccagctacttgggaggctgaggcaggagaatcgcttgaacctgggaggtggaggttgcggtgagccgagatcgccccattgcactccagcctggacgacaagagcaaaactccatctcaaaaaaaagaaagtactgatctggcacagtggctcatgcctgtcatcccaacactttggaaggtcgaggtaggaggatcactagagcccaagagttagagaccagactgggcaacatagcaagacccccatatctacaaaaaacttaaaattaactaggcatggtggtagtcccagttcctcaggaggctgaggccgagggttgcttgagcccaagagtcagagactgcagtgaactgatcgcacgacagcactccagcctgggcaagagagaggcccatctcttaaaaaaattaattcattttttcaaaaggcattgatggatctagaaaaataaataaatgttttaaaattttttcttagaaaagaaagtattattaattgtcagtctggataaaaaaatagaaacttgttttaatgtagaatttctttccctcagtcatgaacaccacatttccttcatttgttccttctcataatcaaaaatcatctttgccactcaggggagtgatctgggctgttttggctctcagaaaagcttttatttgtttgagacaattcttggactaagaattttgacagtatattaaactgcccactaggtggcagagctgagtcaactgtatttctgaattgtgtaagaaataatttctcagaaaaggggaagttgggttgagcacacaatgtcccatctccctcatacttataaacaccaacgcagtccaattttcttctcacagaaaaacaaaccaccacctctcgcctccttaccgtccctgctctgatacatatttgggccacaggctttgaggagggacaaatatgatacagtttagcataagaaactgaggttgaggtgtcaagtctaatagtaataagaaataatactaggatctgaattactggtatattctatccagagacataacccaatctatcaattcaatcaatctatctctatatgtatgtgtgtgtctgtgtgtgtgtgtgtgtgtgtgtgtgtgtgtgtgtgtgtgtatatatatatatattttttttttttttttttttttttgacatggcaattcaagccatcctcccacctcagccttccgaggagctgggactacaggcgtgcaccatcacacacagctaattttttttatttttagtagagacagggtttccccatgttgcccaggctggtctcgaagttgtgagctcaagtgatccgcctgcctcagcctcccaaaatgctgggattacaggcgtgagccactgcacctggcctcaatttatatttaataatacatttattctgtgaagtgtactctaacagatgctaggaagaatacaaagataaaaaagggcatagtttctattctctaggaatttaggagagaaaaggcactttacgtgttagtgctatgtaagaaatataaatgtgctatggagtattccaaagagaatgaaaaaatatttgattgtaaggtaaaagatgaggggattggctgggcatggtggctcatacctataatcccagcactttgagaagctgaggcgggtggatcgcttgagctcaggagttcaagaccagcctaggctacatggtgaaaccctgtctctacaagttttttttttcttttctttcttttttttaagttagccgggtgtggttgcatgcccctgtagtcccagctactcgggaggctgaggtgggaggattgtttgaacctgggagatcgaggctacagtgagccatgatagcaccactgtactccagcctgggtaacagagtgagactctatctaaaaaaaaaaaaaaaagttgaggggattgggaagcaagaaatgtttttggttttgctttgttgctttgagatagagtctcaccctgtcacccaggctggagtgcagcagcatgatctcagctcactgcaacctccacctccggggttcaagcaattctcctgcttcagcctcccgagtagctgggattacaggcacctgccaaccatgtcctgctaatttttgtatttttagtagagatggggtttcaccgtgttggccaggctggtctcaaactcctgacctcaggtgatccacccacctcggcctctcaaagtgctgggattacaggcgtgagccactgcgcccagccaagaaaggtttaatagaggaaaaattatttggctgtctacagaagagtgggtaaaatttcaaaaagcagagatggggaaggacaggcacactaggtacaaggaaaaatgtaagcagggacataaagacagagaaggatatattaagggaacactgagtgctcagttttggctgaagcatagggtacatgtatgaggaaatagtgggaaatgaatgagaaaatttggttgaggacatttcgtgaaggcttaaatgccaggttgaagcatttaaacgtgattcagtaagcaatacattttgcattattataggaacacacaggaactcaattctgtgagattaatctagtgatgttctatagattacagcaggaaaatcagttaaaatctattaaagtaatctaggcaaaagtaacaaaaacatgaaccagaatggtggcagtagaataagaaacaggagacaggtgctagaaacactagaaagatggctctatagaattcagcagttgactggatgtggggcatgacagagaggaaggaattaaaggcaatccctggattttaagcctttataacttggggaatatataatggttctattaaaacaaacaagggggctggaggcagtggctcatatctatgatactagcactttgggaggccaaggtggaatgatcccttgagcccaggagtttgagaccagcctaggcaacaaaatgagatcccatctgtaccaaaaattaaagaattagctgggcatggtggcatatgcctgtggtcctagctacttgggaggctgaggcaggaggatcccttgagagcgggagttcaagattgcagtatgctatgatccctgatcccaccagtgcaatccaacctgtgtgacagagcgagaccttgtctcaaaaagaaagaaagaaaaagaggggaaaaaaaaaggccgggcgcggtggctcacgcctgtaatcccagcactttgggaggccgaggcgggcggatcacctaggtcaggagtttgaaaccagcctcaacatggagaaacccagtctctactaaaaatacaaaattagccgggcgtggtgctgcatgcctgtaatcccagctacttgggaggctgaggcaggagaattgcttgaacctgggaggtggaggttgcggtgagctgagatcacgccattgcactccaacctgggcaacaagagcgaaactccgtctcaaaaaaaaaaacaaggcaaagaaatgggtttgaccaccagggaaagattatgaattcattactagacaagctgaatttgagataacagctggaactttggagacaggctaaaggtatagcatagatttaaagtcatttacacagagtgatgtacagacagtcaaactgaaaagtgaaacttcaagaaagaaaaggagagggcccaggacaagcccttaagaagaattttcagggagtagaaaaaaaaagaattgttagcaaaggagaaaaggatgaagtccaaaagtcaagatttaagtgtttaaaattttaaaacatggcagtttccaaatcatatagaagtcaaaaggaataaagcctataaaaagtactctgactggccgggcgcagtggctaatgcctgtaattccagcactctgggaggccaaggcaggtggatcgcctgaggtcaggagttccagaccagcctggccagcatggtgaaaccccatctctactgaaaatacaaaaattagccgggcgtggtggcacgtgcctgtaatcccagctactcaggaagctgaggcaggagaattgcttgaagccaggaggcggaagttgcagtgagccaagatcgcgccattgcgctccagcctgggcaacagagtgagaccctgtctcaaaaaaaaaaaaaaaacaccctacgttgattttgccaggtatggtggctcatgcctgtaatcccagcacttcgggaggtcgaggtgggcggatcacttgaggtaaggagcttaagacgagcctgaccaacatgacgaaacccggtatctattaaaaatcaaaaattagctgggcgtggtagcacatgtctgtaatcccagctacttgggaggctgaggcaggagaattgcatgaacccaggaggcagaggttgcagtgagccaagatcgcaccaatgcactccagcctgggtgacagagcaagactccatttcaaaaaaaaaggaaaagaaaagaaaaactactccaatttccgctggagaccttgaagaaaatagtttcagagagaccagaaggcagactacaaagggacaagttcagtccacagaaaaagctgatacagattattctcttaagaaatttgacagtaaaagaagaataccgcctgggcacagtggctcacgactgtaatctcaacactttgggaggccaaagtgggtggatcatttaaggctaggagttcgagaccggcttggccaacatggtgaaaccccatctctactaaaaatacaaaaattagtcgggcttggtgatgggcacctgtaaacccagctactcgggaggctgaggcagaagaatcgcttaaacccaggaggcggaggctgcagtgagccgagatcgagccactgcactccagcctgggtgacagactgagactgtctcaaaaaaaaaaatactgtaataacatgagaagggaaataagatatttttatcacatataaaggcaactttaagaactatggcccagcacagtggctcacgcctgtaatcccagcactttgggaggccaaggtgggtggatcacttgaggtcaggcgttcaagaccagcctggccaatgcctgtaatcccaactactctggaggcagaggagaatcgtttgaacctgggaggcagaggttgcagtgagccaagatcgtgccattgcactccagcctgagtgacagagtgagactctatataaaaaataaatagataaagctgggcatggtggctcaaacctgtaatcccagcattttgggaggccaaggcaggtggatcacctgaggtcagaagttcaagaccagcctggccaaaaaggtgaaaccccacctctactaaaaatacaaaaaattagctgggcatggtggtgggtgcctataatcccagctactagggaggctgagacaggtgaatcacttgaacctgggaggtggaggttgcagcgagccgagatcacgccaccgcactccagcctgggtgacagagtaagaccttgtctcaaaagtaaatagataagtaaataaagctaattacaaaaaaaagaaaagaaaaagaactacctttaggaagttattgtaagggccttcagaaaagaaaaaaaaacttttttggtttttttttttgagacggagttttgctcttgttgcccaggctggagtgcaatcttgactcactgcaacctccacctcccaggttcaagctattctcttgcctcagcctcctgagtaactgggattacaggcatgcgccaccacacctggctaattttgtattattagtagagacggggttactccttgttggtcaggctggtctcaaactcctgacctcagttgatctgcctgcctcgacctcccaaaatgctgggattacaggcgtgagccaccacgcccagccaaaaagaactatcttaaatgagcctacaatacctccaaacaagttaattcagcccctctccccatcttgccatgacattggacaatactgagatctctatcctttgcttatcatggtagaaaaattgatctcagtaaacacgaaatgtgggcctccagatgagatatttttaaaagttaaaactaaattaacaaacaagattggacatggtggctcatatctataattccagcactttgggaggccaaggtgggtggatagcttgagcccaggtgttccagaccagcccaggcaacatggcaagactccatctctaccaaaatatatgaaaattagcccggcatgtgcctgtagtcccagctgactcaagaggccaaggtggaaggatcacctcagccctggaggttgaggttacagtgagacatggtcatgtcactgcactccagcctggtgatgaagtaagaccctttctcaaaaaaaaaaaattagctgggtatggtgtgtgttcctagtagttcccgctactgagctatgcttgtgccactgtactccagtctgggcaacaacaaaataaacaaatagataataaagagaatcctgggtttggagagtggctccaccagatactagcttatgtcccaggtcaagtcacttaaccaaaataagaactggttttaaaaaaataaaagactgctacagtcccatttaactctaaaattctctgagtcttgccctgaatcctttattagactattgtgagaatcaaacaagatactgtgtatcaaagcactgagagccaagacaacacatttttatagtacatacttttagacagacatgggcgggttcaagatcttgctctacttacaaaatctgtgacctcaggcaaattacttcacttctgagcctgactgaaccaacaccgagtcacaaggttattgagagaattaaatgaaacaatctaacctcaaatactttctttttttttttttttgagacggagtctcgctctgtcgcccaggcgggagtgcagtggcgcaatctcggctcactgcaaactccgcctcccgggttcacgccattctcctgcctcagcctcccgagtagctgggactacaggcgcccaccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccaacctcaaatactttctagaacaacatgacagatgacagataattatcactgacataattatataaaagacttggttcattataggtgctcaataaatggcaattacttaaaaagtcacttggaactctaacatgctatacaatttcttttttttttttttgagatggagtctcactttgtcgcccaggctggagtgcagtggcgagatctcggctcactgcaagctccacctcccaggttcacgccattctcctgcctcagcctcccgagtagctgggactataggcgcctgccaccacacccggctaattttttgtatttttagtagagacggggtttcactgtgttagccaggatggtctcaatctcctgacctcgtgatttgcctgcctcagcctcccaaagtgctgggattacaggcgtgagccaccgcgcccagcctttttttttttttttttttaaagagagatggggtctcactacaatgcccagggtgatcttcttgaattcctggcctcaagtgatcttcccatttcagcctcccaaagtgctgggattacaggcatgagccaccacacctggcttacaattgttaatttattcttattgatctatgacttggggcagtcttcaaactcttaatttgcctctaaattccttagggaaaaaattgaaagggaaaagggtgcctataatcccagcactttgggaggccgaggtaggcggactgcttgagcaggagtttgagaccagcctggccaacatggtgaaaccccatctctaccaaaaatacaaaaattacctaggcgtggtggagcacatctgtagtcccagctactcgggaggctgaggtgggagaatcacttgagcctgggatgcggaggtttcagtgagccaagtgacactgcattccaacctggttgagagtgagaccctatgtggaaaaaaaaaaagagagagagaaaggaaaatgggtaagggtaaaagggaagtttacagagtagaggtgagagaagtgattaaaaggaccaagaaagggctttgttctgcattaagaactatgagtcttcatgttctaaatgtttgtcaggccagaggttaaagaaaagagaaatgcaatcagtgtcttgtctctgactggcaacaaagtgctgagggcacttccctccctgaaactgctggctttattctgtcacctgcagtaaagcaaacaaacaacaatcaccacttggtttcctgttggcactgggactgaagagggtagagaaggggcagataaagatgatccaacttgcaaaactctttgactgtgccctactttgctgttcctccttggcccaccccttttcccaaacctcacaagtgtttttataccctgattttaggacaagagtttacaaaatttctttcttcttagacccaagaactgggaaaggagaatcggggcaggtttttatcagaataccaggttacaaggtgaaaggtcgtaaacaaccgtgtccaggaggactccacttcagaacatgccttggctacaggcctggtaggcagcagctgctgccaaagctaaataattttttggcatttaaaggaacccaggcataacacagagcaacgtagtctgtagtgagctctgcaaatgggaagatacaaggaaaccagagcccagaagagaaacttagaacgagagaattgtcataggattttttaaaactcagcaattcagtacttcagagatgtgcccacataaatatcaaataaattgaaagggaaaagggtgcctataatcccagcactttgggaggccaggtaggcggactgcttgagcaggagtttgagaccagcctggccaacatggtgaaaccccatctctaccaaaaatacaaaaattacctaggcgtggtggagcacatctgtagtcccggctactcgggaggctgaggtgggagaatcacttgagcctgggatgtggaggtttcagtgagccaagtgacactgcattccaacctggttgagagttggatgtcttaagatgtcccatattaccaccaccctgatccatcactagccaccatctttcctattccctcaaaatgtatgtagttaagatttaacaatatttaacaatattgactatgtagttaacaatattgattcatatatttgtcagcattttgatgtttgatagttacactttcatacccatcaaactaaacgttctcccagaagccacaattttgaacttttaaaattacttcagtcaggccaggcacggtggctcacgcctgtaatcccagcactttgggaggccaaggcgggtggatcacctgaggtcaggaggagttcaagaccatcttgggcaacatggtgaaaccccatctctactaaaaatacaaaaattagctgggcgtggtgatgcatgcctgtaatgccaggtactcaggaggctgaggcggagaatcgctctaacccaggaggcagaggttgcagtgagctggggtcaggccactgcactccagcctaggcaacagagcaagattccaccttaaaaaaaaaaattacttcagtcagagttccacctcctctgctcccagtaactcaatcaatattgttaaccaactgaaaacacctcaagcctagctggttaagtttctagaacagggtgccgcctcaaacacaccctaaggatcaacatgttcctggggtttaatgcatgtgtgtgttttcgaagagactcatgatgcctattcttgagcttgcttaatattggggttgagttgtaactctcgttagccttagagtgtcaatccagctaggctgtctgaggaaggaagaaggctctttaacagcaatgaataggtttttttttttttttttgctgattgggtagggtttcaatatacttgaatgcttcttaattacctccccatctcaatcttgggacattatcttcctctttccagcacaaggaattaaataataatcttctgataccccagcacagatataggaagggtctatgaatcaaataaaaggaggaagaatccctgcacttttgcatacaggtttttcctattacatttaagagtaagttctcagtactcagctcctaaagcatctcacagccagcaggggaaaatccatctgacagctggccaaacgaaaccaacaaagaatgaagagagagggtagggtctcttctggcttgaatttatagtgctctgttgaccgatctttcttctcttttccttcttactgttttctaaaccgtttagggaaaaacctttgaaaatagtttttaaaattgttccttcaaacaggtgtgtggccatctctccactgaaaatttggatataaacaagaggactttctcacttttaaccagatttatggatgtacatttgatttagtgagttggaagaggggatggagacaagaaagagtgaacataactggaaaaaagtgaaaagagtgaagcatcctttttttcccgcttttccttttcctccagaagcaggtaggaagtgggagataatgagcgcctggacacacctcactaaagaggtaatgaggtaaatggggaacacagacaaagtgttccccaactttgcaggtagaaattgaagagatgacaggataagcaacaggatgtaaacacgcccctcctatttccgttccacagaacagagagaacagaagagagggtacaagctgggggtgggtgacgaacagcacaggcacgcagcccccagccctagccccaagggattggaacgggaaggagaagacatcggtcctacacacacaatgaggcctgaaagttctcctttccctcagagacggtggtgttttttatacttaatagggatgcggggcaagagaaggacaaagggctgttcctgaacagtaacaccaagcattctgcgctccacagccccaaacctgaaagtattcttggagctatgggattttcacacacttgctatttatgagccaggaataacgacaggctctaaagtaactgcactggctaagactaggcatgaaattccctcataagcacattttccttttacctcaaaacaccgctctcagaccagaaacgtccacacccgccctccgatggcctgtcgccctggctaggttttagggtcagtgggatcctccttccactggacccgggagaagacgctcaacagccccctccttcccctccttcctctccttcctctccttcccccctccctgcgccgctccagagcgcaacaaccattttcccagccaggagcacaccgtgtccacgcgccacagcgatctcactgattggtcgggctcctggtaaacaaggaccgggcagccaatgggagggatgtgcacgagggcagcacgagcctccgggccagcgctcgcgtggctcttctggcccgggctactatatagagacgtttccgcctcctgcttgaaactaacccctctttttctccaaaggagtgcttgtggagatcggatcttttctccagcaattgggggaaagaaggctttttctctgacttcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggtaaatatcagctaaatgcatctttgaacttttctgtctaaaatatcttgccctcctttgatcacttactgttcttggagagcgttttaaaattttcattttcttgacacaggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaatgtctgtgagatggctttggaaaagtttttggaaagaaggtgtgtctaaaggagttttcctctacttaacaatccacactaatgaaaaccttgtggagaaaacactccctatggaccctaaggaatgtcggcagagtgggggctagaaggtgaagagggaaaccgtttgaggcatgtttcagattcactgaacaactatactgggattttccggttgtctaaactagttttccaaatccataggtaatcattactaaattccttcagttttggagttcatgggttcttgaaatacagggagatgatgtttatgagggcatttgaaagaaaagagtggcggttcctttttttgagacagtctcactcacccaggctggagtgtagtatgatcttagctcactgcagccttgatttcctgggctcaagtgatcttcccatctccgcctcccacatagctgggctacaggcatacacaactacgttcagttaattgtgtgtgcgtgtgtgtgtgtgtatgtgtttgttttttctacgctcagctaattttttgattatttgtagagttcgggttttgccatgttgtccaggttggcctcaaacttctgggctcaagtgatctgctggccctggcctcccaaagagttgggaatacaggcgtgagacaccacactcagctgaagatcccctttttacaatatggttttatcatagggtttcttcccaatgtaaacttgatttatatactaacaaggataacttcaggacttaagaggttatagagttatgagtattaaattctttggaggcagctaaccattttttattttcacagttcctaaccaagcacataactcagtaaatgtttgctaactattcaacttcaccctcatcccttagatgatttgatggttcctattccttgtagggtaatagtagtagagtaataccacaatcccatgtttaattggtgtgattttctttctttctttctttctttttttttttttgagatagagtcttgctctgtctcccaggctggagtgcagtggcccaatcttggcttaatacaatgtccgcctcccaggttcaagcgattctgctacctcagactcttgagtagttgggattacaggcatgagccaccacactcagctaatttttgtatttttagtagagacggggtttcaccatgttggccaggctggtctcgaactcctgacttcccgtgattcacccgcctcagcctcctaaagtgctgggattacaggtgtgagccatggcgcccagcagtgattttcattcctaaagaaccgacaggtggagaaaccctgggatggccaatttaaatatttgcacagatctggtcctggtccttatttgggaattgatttttctgaggacttccacaaactaattccaaataacaggctcctggaaattctacatgaaatcagtgtggggtgttgtagctctagctactcacaaggctgaggcaagaggatcattcaagcccagaagttctaggttacagtgagctatgattgcaccacttgcactccagcctgggggacagattttgtctcaaaaataaataaataataagcaaactaaaatcaatgtgaatttaacagaaagtgagatttaaaagatccttttccatttcaatcctcatttttcgtttatctttcattttccatagcactctcctccctctctttgtctctctttcattaccaaagtgtcagtctctatttctccctattgccagggtgactttcacctgaactctccgcccctttctcacctgtgcaagaatttagtggctcctctccttcaaatctgtgaccaggaaattaggtcaaagttgatggaaaagttttttctgtagcttgttttccagggcctagaggggtgaagcaatgataagagcaggccagagagcaggacaaaggaatggagagaccatggagtacatgagcctggttgtgtgcacagttgggctaccagtacccaatatgagaagagggatggcttcgaaaggatagataactttatacccaaggcctcttagagatctgatcctagggccaggcgcggtggcttacgcctgtaattgcagctactcgggaggctgaggaaggagaatcacttgaacccaggaggtggaggttgcagtgagcccagactgcaccactgcactccagcctgggcgacagagcaagactgtctccaaaaaaaaaaaaagagctctgatcctggaagggccagaacatgggcatctcctccggatacccttaatatcctttatccagctgtccaaatagaactttctatgatgatggaaattttcaatacagtagccactagccctgaaatgtggctactatgactgataaactgattttttttcttatctttttttttttttttttagatagggtctcattctgtctcccaggctggagtgcagtggcacaatcttggctcactgcagttttgacctcccaagctcaggtgattctcccacctcagcctcccaagtagctagaactacaggcacatgccaccatgcccagctaattttttctattttttgtagagacagggtttcaccatgttgcccaggctggtcttgaactcctaggctcaagcaatctgcccacttcagcctcccaaagtgctgtgcacacattttttttttttttttaaacagggtcttgctctgtctcccaggctggagtgcagtggcatgatctctgctcactgcagcctccacctctcagggtcaagtgatttcccatctcagccccctagtagctggaactacaggtgcatggcaccaagcccgactaatttttgtatttttcatagagatgaagttttgccatgttgcccaggctggtctcaaaactcctgggctcaagtgatcctcccacctcagcctcccaaagtgctaggattacaggtgtgagccactgtgcccagcctgtaactgaatttttaattttgtttaattatttatttattattattattattttttgagatggagtttctctcttgttgcccaggctggagtgcaatggcgtgatctcggctcactgcaacctccacctcctgggttcagcgattctcctgcctcagcctcccaagtagctgggattacaggcatgcgttaccacacctggctaattttgtatttttagtagagatggggtttctccatgttggtcaggctggtcttgaactcccgacctcaggtgatctgcccatctcagcctcccaaagtgctgggattactgtgcccggcccaattttgttcaattcaattaaactttagctttctgtgactagtgactgtcacatatgtgactagtgactagtgactagtgactgccatattgaataccacatcaaaatctaagggagtaagcagctagagctgttcccccagaggaaacctatccttctcttacagcacaaaaactccactctacttctttttgccttgtgtatacaacttctacctcacccgaggacattttccgcgtacaggcttgcttcagtacacttccttggggagtggcttagctatttccccacttaagtgggggaatattctgggtcttctttgcctatcctcttctcatgtgccttttaatttttaagtagctatgacctacatgtacaatgattagaggagatgtggttctgagtatcatttattcagtaggtttaatctggtatagggagatctgagagaactaaaaaagaaaactacctaaagagagaaaagggcaagaaaataaaattaacaagaaaaaggggccgggtgctgtggctcatgcctgtaatctcagcattttgggaggccaaggtgggtggatcatttgaggtcaggagtttgagaccagcctggccaacatggtgaaaccccgcctctactaaaaatataaaaaattagccaggcgtggcaggcacctgtagtcccagctacttgggaggctgaggcaggagaatcacttgaacctgggaggcagacattgcagtgagccaagatcacgccactgcactccagcctgggagacagagagagactccttctcaaaacaaaacaaaacgaaaaacaggtacttcaacaaccagagtcattggctgccttgattgatacctctgaacagactggaaacacaaggatctaacttgggttgaggcactgggaaggaaaaatgtggaggggaggatctgacaaagcacatgttcagcaaaaaacaatcacacaagagctgaagggcatgaagtggagtcaaggagtgacctttgcacaattcttttttctctttttgagagagggtctcactatgttgcccaggttggagtggagtggctattcacaggcacaatcatagcaaactctgaccttgaactcatagcctcaagggattccccctactcaacctcccatgtagctgggactacaggcacacgcaaccttggcccaattctttcaacagactacagatccctcttagaattattttcttgggctacctctaggtgataaaatgcataaggtgaataaggaaaatattttactgaccttccaatgatcacaagtccctgcccccaggcatcctggcctcaatagtttggggatgggggaatgggaagtttttttgtcctttctctgttgtgacctcacatcgacctccatttcataagctgaaacactccttttcagagagctaaagatccagggctgcaggtcctggcacaataggtaagtctagaacccagaaaaagtccaaagattagtcttcctatactattaagaaaaaataggccgggcacggtggctcacgcctgtaatcccagcactttgggagccgaggtgggcggatcacctgaggtcaggagttcgagaccagcctggccaacatggtgaaaccccatctctactaaaaatacaaaaaattagccaagtgaggtggtgcgcacctgcagtcccaactacttgggaggctgaggcaggagaattgcttgaaccccagagagggaggttgcagtgagcagagatcatgccactgcactccagcacctgggtgacagagcgagactctgtcccaaaaaaaaaaaaaaaaaaaagaaagaaaagaaaaggaaaaggaagaaaaaatagcatagtatagtagttaagcacgtggacactgaagccaaactatctaaattaagatcttacttctaccatttaaccagctatgtgaccttgggcaacttgtttaaacctctctatgtaacagtttgtttatttataaaatgagagataataataatgcctacctcagaagattgtgagaaatttaaaaatatatgtaaaatttagaacaatgccacataagtgattgttatctaaaataaaagaagagacatatccctcattacccccctgattaatttactttctttctttctttttcttttttttttttttttgagacagagtctcactccatcacccaggctagagtggagtggggcgatctcagcaacctcctcctcctgggttcaagcaattatctcgccccagccacccaagtagctgggattacaggcatgcaccaccatgtctggctgatttttttatttttagctgaggtgaggtttcaccatgttatccaggctggtctcgaactccagacagctcgactcaagctatccgcctgcctcggcctcccaaagtgcttggattacaggagtgagccacagcacccacttagcctcagggtgttctttttcacacttccagtgtgcttcacaagcctgtggattaaaccctgtaaccttctaaaaattatttgaactttcttaacttttcagtacacaactccaaagaaaagcttcccaccatttggagtgataaactgaggaacagagagtgctggatatacaatgtgatgccacaggtcttccagactttttctttcaaggtattgcattccatttgatttttctgtggggtggactagactgaggagcacaaaggtcaatggaggtgagtccacggatgaggcccagtttagcctatttaggctattcttgttctgtcccgacctttccctttgcttgacccttccctactctctgctgggcctgttatgtaaggagaaaagaatgaacagactttgactatcaattgattggtcatctccaggcaacagagtgatgggagaaagaagacagggaaaacaaaggtacaggattgtgaattccatgtgccctgagtcctgagatgttaggcaacgtccattctcagtccttgttgggctatgaagttgctgacaatcaaagttaatcaaatggtcagtaaacaggttcttggaaatgtctggctaggttcccagcttggatatttttaacctcctggacagatggatagaacaaggatttcagctgctgagaggggaggaggtattcaggggcataagaactgtgcttcctttttttttttttttttttttttttttttttttaagagatgagtcgcactctgtcaccaggctggagtgcaatggcgcaatctcggctcactgcacctctgcctcccgggttcaagtgattctcctgtttcagcctcctgagtagctgggattatagatgctcacgaccacgcctgtctaatttttgtatttctagtagatacggggtttcactatagatccgcctgccttggccacccaaagtgctgggatcacaggcgtgagccaccgcgcctggccaacatttgtgcttcccttatatggttctgtggctaaagatccctccctctccacttcagattctgacttcctccttcatctagccagactcagggttaatcctttgtttcctgctctcccatttctctttattccctgtctttcatgcttgcttcaccttccaactctgaggaaactctggtttctgttttacctctggattcctgtagatcaggaagagggtggttgggcaggggccaatggctcctttgtttcccctggagataggtgtagctctgccagtagtactcagaggcttctctgcagttctatctcctcaagctgtcccgcaggacagcttcaaactctcctgcaaactcatgcatcccactgcccccaactcttgggaacagaatttgacaccctgcaagcccaggcctgtgcttcacatacttttggaaagtagaagaaatgatcgtgaaggtcagagaggttggaaatggtgaccaagtctgacaaggcaagatctgctatctctggtttgggaaaattaggtcacctggaaggtggaagggctgggagagaggtcgatcattagcaagttcagaatatctttttgactgtgagggaggcctggaggttaggaatgaaagtgaggaaggagagacaaaaattatgataattccctatttggggtttcatcttcccctggtgaataccctttaaactgaatacccttctatatccaaagactgctttcttctttcctcttgttctttcctgtatctcaacaccatttctgatagtgcccaccctgctttgtggttggaggagaaaatccctgacacaagtgctccaagattgacgggaagctggtggggagatggacttaggtagggaagggagatcacactgtgattcatgtttctcttcttttgtcttgattttagctgatgatgaacctaagcaaagctggaggaaacactaagccagaggcagcaaatcaggggcccataggccaaaccagcttgcagacatttagaaacccatatttccggctgggtgcggtggctcacacctgtaatctcagcactttgagagtctgaggcaggcaaatcacctgaggtcaggagttagagatcagcctgaccaacacggcgaaaccccatctctactaaaaatacaaattagttgggcatggtggtgcaggcctgtaatcccagctagtcaggaggcggaggcaggggaattgcttgaacttgggaggcggaggttgcagttagccgagatcgcaccattgcactccagcctgtgcaacaagagtgaaactctgtctcaaaaaaaattaaaaataaataaataaataaataaacctgtatttcctttcctaaacatttgaatcggttgtaaacatttaaaaatcagatttcactaacatctaccgttctggtgtctcttaaaaagcaatcatatttggtaacactgagtcacattctttcatggcattaatcagctggagctgaaggggctagacaggctctggtttgccagttctcaccactccctattgcattacactcacatgcttcgatcttttatatctgcctgactcctgtttagtgtttaggtttgtcttagtttgttacctctgctctaagtagagcttctcaaatatttcttctgcaggacccctaagatacaagagagtgaaccattttcccccaggactcccaaagcagtctaaagtagcctgtcataagccagaaatgtctttgaagtacctattttctttaaaaaatgcaaattttgatttacactgcataatatatttgtgttggttttagcataaaaatgatttatcttcccccaccaaatcttaaaagtaaaattaacactctggaagatgtgccatgtgtattctgtggctccaaatagtcttcaccatatcaccctaggaataatccaatttaaacagcactgtataaaggcatgaggtaaagagagacatggagaaaagacacagagaaagagtcaaaaagaggaaaagaatttgaaaaacaacaagaatgagtctgagtgacaagctttctgtctggtcctcagccaaccctccaggcctggcccagtccagccactgagaagtgtataaacatccctgatatctctggacaggtgttagtgtggcggctcagggtagaaagcaagacccaaaacaggagccaagccaagtaagggagaggtgagggatccagagcagccaagtatggtcagatgagaaagattgtctaggtgtgccaggaaagaggcttggaaaggaaatggaagacttagaaaagggctgatcagcatttgccctttctcccactgagcccattttgtgtcacttcctcttatcactctgcctaagaaaaatgaggtacaagcattaaattgtcctcctttgaagagggaatttcttctccaaaatggctacatctctggtcataccagagcctaaggaggatgagtaccagggcttctttccctgtccaaatgggactctacctattctctccaagacaggaaatacctcaaatccacatccctaacttaggtgagtttcttccacctaccccttttggtaagacaaaaataggtctaactccctccctcctaatctaatattatcagcactgccctgagtgtaccaaagaatatcagagacaggatttggatattttccccctttctctactgtaaaccaggatcaatgtggaatcacaaggatgggaactattcaggaaagggctgggagcacagcccaaagctgaggatcctgggaggaggagaggtttgagaatggagaataatcccagactctgaggtcgtggggacctagccccttcctgcattggttgggatcaggcctaaggaatctctggattccttccccagcatcttgacatcttggattcccaaggtgagagcacctagccattacggtcccgcagttaagctggatcattgtcttcccactgacccccattaaggttatgagggggacctcccttctttcctagatacaaagaggcaaattaaagtctattggagatgagccaaaggcctttctgaggtgatagcaggaaactggaacttatttccagttttgtggtcccaaatgaccttgaggaaatgtgagccccagaaggggaaaggtcagtggagaagaggtcactactggtttggccagattagttagtggagctattctcgttgagctcatttctcttctccatcctctggctggacatgacatacgaggggagatgaagaggacatgcccaccagccccttcttcagtcagaaatctactggtggcctgtttgatttgagtcctggcttgcagattgtgaccttgaactctgctgtaggtggtgtccctttcttgctagttgatggaattgttgatcttcttgctacccaagctgaagcaggttcttggaaacgactggccagatgcctgaggtatctttagtctgcctaggctgaaaataaagtggggaaatccagcgaatggaatgtgttcagccaaagctaggcacatcctgcctttgttctcaggcccatttgaattcttacagatggatcagcataagccctactatgtgagagctagaagggctcccagtggacacatctagtccaaatttatatttcacacatgaggaatactgaggagtggagacatacatgactttctgaagggcacgaagctatggagtggtgaaactaggaccacaaaatagtgtgaaacactgtctcttaaaaaaagtgaattgaggaaaagaactgtctgttccttaccaaattataggtgcccaattaccttattcatctgaccctccaattttctttggtctccactcccaatctaaactacatgttgcttccaggtctgccatttagcctccctcaaaccacttgagtcactgaggctgtctgcagacccctcttaaactgcccacctgagatgggagaaaaatcatgaggctagggatggaacatagcatagagaaaaataggactctttcccttttttttttttgtagaggcagacttagggaagactatgttgccccaagctggtcttgaactactcgcctcaagcaacctcccacctcagcctccaaaagctgtgggattacaggtgggagccaccatgcccaggataggattcttgacagagaacctaccctgcctggggccagtgcagcccaggctgtggacatggcagcaatctgttcaacataagccctatcaggcgagtagtactgggctgagcagcactgtgtaagtcctctgtaaatgtttgcaagcaggcgctgggcacggtggctcacgcctgtaatcccagcactttgggaggccaaggcaggcagatcacaaggtcaggagttcgaaccagcctgaccaacatggtgaaaccccgtctctgctaaaaatataaaaattagctgggcatggtggcgtgcgcctgtaatctcagctactcaggaggctggggcagcagaatcacttgaatccaggaggcagaggttgcagtgagctgagatcgtgccactgcactccagcctgggcaacagagtgagactccatttcaaaaaacaaaacaagacaaaacaaaaaaagtttgcaagtatggcctcaagccctaacctctcaggggttcttccaaagtgaataggagccgtgaccctgtttactaggtcttgggcttcaggcctgcctgatagtacctatggaaagtaggggaaaggttgatggaaacaagtctagctcatgcctggaaccacttcagaatctgggaaagctgctgggtcctgtgtccctggctttgtccagcaaggtcacctgcagacagggcagagtccaagaatagtctgatcttcctgacactttgaagtaatacaactgatctcaagtggtcactccaacctttgtcctcatttccccagtttcatgggaaaaggatgtgtgtgcataggatgtgtgctgcttttccagaatcttctttgttcccactcttttaagttcccaggctgacattgtgggctttatggggtggctatgctcccaacacagacacatatagttgaccaggttaggacttggtgtgtgtatgtagggaacaatgcaaaaggaaaattttcaatagcttttacttttgtttttgctgatctctccctagctataatcacaggctgaagtacagctatgggaaacccgttacaggtcccctatttccttcctgccactcaacacaacacctcaggaggactaaaaaaaaaaacacatcaatcatcataaattgctcaatgactctagaatgttctgtttctattcctgtttccttcactgcttctactcttttcttcttttcttagaggcgggttcttgctttgttgcccaggctggtggtgcaatcatatagctcaccgcagcctcaaactccagggctctagggatcctcctgccttagcctccctagtagctgggactactagggagtgccaccacgctcagctatttgaaatattttaaaatatttttgttgtagagacagggactcgctttgttgcctagactggtctcaaactcctggcttcaagcaatcctcttgcctcagtcttccaaacttctgggattacaggcttgagccatggcacctgccattgcttctatgtaaacactaactaacacacccaaactaggcttttaaggtgctttccctcaatggagtcacagtctttcttcattctttacaatggggtcagacatattcaaccttagattgacagtctctatcacttgatgctgtagggaattcagtcggcctgcctgaatgcagttggggaattttttgaaggttcttctataccccatcttacggctttcaaatgctcagcagggttgctatgatagcatgccttcttattcagttcctattctggacacgcagcttgcccgtgactgttgcatgtcaagtggctggaaccaatcagcttatctaaggcttcctcagaagccaatcagagcctcggaaagtgacctcacccaagggagagctctgtgggcgagaaagcatctctcagatctgtgagtgtccctaagtcactcccttcctccccaccctccttacttcctgtaaaacaacaccacaccgcctacctcccttcccccaaagaaagggagtgagaaaggctaactaaattccacaaagggaagaaccaaaagagaaactgcaactcagccacacactggtttctgtaactggagaacaggatatttagggggacttgctctgcacagacatacctttcaaagtggcatctccagagtctggaagaggagggagtatggtgaataagtcagctcctcctccctcctcatacctggttttcttgcctttccccacaaaaatagctgtaatcattttttgtaaataaggacaagatcaaggtcaagtgtgggaaagacaggacctatgtccttgtgaacatgtgtgaacagacacaatcatgtccttgtggcctgaggaccagaggctcagaagtcagctgtactgcagggggcgtaggctgttctctacaatttactttgcattgccctacagatgaggccttgaatattccttggctgggctcgattgtgaatatgtgtcccaccatgggggtagaagggaagggacaaaggacaagcgggctgtagggctgtaaccctccagtgtgtcacaccagacccggcttagttaagcatttccttcattcctccagccctctgtcaccaggcctcacccacaacagagagacagataaaaacactttatttaaaagtataaaaccaggcttactccttcaaactgctcccacccctaattatctccacaaagagctatataaattgggcaggggtatgtgtacagtcatctcagctctaacaaccccagttcttctttcaattctcctttctcccttcatacaattgagatgtttgtcctttgcactttccccaagatagcaaaggtgatacaaatgtggaaggaggggaagtgtagaaaataaactgtcatcatcctctattcccatctccagggaacagacagattatatgaactctgaccaaatgatttgcttgtctgaagaaacaaataataggtacagttactctctgtatcctaaagaaagacacgagggtccagagtccttcttcagtatatagcctcgtccatattgtcatcactgtcaccaccaaagtcctctccattgtcaaaatatgacatgatgtaatcagtttcctgaaatggaaaaaaaaaaaaaagtaaaagtcaatttggcattcaccttccttcctgtgtaccagacccctttcctctcagtcacaccattccaggcctgagacatctcttccagctgtagtttgtagaaggggggcagatgaagtagagagaagcccctaccctggggggcactatctctgttggcatgccaaccctctgaggagagcaaccctagtataaagagggtaaagggagggggactaaggtggaaggagtccccttcacctcttcatgttcttcttcatcatactcttcttcttcctcctcttccttctcttcttcttcttctttctcctcatcctcctctgaagttacttcttcttccttcttctccagggtctcatgtggggatgaataggaatagaaactcaggttcagttcacagaagggaaaaattgaggcacacatgggccaagagagagggaatggatccagggctcaggaggtctctatgcacacttcctcctcacctctagtttctgtattgtttcctccttatcttctgtggtcttagggggcctcttggggagcagaattgtaatccctggtggagggatcaaaaggtaaaccttcagagagcaaattttgccagctttatagcccatcctcatgcaaagaacatgtcactctgctgccctcatgtggccactatgacatctagcaacaacacttggtagattgggtataggaactgggatggaaggtgagaccagcagcagcctcggccctcaggctgatgaaggaaacctctcttctccctccttttttccagatacactcacgttccttctgtagcttccgcactcggatctttagctcccggggtagacgccgccaatctgggaatagtgggaacgtaaatgtcaataggaccctgcctggggtctccagtgaatactgactggttttaaaggggggtgagggttttaaaggagaggaaggaaggggctgggccaaagttgttcagtggcttggatatctcctgagtagtgggaactatttaatagctttttcaggtagaatctgagaatgtgttggaccataactaaggctctagcttgcagatgctggatcggggaatggggtggggtcatgggcgtggtgggaatagcttgaagcatcccatgcatttgaaagaagggcagtcaatgaaagggcccatcacctaccagggttccaatcgatggcattgtcaatcggacctgacatctgatatttgtctgaataacgctccacatctgaggggtggaagggtcaaagttttatcccttcagagacccagaacaggactgttcctgagagtccagccctctcaatactgaggaattatctgtttccttaccccaaacccagagcccagggggtcagcttcagtgaggaccttatcacttttttttttttttttttttgagacagagtctcgctctgtccctcaggctggagtgcagtggtacaatctcagcttactgcaacctccacctcccaggttcaagcgattctcctgcctcagtctcctgagtagctgggactacaggcacacaccaccacgcctagctaatttttgtatttttagtagagacggggtttcaccatgttggccaggatggtctcaatctcctgacctcgtgatccacccacctcggcctcccaaagtgctgggattacaggcgtgaattactgcgcccggccccttatcactcttctaacctgttccttttccacccaaaattacgattttttttttttcagacagaatctcgcactgtcgcctgggctggagtgcagtggcgtgatctcagcccactgcaacctccgcctcccaagttcaagcaattcttgcctcagcctcccaagcagctgggattagaggcatctgccaccaggcctggctaatttttttgtattttttgtagagacggggtttcactatgttggccaagctggtcttgaactcctgacctcgtgatctgcccacctcagcctcccaaagtgctgggattctaggtgtgagccaccacacctggccttttttttttgagacagaggtttgctgtgtcacccaggctagagtgcagtggcaagatctcagctcactgcaacctccacctcccaggttcaagcgattctcatgcctcagcctcagcctcagcctcccgagtagctgagaccacaggcacacaccactgtgcctggctaatttttatatttttagtagagacagggtttcaccgtattggctaggctggcctcaaactcctggcctcaagtgatccacccatgtcagcctcccaaagtgctggccattacaggcgtaagccaccgcacccggccatgatgattttttttttttctgtcccttagttcaaaggcatggctgtattaagaaatagcgtggtgcagtggaaagtatgctagggaataagaaaccaggatttcagtattctcttgttggttggtgcttataatatccagattgttaaaaattttgctgggcgcagtggctcatgcctgtaatcccagcactttgggaggccaaggcaggagaatctcttgagcccagaagttcaagaccagcctggacaacataaggacaccctatctctattttacaaaaaaataaaaaatatataattttttagaaaatacatccccctacttatacacgtgaaatgggattttaatatttaacctcctgctgtcccaagactatcatgagactcaaaacaaaccatgaatactataatgcatttcagatacaggggtaactattatgatctccccagttagatagtatgcttcctgtgcccctctggcccccagtggtgctgagcacagggcactccccatggaaggcactcagaatatgatgctagcattccaactgacctctcttggggacagctggccggatgaagtaggggagctgcctcatggctcctcgtagctcttgcttcagtgccaggacatattccccttcctcgcctgagggcaaaggtactgggcggaactccaagggctaaagaggcaggggcagtggtcagttcagggagaaaatgctagtacaaatttaggaagacccctcctcccaatttagtctaacactcccactgagcagagggccaaatgacaatcgagggagtaacatattattttgaaagctggggagaagtaaaggtggacacttctttgcctgcaaaacatccctgtgcattgggagtatagagagagggccaaagcgaggatggttttatgatggtccaggaggaattcagaatcatgtacagtcagccaggggcacatgagagtctgggaagggagtggagagactcacagggaagagtggagaaggctgcagggtgggtgggggcaaagcatcccctttcccaatgcccacggcctccacgttgaaggtcaactggccccggccacgaccccggcccccaccccggctggccatggtggagggggcctgggtattcagagatccagtgaataaacctaataaagacaaaaacaaagagaaaaagaaatgtagtagaatggacaggaagccaaggaggtacaagacattcaatcttttatctctgggacatgaaaagttaatgtcattcaacaaattttgactgagaaggcacagtgtcagagagagaatttctggaaatataaacatgaatgagacatggtcccccaaacaggtcagataattacaatatagtttagcacaaaggagaaagtgctgacacctttggacaaaactctacatccctaagacaatttgatgtttatctctatctgcatttctttatttttatttttagagatgctctgtcacccaggcttgagtgcaatggtgcaatcacagttcactctagcctcgaacccctgggctcaagatcctcctgcctcagcctcccaaagtgctgggattacaggcatgaaccactatgcccagccacaaactgcatttctacatataacctttgaattctttctatctctggccttccaaacctgaccaggccccaattcaatccaatgcaatgcattcggcgaaacatttattaatcgtctaccatgaaaaagatagtgtgtcaggcactgtgggagcacagggatgagtcatcaatttcattgtaaaccaggggaaaagacacattacaatcaaattgatctttttattttattttatttgagatagggtctctttctgtcatccaggctggagtgccgtggtgtgatcatggctcactgcagcctcaacctcctgggctcaggtgatcctcctgccttagcctcccaagtagctggagctacaggtgtgtgccaccatgcctggctcttttttttttttttttttttttaagagactggatttcattatgtcaagtgatccaactgtctcagcctcccaaagtgctgggattacaggcatgagccaccgcgagaggccaaattgatctttttaaacaccacttggaagcatagaatcttagaattgggaggacccttatagaggtcatctagtctaaacccctcccagtgcaggacttcactctgtaaattgttttgttgttgtttggtgtatgtgtgtgtcttctttttttttttcttgagacagagtctcactttgttgcccaggctggagtgcagcagtgcaatcttggctcactgcaacctctgcctcccaggctcaagtgatcctcctgcctcagcttcctgagtagctgggactacaggcatgtgccaccaagcctggctaatttttgtattttttgtagagacaggatttcgccatgtcacccaggctggtctcgaactcctggactcaaatgatccacctgcttgggcttcccaaagtgctgggattacaggtgtgagtcaccacccctgaccctactttgtgaattgttattcagcttttggtggcatttccctaaagagatggtatccattctccccccaagacagtatattccactgtgatcaacactgatgaatctaaagtttctccttctaccgaattttcactctgtctcttatcatcaatcctgaggaaccagtcagaggcagctaggatgggggaataaaatcaccagatgaaaagaaaacttgagagaaatgatatcccagtagcaatgagcacacctagcacccagatcttggtttctcatacaattttccaataaaaggaaccagggctctctggactactagctgattctaggacagggtaggaaatatacaacatgagtctagagcatcttgaggtgccaaaaagtaaggaggtgctcaaaacaacaaccacactcacatattgatgggttagctgggtgcagcggctcattgctataatcccagcactttgagaggctggagcgggcagatcactcgagccctaggagtttgagaccagtctggacaacagggcaaaacctcgtctttacaaaaaatacaaaaattagccaggcatggtggcatgcacccgtggtcactgggtgatccttccctactgggaaggattgcttgagccggggaggttgatgctgcaatgttatgattgcaccacttgcactccaacctgggtggcagagtaaagactctgtctcaaacaaacgaaaaacaaacaaaaaggagaaaaaacgaaaaaaataaacatattgatgaggctatgtcaaagggacataagagccaactgaaaaagttcccaatggccaaagctgaaacaatttgaggaacaaaataaataaagcagtattagattataaccccaaagtataagataaatatctgtgagtccatagtgatataaataaatgactgaatttatttatatgggggaaaaaagacaaatctctcatgtagaattccaaataaaatatgtagacactccatcctaaaagggagcaggggagcataactccccactttttttttttttttttgagatggagtttcgctcttattgcccaggctggagtacaacggcacgatctcggctcgctgcaacctccacctcccgggttcaagagattctcctgcctcagcctcccaagtagctgggattacaggcatgtgccaccacgcccggctaattttgtatttttagtagagacggggtttctccatgttggtcaggctggtctcaaactcccaacctcaggtgacccacccacctcggcctcccaaagtgctgggattcaggcgtgagccaccgcactggctataacttcccacttcttatgtgtggactgtgtatagggaatttctctctctctctctctctatatatatacacacacacacacacacgtatatatatatatatatattttttttttttttttttttttttttttttgagacagagtctcactctgtcacccaggctggagtgcagtggcgcaatctcagctcactgcaacctctgcctcccgggtgcaagcgactctcctgcctcagcctcctgaatagctgggattacgggcgcacgccactacgcccggctaatttttgtatttttagtagagacggggtttcaccatgttggtcagtctggtcttgaactcctgatctcatgatccgcctgcctcggcctcccaaagtgctgggattacaggcgtgagccactgcacccggccctcattcaataatttaggaaatcaggaggaatatctttacagtggagagaccagaaaaacactacttcaaccagatgaccaaggtcagcatcagtactcataaatcatgttttcggtatgtgcccttaaaattacatgataaaatggtacttcacctctgtgatcatcctcctaaaaacccataaccccacactaataaagagaaaaatatcaaattccagcagaaaggcatcctacaatatacccaactcctcaaaactgtcagtcatcaaaaacagtaaagtctgagaaacccgtcacacttaagaggagcctaaggagacgtgacaactaaatataatgtggaatcctaaatgggattcatgtacagaaaaagagcaataggtaaaaaccaaagaaatgtcaatcaagtatcaaccttagttaataataatgtatcagtattcattcattaattgtaacaaatatacgaatcaattttttttttttttttttttttttgagatggagtttcgctcttgttgcccggctggagtgcaatggcgcgatctcggctcactgcaacttccgcctcccaggttcaagcgattctcctgcctcagcctgctgagtacctgggattacaggcatgcgccaccacgcctggctaattttatactttttttagtacagagggggtttctccatgttggtcaggctggtctccacctcccgaccaggtgatccatccgcctcggcctcccaaagtgctagattacaggcatgagccactgcgcccggcatttttttttttttttttttttttttttttgagatggagtttcgctcttgttgcccggctggagtgcaatggcgcgatctcggctcactgcaacctccgcctcccgggttcaagcgattctcctgcctcagcctcccgagtagttgggattacaggagcccgccaccgtgcccggctaatttgtttttgtatttttagtagagacggggtttcaccatcttggccaggttggtctcgaactcctgacctcgtgatccacccgcctcagcctcccaaagtgctgggattacaggcgtgagtcaccgcggccggccaatctacaatgttaataggggaaactgtgcactgggacaaatgggaactcttggcactatctgctaaatttttccgtaagtcttaaattgttctaaaatatataatctattaattaaaacaaaaacaaaaaacaaaaaaaactcgaggctgggcgtggtggttcacacctgtaatcccagcactctgggaggctggggtgggatgactacttaagtccaggagtttgagaccagccggggcaacatagtgagattccatctctacaaaaaataaaaaaattagccaggcatggtggcacatgccagtagtcccagctacgtgggagactgaggtggaaggatcgcttcagcccgggagataagaggattcagtgagccatgatcatgtcactgcactcaccctgggtgacagagaccttgtctcaaaacaaaaagctaaaacaaaaatcaagtagcaattcaaaattcccaagagattagttggtgaaaaaaatatttaaaaataatatgtagaaggtaatcttctgtcagaaatacatacacacatatgaattaaaaatctgttatagaaggatatgtaccaaaaattaacaacggttaatttgaaggatgagggttttttgaattttttctggtggggagagttgtgtatctttttttttttttttttgagacagagtcttgctctgtcacccaggctggagtggtgcagtggtgcaatctcggctcaccgcagcctccaccttacgggttcaagcaattctcctgcctcagcctcctgagtggctgggattacaggcacccaccaccatgcttagctaatttttgtatttttagtagagagggggttttcccatgttggccaggctggtctcaaactcctgacctcgtgatctgcctgcctcagcctcccaaagtgctgggattacaggcatgagccaccatgcccagccaggttatgtatgctttgtttttttctatactgaatagaatactataacaacattaaaatattaatttaaaaatttttggctgggcatggtggctcatgcctgtaatcccaacactttgggaggccgaggcaggtggatcacaaggtcaagggatcgagaacatcctggtcaacatggcaaaaccccgtctctactaaaatacaaaaattagctgggcatggtggtgtgcgcctgtagtcccagctactcaggaagctgaggcaggagaatcgcttgaacccgggaggtggaggttgcagtgagccgagatggcgccactgcactccagactggcaaaagagcgagactgtgtctcaaaaaaatttttttttaatgggccagttgtggtggttcatggaggtaatttcagcactttgggaggccagggcagaaggatcacttgggcccaggcagtcgaggctgcagtgagctatgatcacaccactgtgcaccagtctgggcaacagagtgagaccgtgtctcaataaatagataaataaaatttaaatgtcgtaacagaatactaaatgagattaataatctgtagctaggagagggtagaaaaatgtatatctgaggaatctgggaagtttcaagcccaactgccataaaaaaaattgaggaaacaatggctgttggttaagatatcaaattgcaatctgtttgaaaagagcatattaagggagagaagatgtctcatggagactagagaaataataagaatttgttggctgggcgtggtggctcatgcttgtaatcccagcactttaggaggctgaggtgggcggatcacgaggtcaggagttcaagaccagcctgaccaacaaagtgaaaccccgtctctactaaaaatacaaaaaattagccaggcgtggtggtgcacgcctgtaatcccagctactcaggaggccgaggcaggagaataacttgaaatcaggaggcagaggttgcagtgagccaagattgtgccactgcactccagcctgggcaacagagcgagactctgtctcaaaaaaaaaaaaaaaagaatttgtcaccgtgtcttcagccccttttaagcgagagaacattctaaccagctggttaagtatctttccacttgacagatatagttctggcagtggagataggagctgctgtgactgcaaagcaatgaagagtcaataaatggccatgagtttgaggttagacaaattccacaccatttctacacattaaatgagtgatcctctaagaatgcaggggaaaaagaagacaaaattttatttaatacaggttgggaaataaaccatccatctgccccattcatcttaggaatctatagggagtctctgctattaaagattgtgatggagttaaaattcttgaggatacttaaggtctcccataatctagtcacaatctgctcctccttaacatcaacctttccagagagtttacccctgtactctgttttactccaaacaacactcatatacactatgctcattcccaattattcatacatatatattgtggtggaagttactgagaggcaggtttcaactaaacatacagaaaaacactaacaattacatcaaatttaaggaaggcagtacatgtagaggttaagaatatggttttgaatcccagttcaatttcctagctacaaaactctggtaatttatttattgtctctaaacctgtttcctcatctgtaaaatgggaataaaaataacaataatagaatcatttcactcaacaaatatttactgagtgcttactaggtgtgccaggcactgttctagattctatggatatagcagtgtgcaaaacagacaaaaacatgctgcacccacggggtttaaatggagctttcattccagtggaggcatcagcaaacaaacaatacttcaagccatgagactaggtgagacccctaaaggagtggatgtggacagagaaaataagaaatccaggcactgaggcctggggcacgctgatgtgtagaatttgctatacatgtaataaataaagcaagaaattaacacccttaaaatcttggaaatccaaattttaaaaaatcatctcaatagaaaaaatgggcaaaggacatgaacaggcaactggcaaagagaatggccatgtctggacatggtggctcactcctgtaatccagggttttgggaggccgaggtggacagatcacttgaggccaggagttcatgaccagcctgggcaacatagagaaaccctgtctctactaaaaatacaaaaaattagccaggcacagtggtacacacctttaattccagctactcaggaggctgaggcatgagactcacttgaacacaggaggtggaggttgcagtgagctgagatctcaccactgcactccagcttgggcaacagagcaagactgtctcaaaaaaaaaaaaaaggagagagaatggccaataaaaccactcttcacctatgaaagtgacaaagatttaaataataagcaggctgtcatgagttttttttcaaatggacactctcatacctcactggaaagactataaacataatatttcaaggggagcaatttgtccagttaaatcaacagcctttgaaatgtttatatccctaatccagcaatcccactttaaaaatatattccaaagacatcaacagatatacagtcacagatataagtaaaaggatattcatcaaagagctatttatggtagcaaaaattctgaaataactgaaacaatctaacaataaatgaatggttaaaaaatacccattttatttatttatgttctttttattttattattttttttttgagacagtttcactcttgtcgtccaggctggagtgcaatggcgcaatctcagctcaccgcaacctccacctcctgggttcaagtgattctcctgcctcagccccccgagtagctgggattacaggcatgcgccaccatgcctggctaattttttttgtagttttagtagagatggggtttctccatgttggtcaggctggtcttgtactcctgacttcgtgatccacccgccttggcctcacaaagtgctgggattacaggcatgagccatcacgcccggcctcttttttttttttttttttttgagacaggttcttgctctgtcgcttaggctgaagtgcagtgcagtggcaattttggctcactgcagcctcgacttctccagctcaagcaaccctccacctcagcctcctgagcagctggaactacaggcctgagacaccatgcttggctattttttttgtagtttttgtagagacagggttttgtcatgttgcctagactggtcttgaactcctgggctaaagtgatctgcctacctcagcctcccaaagtgctggaattacaggcatgagccaccacgcccagccagaaatggcttgcttttaagaatgctaccaattccactgtaaaaggacagatttcctttttttttttttttttttttttttgagagggagttttgctcttgttgcccaggctggagtgcaatggtgcgatctgagctcactgcaacctccgcctcctgggttctaatgattctcctgcctcagcctccccagtagctgggattacaggcatgcgccaacacgcccagctaatttttgtatttttagtagagacagagtttctccacgttggtcaggctggtctccaactcccgacctcaggcgatctgcccgcctcggcctcccaaagtgctgggattacaggcatgagccaccgtgcccagccatatttccctcttttacagtggaagtgtggaatgcatttcctttagctatatatttcttatttagaatatttgtaggatattgactaaagaacaggtatcaaaaaattgaatgatctacaagagagataagagagttcccttactaaagatgtttacatagaagctgggtaaaaatttactacatagggtttgtaagaaggatgcatggctctagtagaggattccctatgatcagcatgatttagcattgtgtctggcatatagtaggtgctcaataaatatttattgaatgaataaatacatcatttctatgggcctttccaaacttgagaaattgtgatccataaagcctcccctcaccattccagttctccttgctttcttccttctctagattgtagaaacaattatgaaacactaatattatgaaccactaatttaatggctcttaattacatactgtattgtcttttattgttccctagttatgttaggagtttaaattctgcctccccaaaaagagtgctagttaccagaaatcaattctatttaactaacgtttattgggcactatatattaactactagcacctgtcctacaaaaccttctattctaaaaggcatagaaacgttaaagagagacagtgcactaagtgtcctaataaaggtatatacaaaacgctatcgtagacgggggaacaattcattttgcaagaaaggcggcccaggaaaactacaggtagcatttcagctagtcttcatagataacaggagtttgtcaggctcttgggataatattaatagattagggggaagttgatgctatagcaaagacagatacaagaggctgtctcgttttctgctttaatgtctctccccatgcgcgatagaaaactgccattctctagtatacaatcaatacagaaatggaagcccaggggagaaacggtagggagccagaagggggctgatccaacaacctgacggaaagcgttgtctatttcgcagcctggccggggtgaacaagtttggcaagtgtcggaccgaaccaggtcaagccttacctgctgcccctccccaaagcggagcccaagccgcgaccaacttgaaatgtactgggcttcctcaagtcggtggcgttctaagcccgcctcccggagctccctattggtgagttttctcggccaatgcaggagaagccgaggagggaagtccgccctcttgaagcctaggaagagaaggagggagggagcgagtacgcccggaaccgaagcttgcgaagcgggtcgcagagagagatgggcgttgcagaatcagctggggtcacttatttccggtctcactccagatgaaggagccactagccggcgagagttcaccgagggaacgtgacactcatatctcatcgagggaccgtgttgagggagcccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaaggtgggcagagggttcaagaaaggaaggatttgggatcagcgtaccagggttggggagacagggcaggagcccagctttttctgcattttccactactttccacttcctgcgagctccttgggaaagccagcagagtggaaggaggagtcctattttcacagaaagcagaaacaagggagaaaggttcagaatggagatgaaatctaggagttagtcaagaagaacatcccagatgtcagagaaaatggcctgtagactgggaggctgtaggtgtagtggcaagcgcccagtctttgccataggacagaaacatagctgtgaagctttggagagcttgcttaaccttattaagtctgtttcctcatctgtaacaagaagatgatagttcctatcttataaagttgtgaggattgaaaatagtgtatgtaaagcacatggcacatagttgacacgtgtccaagaaataactagtaaaaatgggtagcttcctgcaaatatttctctctctctcccatccccgggaacattattttcagtatcttgcatctggggggcctccagcctctgaattagctcaggaccctgagtgaactttttaaatccttaggatttttctttttctcccacttcccttggtgccttacagctggacacaaactcattcctaaaatatgtggatggaagctatggtaaccatggagacagggcaggtggcaaggagaggcagagacagtgtgagagaccaatagacagataggaagagagaagatataaggaatgtttcagacagagatcgtcaagcaagatggaaaaaataagacgtctaagcaagactgagattaaagagatgcaatgtgagagagtgtattacaaggttcgctcttcttcctgcccctgtcctatctccctgcccacaataatacggggtggaggcacctggaatgtcccttgccttatctaaaagtgctcccatatccaccttcctcatacttatctaagaggtctacataagggagctgaggtccaagtttctctgcgatgggtgttccgtttttgagagatggggcgggggtgtatctgtgtctgactccaggctggaccgtgatctccttcacaattaaactacaggaagaaagccacatctcttgcctctctttgcacagtatggacaccggctgtggatccaaaaagcctttctacacctttcttacacagtgtgccatgtgccgtgtatggcaggtcaggtctggcgcacaggagcgcacaaacacaccaagtgcggagaatggggatctgctgaatctcagcgaagaatctggatgatggtccctgtctgggtcgcggaggagtcccctaaggaacacttaggtttgttggggctgaggggaggtcggctgagaaaaggaagtcaggattggagcctctaggtttttgagggtttatgtgtgcatgagtgggggagcagtttggtgcctgacgcccccacccgcagtgactaggctataaatagcacagcagagctccgccccccccccccccccccccgccaagcttctctcctcccgagccggcgctgtgcccggggcgctccgggaggagggaccaggatccggcgccggggcgcagatactgacaccaagggaatccgggtgccccccccccccacgccatgcgggcccccaggaaactggctccgccacctcggctgccccgtggccacggccccaatcctggccaggcggagattctgcggacattcaggtatctatctgggcacacagcctgggaggggaaagagcaaggagtgatggggaacatcgcaggggcaatagaaccccccaattctccctccacccgttttaggtctcaaatgcaggctgcttccctccccccactcaatttttggggttgtggcaagctaaaacaggttaggaatgagaatacatgtgtgactgtagggtgcatgtatgtgggtgggtggcgttcagcatcctagaaagggggatcccaagtgtggataagacaagggggacagaggaaaggtctgataagccatggggtgagggtgggggtgcggacatccctgcgcgtgcacgaacgcatttgcacgcgcgctagtccttcagtgcgggtgcacccttcccacctcctcaggcatgcgctgcgggggaagggccggctcaaaggcatgagttagaggaaggactgtatgccgtgaaggtctcctccaccccacgctgggtccctgcatctgtgcctcagttttcctgccgaatctatcaatgagatgtctctcttgcagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagacccctcagtccgagatcacgcgggcgcctcggctcttgtccacgccctggaccgcggggaccgcgagacccttgccacactgctggacgcctgcaaggccaagggtacggaggtcatcatcatcaccaccgatacctcgccctcaggcaccaagaagacccggcagtatctcaattctccaccatccccaggggtggaggaccctgctcccgcctctcctagcccggggttctgcacgtcgccttcggaaatccaactgcagaccgctggaggaggagggcgtgggatgttatcccctcgcgcccaggaagaagaggagaagcgggacgtatttgaattccctcttcctaagccccccgatgacccatccccttccgagccgctccccaaaccaccacgccatcccccaaaaccactcaaaaggctcaactccgagccctggggcctagtggcccctcctcaaccagtcccacccactgaagggagaccggggatcgagcgcttgactgccgaattcaatggcctgaccctgaccggtcgaccccgtctttcccgacgtcacagcaccgaaggccctgaggacccgcccccatgggcggagaaagtgactagcgggggtcctctctctcgccgaaacacagcaccagaagctcaggagtctggtcccccttcagggctgaggcagaaactgagccgcatggagccagtggagctggacacccctggacacctttgccctgactcgcctgagtccagccgcctgtccctggagcgccgccgatacagcgcctccccgttgaccctccctccagccggctcggctccctctccgcgccagtcccaggagagtctgccaggggcagtatctccgctaagcggaaggaggcggagtccggggctgctggagcggaggggctcggggacgttgctcctggaccacatctcgcaaacgcggccgggtttcctaccccctctcaacgtcagtccccaccctcccatccctgacattcgcccacaacccggaggtcgggcgccttcgttgcctgcccctccttatgccggggcgccaggctctcccaggaccaagcgcaaattggtgagacgccactccatgcagactgagcagatccgcctgctggggggcttccagagtctaggtgggcctggggagccagggcgctgagaggagtgagaggagccaaggagggtggggattaggaccttaatgggataggtgggagaaccagctcacacacacaccacgaacaaagggatctcttgcatgtgctcatgggtgcacagtgcacccacacatggttaaacatgtgtccataagcacagtactcttattagcaagaaagaataagtactctatttactgggtatatacacacatgtattcatgccctggtcatttcacatgcatatgggattacttgtgtacctacaggcacagcatatcaataaacacacagggctagggtcccaaactctcttgcatttgttcagaagcagtagggaacccttacttatgggcagtctccgatgtctttgccctcctgcagaagcaatcccttgctttccatgtatgccctgaaacacagcctatcatgattttgcacactctctccgtggacatcccagcccattctgcaggtcttgcttctttctccaggcctggctccttattcacaccctgcttctaaccccaaccacttttcaggatatctttttcactcttcttgggggttcctgcagcaacccccagcctcagttctgctgctgtctttactgctctcaacttcacttctcaacttcctgctttttattcccaccctgttcctccaacaactacaacagattgtctcattttcccagggggtgggtcatgggctctaagctgctcttctgtctgtctgagcttatgaacacccccacaggtagaagtggggagaaaccctaaatcactcctctctccacttgacatatcaaataaatgtgttcagaagtctctgttttgtcacttctgcctggaggtgtgggtatggggaatgaggaatggggagggagggtaacactaacttatagctataattatccaagggatacttagctgttccagccaccttctttccaagaaaccaacttttctatagagaaaaggcaagtgtcctgtgtcctgaagattttaaggcatttgacaggatttcatttcctccagtttcctctatgtccaaccttgaattctttaaggttcctacaaagagttcctccctccatcatcagcagatatatcccagtagattaactgtctccttttgaaacttcctatttcttgactactcacagtttttattcagggtctaattttcatttcaccaagtgtgtttcttctattttcttctacttctggcctctatttccccatctttgatttctgagccactgtaggagagatggggggaagcagttaatataatctcacctaagcaaaaatggcctggtgaccacatgataaagggtatgtagagtgtgtgtgtgtgcatgtgtgcaagtgtgtgtgtgtgcaaagtaatcagaggaacccagtctgacatattataccaacaagggtaattttcttaattcccccaactggacttctcagtttgctaattttctgcatgtatcctaactctttctcactctaatgggaggcaaagagacttgcccatcccactctctcttattcccttcctctacttagaataagtgaactcagaaatttacccaacaatgtggcatagtaaaaagataaaaatattgggaatcagaacacctatgcttaaactctgaattccactttgccatctcttagctatttaattttggccatttttctagcttccctcagcatctgtttccttatccctaaaataacaaaatctagttagtgattgtgattgtaaataagacatgcactacagtacattgcatagtttatgttcattaaatgtcagtatctttcttgccttagctccaccaccaattgcatatgatgttggacaagtcgaattacttctctgagccacaatatcctcacctgcaatctgtgaaatgaaatggtaggacaaaatgatctctactctgtctgcaatcctccccaatcttgcatctaggcccatttttttcttcaagcccagccccaagattctgtcctgctttctagtgcttgccacaggactcccaaagacgcgccgaagctctgcgtctgcctttcagaggatacgctttttctctttgcaattggttctgagaatccccaccctcctcaataatttgcctatggcggagcaggagccctccagctcccgccccatcactggtgattggcatgggacctagctcgtccccgcccccacttgactgaaggttcggccctggcaccgccctgagtccccaggcgctagctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgaggtgagtctgcgggtctggcctcctgcgcgacaccctctgtaagggagccttgctcccacagtcctccggatcgcttttcctggcgtggagccctcacatgcatttccttttggggagtttccttctgggctacgcacacgcacagacgcacacactcatacacacgtttaagcctcctacctcctcccctttactgagttattaatatattctccagggactctttttcagatacaatcctcttttcttcctaagcttttctcctttagaaatggaattcctcctccagcttaataccttaacatctctctgcctttgagaaccagtcctcattgtgtgggatcctgtcttttatttcagatccaatttctcatccataccctctcagtctttcctctgtgatctctgcaattcctggactcacctgttaatttgctccagccccttaaccttgactgttaaattctttacttacttaccttcactctgaaatttcagtgcaacttcagatttactggggaactaggtagtgccttcacaagtcactcatagtaattgtgtatttaaatccggacctgtaccactgaactcacagcagcttcctgtggctcagtaccttactttggtatcttttttagtatggagactcacaactccagcctttctgtctggctgtgttttcctggcccttgcccaggaactgaggataaatcccaggccttggctctttcaatgttaaattctgtggaaatgtgccaggttagaaactctatttcagttagaaaacttcgttaatttctggaaagagggatgtgagggttttctttgttgttttcgtttaactagggtagtttcctgtctgagtttgagttccagatttatagtgtaagtaataaggaatatatagtgaagggtgtggaatacagaatttaagcctggaatttacaagacatcccttctgtctgcttggccaggtcctgcctgacctggaagtgactatatctttaactttctgtttaacaataatacagagaaaagttacagggcttttctgtagattttctttttttaagaaagtttagtgaaaagagcacacacaggctttggagatctttgtcacttaccagccaaatctttggggaagggacttaatttcactgagcttcagtttcttcaagggttacaatatggattgactgagacattgcaaatgacatataacctaaaaatgattattatctcaaatttgttggttcatagttccttaagtagaacatgcttcactttttcccactcttaaatcctaataatgtaaacccaaaaattcctatgaaaacagatttttagagccattttgctatatgtgcctaatgattcattcatcatcaatttccctttgttcttcatacaatttgaactcctattataagacaggaactctgctaggtgctggggatacaaatggatgaatctgaaactcatgaggaaatactatttttccaatgtaatcccaagatttaacaaggctatgtgatggaactgctattagctactatcctgctgcttcaagtctctaagtcaagatcaagggaaggtctttgcctctgggcacaggagtagcctagagtggtcacactaaatctgaagccttcctcttggcaacttacaggcatttattaaaattatagaagagtacaccctttttcttgtctgtgttacctggagagcctctgctttggctcccaaactggacatcctgtaaaaacttccatttccttagcaaggatgagggaacaaggggattgtactgacaaagggcaattaatcaggcttcacacttcgtggtgattttctttcctatctccccacctcccatcgcagtctttctcattattcttgagtttctcatttccagtctgagtgtccagccagtactttaggaaagtctggcagatagttcagcttcaggcaagcagaatctctgcccatttggctcagaagtcctttaccacatggaatcacttattctgcttcaattcttaggcaaagctgccactggcatatattcacatacccttgtgactgatggcatgttatttgggggaatggctgtattcccctgaatacaatttactttagcctctgcctagacaattcattccctcatccagcaatgctttaccacatcatcttcaattaacatccttcatcttcttcctgaatgctccaaatccaccttttccaatcagtctttagatctaccttcactcatgtgggctatcagtatgtatgtatatatgtatgtatgtatgtatttacttatttattttaaaaagctttcctgtcctttatctgcctccctcacccacttacccaagatacacacacagctcagtattctgtaggatcttgataagtttgtagtgcatgggatttgtaatcagaggacctagccctgtcaaatagttggctgtgtgatcttggagaagttgcttaatctctctatgcttcatctgttctcttcattcatttaccaaatatttattgatcaccagatgcagtggtggacaaggcagatatttagtccctatcttgatggagctcacagtttacattacagagcatgtataaagattaatggtgtagtaaagcaggccagcccaatacaaagagggttgactttggagccaaacaaacattgtttctaaatcctggttctgccacttctggcctgttccttaacttgcttactttttgtaaaatgggtattataatacttatcctgatagttttgtgtggattaaataagacaacgaatataaagcatgcagcacctggtactcagtatggttgctactattgtgcatttggaaatgctttggaaactgcaaatgataggtactgttctgcattgccatttcctttgcaccctttttttctatggcatatagtctctttctcatgtttgacatctggcaatctctaaactggcaggatcgagtaactcactttccttgctctgtaattgctacatttccctcttcaaacctgttgttttggaagtattgctatccttttatgttacaatatggctgcatgattggagattttgccctgttatttcactaagttgaacaaatgaatcttgtgtagtattttctatttagttgttccttttcctcagaatcacagatagcttcttttctgtaagactgaagttaaatgggttgggctgaatatttccaatttttggaaatgctggattagttcctatattagtttcctgtggctgctgtaacaaattatcacaactttagtggcttaaaccaacagaaatttgttctctcatagttctggaggccagaagtccaaaatcagtattactgggccaaaatcaaggtgttggcagggccgtgctccctccagaagctctaggggagaattcattccttgcctcttccagcttctggtggctgctgacattggtttattacgtggtttattgctgtatcactataatctctgcctccgtgactcctcctcttcatcaaatatgcctcctttttttttttttaagaaatggaatctcgctgtgttgcctaggctggactgcagtggtgcaatcatagctcaccgcagcctggaactgctgggctccagtgatcctcccacccgcctcagcctcccaagtagctagactacaggtgcatgtcaccacacctggctgattttaaaaaatttttttgtagagatgagatcccacagtgttgcccaggctgatcttgaactcctggcctcaagtgatcatcctgctttggcctcccaaagtgctggaattataggcatgagtcagtgtgcccatcctgcctccctcttataaggacacttgtgaatgcacttagggcccacctatataatctaggtcatctccccatctcagatcatttaaactcatctgcaaagtctttgccagataatgtcacattcacaggttccaaggattaagacatggacattttggcaggtggcattattcagtctaccagagtcccctcccaaagtcactgttactttgcagtctctccttccaaagagactgtggatcgtgggctatttaggggcagatgtaccttctaaacattgaaataggaaatagatgaactattgttaactagcttccctatcttccataataatgtgaatagagtcagtctattctcgccatcctctatgatcaaggagaatctttttactcacctcttaacttcattatctctttattcctgcttccccaccacaaagttgtatttattacttttttcttttatttttgttaattaccttcctggcaaggttgtatttatccttatgatataaaatttttactgtagtttcatatattgttttaatatttttatcctggccaggcacaatggctcatgcctgtaatcccagcattttggaggccagcgcaggaggattgcttgaaccttagggtttgagaccagcctgggcaacatagtgagaccccatctctacaaaaaaatttttttgaattatccaggcatggtggcatgcatcttgtagtcccagccactcagggagctgaggtgggaggatcacttgaacccaggaagtcaaggctgcagtgaggtgtgattgtgccactgaattctagcttcagcgatagagcgagaccttgcctcaaaaaaaaaaaatgttttaggttaggtgcggtgactcacacctgtaatcccagcactttgggaggctgaggtgggaggatcatctgaagtcaggagttcaagaccagcctggccaacatggcgaaaccccgtctctactaaaaatacaaaaattagctgggtgtggtggcgtgcgcctgtaatcccagctactcgggaggctgagcaggagaattgcttgaaccttggaggtggaggttgccgtgagccaagatcatgctactgcactccagcctgggcgacagagcaagactttgtctcaaaaaaaaaaaaaagtttttattttggctgaaaatgatcactacctctcattcccatcctgtccacttagacattcgtatattttatctcctaaaggcaaaaactaaattattctcttttttgttattcaacagcagggtataagcactgaaatattcctatcttggtctttcttgtgagagactttgagaaaacaattatcagatgtgtatatctcagttcttcctaccctcccacctcactgttctttagccatccttatgtaaaccattatatccatggttcctcattgaaaatatgatacaaaatttgggtgctccacatatacccatgcacaaatactcatatgcatacagacacacacataattttacttaacagttttaggaagcttgtgaacctccatgaagctcagctgtggactggaccttggagcctgtgttaagattcccaaattggaaagaatattggcccccggaaatctagattcatgccccaactctgccatagctatgtgacctcaaacaagtcttctgttctttcttagccagcattggactagatgatctctaaagttccttccagccctaaaaatgaataagtctagaagcattttcaaatgcggatcacaattagttgcttttttcttgaccactttgcccaattatcatttcatactcacatttctaaaatcaagactccccatgtcccttggccttgagtaatcattaaaaaatgattctctagtctgtgcaaaggaatgtttaactggatagagactgaacatatgctttttaataggaccttcccaattatggtggtctcctcctcttcctctttattccagtattctccctgttgtgtgcatgtcaagagagctgtcacccagtgcattgtgctaaactgtctcaaagagggaactggagctgaaaagatctcacggaaagaacaaagatggctgagctttctggtcagtattgacctttgaagagccctgccaaaaccaatagaaggaaagagagttttcttttcatgctggatctttttttaaattttaattttaattttttttgcccatgacagagcctcaggaggtcctaatgacatgtgccctcatgctgtcttttaatagaagaatgagcattcttaaaagtcagttaaatgtaggttattaaaaagagtttatgctgcttctccaactcaggctagtacatgggtgtttgtttcagtcacagagcaggcgagataatttattattggccactgatttcaaattccttgcttgctgggcgcggtggctcacgcctgtaatcccggcagtttgggaggccgaggcaggtggatcacctaaggtcaggagtttgagaccagcctgaccaatatggtgaaaccgtgtctctactaaaaatacaaaaattagccaggcgtggcggcatgtgcctataatcccagctactcaagaggctgagacagaagaattgcttgaacctgggaggtagaggttgcagtgagccaagattgcgccactgcactccagcctgggaaacagagggagactccaactcaaaaataaaataaattccttgcttgcaggaactgtgagttattcttttcatgctcaatgcttagaatgatgccatgtacctattaagtgctcaaagttttgctaacgtgtatatgacagccatgaaaatgtgcagttctcattgcctgctgcagggagcataactaacagcctcagccactgcccactctgggtcatccataaccacatttgcaccacaaagtcgcacattcgcatccataaccacatttgaaggaaccacgcttcctgtaggctgctcccagccaatgacctagcacatcaggggtattaacacaggcagatcctggtgagatatgggattcctttggcatgaggacttctcactgacttagccaaatctttcttaaaactgtactacagccgggcgtggtggcttgcgcctgtaatcccagcactttgggaggccgaggcgggcggatcatgaggtcaggagatcaagatcatcctggctaacacggtgaaaccctgtctctactaaaaatacaaaaaattagccgggcgtggtggtagtcccagctactcaggaggctgaggcaggagaatgacatgaacccgggaggtggagcttgcagtgagctgagatcacgccactgcactccggtctgggcgacagagtgagaatctgtttagaaaaacaacaacaacaacaacaacaacaacaaaaactgtactacagtctgagattgtcatatctagacctccttctttccctctcttccacaggcatgagatctttgctgtgctcagaaggctctccctgttgtctcctacttcctccctgataaatctcttgcaattgtctatcccatcttggtgtcttcttggcagatctgaactaaggaaatatgaaagaacgaatgagactttgttgcgattaagagtagaagaggagaggccagacgtggtggctcacgcctgtaatcccagcactttggggggccaaggtggaggaggagcactttgggaggccgcttgagctcaggagtttgagaccagcctgggcaatgtagtgaaactctgtctctacaaaaattacaaaaattagacgggcgtggtggcatgcacctgtggtcccagctactcagaggctaaggttggaggatcgcctgggcctgggaggtggaggttgcagtgagctgagatcgctccactgcactccagcctgggcaacagagtgagattctgtctcaaaaaaaaaaaaaaaaggagagtggtcagtatgttgcaagatatttcagagcacctgggataatttattattatgaggctttagctaaaactatttgaaatgtttggaaccctagagccaatgtgatcctttctaaaagcaaactgatctcatccctccttttttttttaattagttatttttccttggagctgagttagaaagactcccttctttttaaagtcctccaattgcttcctattgctctaggataaagccaatactctaacatggcctaaaaggccctacttggtctggtccctgcctcctcttgcaacctcatcttgcattacacttcccctccctcactctttcatagccatatggtcttaattccctttattcatcatgttccctgccgtcatgagcctttgaacatgctgttccttacgcacagaacactgtcctctcacctcttgcctagtgaattcctagtcatacctaaacttagatattgcctcctcagggtagctttctttgaccttcttaactaggtcagatacgccgacatctatcactcctttatagaacttgatcacagctgcaattttacatttgtttgagatttggttaatatctctttccctctttacactgtaggctacataaggaaaacgtagggatgagaggaagttttctagaatacaatgtcaggtctggagtttgattttagcctacctacaactaataaattagccatttactgtttcatgggtgctggcagaagtcaagagactttgagatttagagacaaaggaatttattattcatagcacagcaagtagcatgagcatcatgtttatattagttctccttgcctcctcccaagtccaatgcagaggactcaggtggatacttgcataggccatgggttgcttcacaacagaggaacacttatagaacccacagcttggggaacttgccattttacaacaagctgaagcaagcaagttctttatctgagtgaaggtagtacctcatccctcaatatttcttgctgcaagcacagtcctgaaaaatagcccaagtaaagagcagtcagggatttgcaatcttggtgtacctagcaagatgtgaaggagcatgagagaccgacccatggaggagtgcttctttttaaagtcctccaattgcttcccattgcattgcttcgcatctcaccatatggctcctccaaaaacatttatacccaggtaaagcctcaaaagagttttctctcccacccccatgccctggcttctctcactcgtagtatgtacatagtattctgggttggaaaaggaatctggcaatggatgtgctcactagaagcacaggctcgagaatggttattagggctatatttccttgagccagcagtattgcataaaagaatattcattggaaccaagactacttgagtttgaatactcaaactgctactttctcctggcataaccttgggcaagttatttaacttctctgtacctcatttccctcatctgtaaaatatggatagtaaaaatatctgcttcataaagttgctgtgattaaacacgtaaagcagttacagaaatgggtgacatacagttcaatacatgttagcacttattgtggtggttattatcatcctgggccagctaaccaactgtggaataatctgcttgtatttcatcaggcagtgataatggtctgctgacattgggaactctgccttcaatatttaagttattctaggactaagttaaaatgtgaactattcagattggaggtgggagtgaaaaaaaaatttaaataaaataaaatgtgaaccagaaaagtggtggaggagggcaggcctactctggtctttctaggcaaattaacttaatcacagtctaggtttattaacttaaatgcttttcaatggcgataggtagggagctaaggggcagactcttaatgtaggtacaggttacaggtactgtattgaagtatagcaccacgtggaggtgttctcattcattgctgaacttaagtacttctcttttgtagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccaggtaagagttgtgaggtggcagtagcaaaggtaaatgcttagatgttagtaacggctttctccaccactttggccattaaactgcctgaaatcatatatttgaggacctaaagcaattctggggaaattattctggcaagcatctgaggccaatttgaccatagtagaacctcagtagcatgctttcctttcaaaaactcaaacccattttgaatttgagcagttatgaatatccccttgctcagtatatccgactaccagcatccaacccatgttccaatctggcttcagttattgcattccaactttcttccatctcttattgaggatatagaacaatattccttgcctccagtactttttcgtaggcaattactaaagaaagcaatgttggagttctctaagaggtcaaatcggagggactatgtatgctggaaacagtactcatctaagagttaggagatccaaatttacattcttctgaatatcaatggggcaaatctctgggcctcacttttcccatctataacatgaaggagataggttagattatttctaaagtcttttctactactaacattctacaattatgtgaaatacctatgatgatgaaaagaatggttgccattatgaggtagtagtgaaaaattatggactagtacgaatattctcatcaaagatggattttttacattgcagacagggaggcagccttctgaaatgtcaacttaaaagtctcaaatggaatttagagaaaataataaacacctttgttctgttttccatatggtttgtgaaacccttagacaaggttaaaggccctactgtgtgtctgcatagcaccttgaacttcccctatcatatcacttattacaacatatcataattgtttgtctctcctagtggactatgttccatagaggcaaagattgtgtttgtcttctttctcgttaaatccctaccacccatcttagtgcctagcagatagtaggcaaataatacgtctgttgcatgaatgagtgccattgcagcttagtttctgcctcaaacagaagcagtcctaaggaagcttcatttcaaatcaggtgatgaaattttttcccttagaacttcagtcatttcaggccgggcacagtgactcacacctgtaatcccagcactctgggaggccgaggcgggtggatcacaaggtcaggagtttgagaccagcctgaccaacatggtgaaaccccgtctctactaaaaatacaaaaattagctgggcatggtggtgcacgcctgtaatcccagctacttaggaggctgaggcaggagaattgcttgaactctggaggcggagattgcagtgatctgagattgcaccacggcactctagcctgggcaacagagtgagactctggctcaaaaaaaaaaaaaaaaagaacttcagtcatttcagagaaataactatatacccaagatgacaaatgtttatgctttcacttgtttttttttgtttttttgtttttttgttttttgagatggagtcttgctctgtcacccaggctggagtgcagtggtatgatcttggctcactgcaacctccgcctcctgggctcaagtgattctcctgcctcaccttccccagtagctaggactagaggcgcatgccaccacgcctagctaattttttttttttttttttttttggtatttttagtagagacagggtttcaccatgttagccaggatggtctcaatctcctgaccttgtaatccacccgccttggcctcccaaagtgctgggattacaggtgtgagccactgcgcccagcctgtgctttcacttctaagagaataagatctttccttcttctttttttttttttttttgagatagagtctcgctctgttgcccaggctggagtgcaacagcccgatctcagctcactgcaacctctgcctcccgggttgaagcgattctccctgcctcagcctcccaagtagctgggagtacaggcacctgccaccacgctcagctaattttttgtatttttagtagagatggggtttcgccatgttggccaggctggtctcgaactcctgacctcaagcaatccgcccacctcggcctcccaaggtgctggaattacaggcgtgagccaccgtgcctggctgatctttccttcttcttcccacctcattacattgttgaatgacttgaaaattttatgacaatgcccataactgaaacattatagtaatttgatttctgttatttttggaaagaggagaattgtctttcttggccttttagcctaaacttttttttttttttttttgagacagagtcttgctctgtcgcccaggctggagtgcagtggtgtgatcttgactcactgtaacctccacctcccaggttcaagcagttctccctgcctctgcctccggccaccacacccagctaatttttgtatttttgtattatttcaccatgttggccaggctggtcttgaactcctgacctcaggtgatctgcctgcctcagcttcccaaagtgctgggattacaggtatgagccacttcacccagcttttttttttttttctttcttgagacagggcctcactcttgtcacccagactgaagtacagtggcacaataatggctcactgcagccttaacttcatgggctcaagtgatcctcccacctcagcctcctgaatagctggggccgcaggcatatgccaccatgcctggctaatttttgtatttttggtagatatggagttttgccatgtttcctaggctggtcacaaactcctgagctcaagcaatcctttcacctcagccttccaaagtgctgggattacaggtgtgagccacctcgcccagccaggggcagggtgcaataactgaagctagattagaacatgggctgggtgttgatagtccgatatactgagcaagggcatatccataactgctcaaattcaagatgggtttgagtttatacctctttatccactttggcaggtgaaatttctccctctggttttcttcacagatgactttttaagcaacagcactatagagcaggccagcaagctagtaacagacaaatagaaacagacaaattgaagcactgggaagacttaggacttacttaccaagcctcatatgctgtctcagagagcctgtcagttaatagaaattaggaattattgatattagggatgcttaagtactaaacacatcctggtctacttatttattgtttttttaagacagagttgtgctctgttgcccaggctggagtgcagtggcacaatcatagctcactgcacccttgactcctaggctcaagtgatccttccacctcaacctcctgactagctgggaccacaggtgtgcaccacaaccatgcccagctaatttttaaattttttgtagagttggcatctcactatgttgcccaggctggtctcaaactcctggcctcaagtgatcctcctgccttagcctcccaaagtgctgggattacaggcatgagccaccatgcccaacccctggtctactttttattttaagttttcttttagagacagagtctcactctgtcacccaggctgcagtgtagtggtgtgatcataactcactgcagcctggaactcctggctcaagtgatccttctgcctcagcctcctgagtagctgggactacaggcacgtgtcaccatgcctggctaattttttcttttttttttttggtagagacaggggtcttgctatgttgcccaggttattcttgaattcctgggctcaaatgatcctcctgccttggcctcccaaagtgctgggattacaggtgtgagccaccaagcccggccttggtctacttttaaaaactgcaacatcactttcttcctttcctctaattactcataaatgacatagggcaaagaggcctttgagacagccaataaagatgaattataaaggaatactatggtggctagagatctgaagttgaataattttgagacttctgcagatcagacttgttctatgatacctatgttggatacaatataaaaacatgaattaatttttatttttttccttcttaagtcagctttccttcccttagttactcctctcctctttgtttccactgtggggaaaaaagaagtctataaattccttcttcagacttaaacccttctcagggatagctcctttggctcactacgttatttgagaaaatgcctgctcacagctaaaaatgaagtccgagattccaagatgggtgcttctgatagagaccagtggcctctgtagaagcagcctagacacagctttggttctaatcttgggttatctagaggaatccaaaaaaccttacctgtccgcagaacaagatacagatttctattaagccggccagaatctgacttttgagtaactaattctgtcgacagtttaaacgggtatttttcatgaccagtgattatatgctgacttaagcagccttcctcgttctgcattcagtttggtatgagctacagccctctcccagttccttaatgacttcaggatgttgaatcaaaattatgtttccaaacatcccaaccactttaccataaaaaccttggaaagtgtgttgaacacaactgatttatccaaagagcgtccaagtgttttctatctgaagtgtttccctcccactgttccttcctctctctcatatgcacaaatacacatattctcactctttctcccctgcctagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatgtaagttgtatggagctggaaggaaggagagtgggagatgggagaactggctgcttgggaagtcgtaaattactgtgaaacagagcatgaattcttgttttctttctggtccacctctctgttcttttgatttattctctgtcagtctattgtgtcatgtgctccacctgtcgcagtctctagttctgtatctgtgtttatgtgttttttgttgttttgtctctttcattgtgtctctttggtatctagaaacctttaattgcagatttatggaattgtagagctattccaaaatgaaaattgagcttcaattttgcttttgctaatttgggttaagaccttagtttctgcagttctttttttatgactgttttttattgtcacttgtctcctgcctccattacttcatcttattgataaagaagacttttataacaaaacgtctttttaggaacaaggaggataatttatttactctctttatttacaactgttctttcaaatgatgatgataagaataaccataattagccagacgcggtgtctcacgcctgtaatcccagcactttgggaggccgaggcgggcagatcacgaggttaggagatcgagaccatcctggctaacacggtgaaaccccgtctctacaaaaaataaaaaaaaaatagccgggcatggtggggggcgtctgtagtcccagctgcttgggaggctgaggcaggagaatggcttgaacccgggagacggagtttgtagtgagccgagattgcgccactgtactccagcctgggcgacagagtgagactccatctcaaaaaagaagaataaccataattaatcctaattgagtatttaccttgtggcagggactgttctaggggatttatatgcattttacctcatttgatcatcacaacaatcttatgaggtgtaagtactattattacccctattttacagatgaggagactaaaaacacagaagtggaatgttgcttaacatgatatagctagtaattggtcacgccaagattagaacccaagttgacttaatttaattacatcttagaaattaacaccgccatcttccttcctctccacaaattcattaatagtcagaccaagtatctgttctatttgcatttaattaagatgtaattacaggccaggtgcagtggctcatgcctgtaatcccagcactttgggaggctgaggcaggcggatcatctgaggccaggagtttgaaaccagcctggctaacatggcaaaaccccatctctactaaaaatacaaaagttagctgggcgcagtggtgggcgcctgtaatcccagctactcgggaggccgaggcaggagaattgcttgaacctgggaggcagaggttgcaatgagctgagattgtgccattgtactccagcctgggtaacagagcaagaatccgcctcaaaaaaaaaaaaaaaaagatgtaattacatatactaaattacttcagttatctgctttgtggattagttgttgaatactttattgaaagttggtttccctctgttatttaggacccagctgtttttctcccattattctttgccccagtcaacagcatctgcagggaatgaaaacatttttatattaatccaaaccaaataaaaaaagaaaaagccagctaaaattttttggaaagtacatttgctacttttaggtcgcctaatggtattataaaatgaaacagggcgaggcgcgatggctcacgcttgtaatctcagcacattgtggggtggatgccagcagatcacttgaggtcaggagttcgagaccagcctggccaacatggcaaaaccccatttctactaaaaatagaaaaattggccaggcacggtggctcatgcctgtaatcccagcactttcggaggccgaggtgggcagatcacgaggtcaagagatcaagaccatctggctgacatggtgaaactccgtctctactaaaaaaaaaaaaaaaattagccaggtgtggtggtgcgcgcctgtagtcccagctacttgggaggctgaggcaggagaatcacttgaacctggaaggcagaggttgcagtgagccgagatcacgccattgcactccagcctggtgacagagcgagactgtgtctcacaaaaaaaaaaaaaaaaagaaagaaaaggaaaaaaaaaaagaaataaaaaatacaaaaattagctgggcattgtggcacatgcctgtaatgccagctactcaggaggctgaagaatgagactcgcttgaacctgggagatggaggtgcagtgagctgagatcattccattgcacgccatcctgggcaacaaagtgacaccctgtctcaaaaaaaaaaaaaaatagaaaaggaaaggaaaaaaaaagaaactgtggattatggaaagtaggatgtgcagtatttatctgatcatgggctctaaattcattgttggcgcggtggctcacgcctgtaatcccagcactttaggaggcggagttgggcggattgcctaaggtcaggagttcaagaccagcctggccaacatggtgaaaccctgcctctactaaaaatataaaaattagctgggtgtggtggcgggcgcctgtaattccagctatttgggaggctgaggcaggagactcacttgaaccaggaggcggaggttgcagtgagccgagattgtgctattgcattccagcttgggtgacaagagcaaaattctgtctcaaaaaataaataactaaattcattgttattgaaattatggttctaggccaggtgtggtggctcacgcctgtaatcctagcactttgcggggctgaggcgggcagatcacttgagctcaggagttggagaccagcctgggcagcatggcgaaactccatctctacaaaaaacacaaacagttatctgggtatgggggcatgcatctgtagtcccagctacttgggggtctgagacaggagtatcacttgagtgaggaggtcaaggctgcagtgagccaagattgcactactgcactccagactcagtgacaaagtgagaccctgtctcaaaaaaaaaaaaaaaaaagaaaaagaaaaaagaaagcaattatggttcctggctgggcgctgaggttcatgcctgtaatcccagcactttggaaggctgaggtgagcagatcacctgaggtcaggagttcgagaccagactggccaatgtgttaaaaccccatctctactaaaaaatacaaaaattagccaggcatggtagtgcacacctgtagtcccagctacgtgggaggctgaggtaggaaaatcgcttgaacccaggaggtggaggttgcggtgaactgagatcgcaccactgcactccagcctgggcgacagagtaagacttcatctcaaaaaaaaaaaaaaaaaaattatggttccatagtcttcctttgggatctgtgtgggattggttctaggatctctcgaggacacctaaacccaaggatgctcaagtccttcatataaaatagcacagtacagcctgggcaacataaagagacttcatctctacaaaaaaataataaaataattagccgggtatggaggcacttgactgtgatcccagctacttgggaggctgaggcaagaggatcacttgatcctggggagattgaggctgcagtgaccatccactgtactctagccagggtgacagacagaatgagacacagtctcaaaaaaaaaaaaaaaagtacagtatttgcatataacctatgcacatcctcctgaataaatgctttaaatcatctctagagtacttataatacctaatacatgtaaatgctgggccaggcacagtggcttacgcctgtaatcccagcactttgggaggccaagacaggcagatcacctgaggtcaggggttcaggaccagcctggccaacatggtgaaaccccgtctccactaaaaataaaaaaattagccgggcgtgatggcgcatgcctatagtcctagctactctgcaggctgaggcaggagaatcacttgaacccaggaggcggaggttgcagtgagccgagatcgcaccactgcactccatcctgggcgacagagcaacagaatgagactccgtctcaaaaaaaaaaaaaggaaatttttatttttaatttaaaattttatttaattctcaaaacaatcatttaaggtagctctatgattattcccatcttacagaagaggaaactgaagaacagagaggttaagtgactttaccaaggccacgctatttgtaggagctccagtccatgctcttaacttctatgctgtattggtttttttacatgctaggcttgaatgcaggacagtgtgtcttaattctaaccctgcagggttacataaccaatagaagacacaataggccaatgtccaggagaccacactgctacccagaatttccacacttataccacatttcagaaagtcagtacaaaaatgtaaaatatttcattaataatgtttatactgactacagttgaaaaataatattttgaacatattgggttaaataagatatattattaaaattaattttacttgtttttttttttttctgagacagagtctcactctgttgtccgggctggagtgcagtagcccgatctctgcaatctccgcctcccaggttgaagtgattctcctgcctcagcctcctgagtagctgggatttacaggcacccactaccatgcccggctaatttttgtatttttagtagagacacggtttcaccatgttggccaggctggtctcaaactcctgacctcaagtgatctgcccaccttggcctcccacagtgctgggattacaggcatgagccactgcacctggacttacctctttatttttactttaatgtggcagagaggaaattttgaattaaatatgtggcttgcattatatttctactggacagtgctgcttgagatgataatcctggttgaaaatctatttgtcttttctgttcctctactaccagggcaacagggaggaagctgacaacccaaatacagggattggtgccttccgattcatgctggaatccaacaagggcaaatcaatgttggagttccaggtactttcccatgtacttccctggttctaataacatgggtcagcctgctactgtaatatataatggctcctactaattcctaactcattgatactggaaaagaaagaaggttgttacactatttttcaaaaataaataccttcctggctgggcatggtggctcaggcctgtaatcccagcactttgggaggctgaggcgggtggatcacttgaggccaggagtttgagacatggcaaagccccgtttctactaaaaatacaaaaattagctatgatggcacatgcctgtaatcccagctacttgggaggctgaagcacgagaattgcttgaacccaggaagcagaggttgcagtgagctgagattgcgccactacactccagcctgggtgacagagcaagactctgtctcaaataagtaagtaagtaagtaaataaataaataaataaataaataaataaataaataaatatttttcttccccaaaggcctatcagagttagtgatgagagatgcttctacaaatccattttgtaaaaggtttcccatgtaattctgatgcaacctcccaatataaaaatcactgtcctggtacttcctatcctcttcccccaggagctaatgacagtttttcaactgctacactggaatggcagccttaaggccatgagggaacgacaatgctctcggcaggtaagagattttatgagtgggggcgaatgaggggagcacaatctgtcagtggactcttttgaggtggttactatgttagaaataaggtctattgtgacctatggttgtgaatattgaaagccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggtttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcctggctaatttttatatttttagtagagacagggtttcaccatgttggccaggctgttcttgaactcctgacataaggtaatccacccgcctcagcctcccaaagtgctgggattacaggcgtgaggcactgagcctggcctatttgtggtttttttttggttttgtttttgtttttgtttttgagacggagtcttgctctgtcgcccaggctagagtgcagtggcgcgatctcggctcactgcaacctccgcctcccagattcacaccattctcctgcctcagcctcccgagtagctgggattacaggtgcccaccaccacgcccagctaattttttgtatttttagtagagacggggtttcaccatgttagccaggacggtctccatctcctgacctcgtgatccacctgcctcggcctcccaaactatttgtgtgtttttctttttttttttttttgagacggagtctcgctctgtcgcccaggctggagtgcagtggcgctatctcggctcactgcaagctccgcctcccgggttcacgccactctcctgcctcagcctccttagtagctgggactacaggcgcccgccaccatgcctggctaatttttttgtatttttagtagagacggggtttcaccgtgtttgacaggatggtctcgatttcctgacttcgtgatccgcccgcctcggcctcccaaagtgctgggattacaggcgtgagccaccgcgcccggcactatttgtgtttttaacaccattctcccccacttctctcctgggtgacataagagagaaataacctgtagtacagcagctaaagtattctcctttcagagaatttttttggaggtctcatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtgagccagactgactctttcttgagacctatatattacaaaagtgaaggggtgggttgcccctccacacctgtgggcgtttctcgttaggtggaacaagagacacagagacaaagtatagagaaagaaaactgggcccagctgaccagcgttcagtatacggaggatccacgccagcctctgagttcccttagtatttattgatcattattgggcgtttcccggagagggggatgtggcaggatcataggataatagtggagagaaggtcagcaggtaaacacgtgaacaaaggtctctgcatcataaacaaggtaaagaattaagtgctgtgctttggatatgtatacacataaacatctcaatgccttaaagagcagtattgctgcccgcatgtcccacctccagccctaaggtggctttcccctatctcagtagatggaatatacaatcaggttttacaccgagacattccattgcccagggacgagcaggagacagatgccttcctcttgtctcaaccgcaaggaggtgttacttcctcttttactaatcctcctcagcacagaccctttacgggtgtcgggctgggggacggtcaggtctttcccttcccacgaggccatatctcaggctatcacatggggagaaaccttggacaatacctggctttcctaggcagagatccctgcggccttcctcagtggtttgtgtctctgggtacttgagattaggaagtggtttgagattagggagtggtgatgactcttaacaagcatgctaccttcaagcatttgtttaacaaagcacaccctgcacagcccttaatccatttaaccctgagttgacacagcacgtgtttcagggagcacagggttgggggtagtgttacagattaacagcatctcaatgcagaagaatttttcttagtacagaacaaaatggagcctcctatgtctacttctttctacacagacacagtaacaatctggtctccctttcttttccccacaagaagctctaaaacatccctgttcttttacatatatactaaagaagaatttttaggccaggtgcggtggctcatgcctgtaatcccagcactttgggaggccgaggcgggtggatcacgaggtcaggagttcgagaccagcctggccaccatggtgaaacccccatctctactaaaaaaaattaaaaattagctgggcatggtggtgggcgcctgtaatcccagctacttgggaggctgaggcaggagaattacctgaacccaggaggtggaggttgcagtgagccgagactgagtgattgcactccagcctggacatcagggtgagactctatctcaaaaaaaaaaaaaattttattagcatttttggggtggtagaaatgattgcataaggcagcctgcctccctttctgcagatatttaacctggagtttgtccttggtcttttctcctcaagctctacctactcccactggcaatctcacccattatggtgacttgaactccactatacacatgactctcaaatctatttcttcctccccaacctgttttaagcttttacatttactttccacatacttgacacggccatctgaatatgacaaaagcactttgaaacatatcgaaaataaaaaacatttctccatactcattcctctttgactctctagattattcgaattattattattcttattattattatttttgagacgaagtcttgctcttgtcccccaggctggagtgaaatggcgcgatctcggctcactgcaacctctgcctcctgggttcaagcgattctcctgcctcagccttctgagtagctgggattataggcgcccgccaccacgcccagctaatttttgtatttttagtaaagatggagtttcaccatgttggccaggctggtctcgaactcctgacctcaggtgatccacctgcctgggcctcccaaagtgctgggattacaggcgtaagccaccatgccccgccgatctattattagaattattatctacactgttacctaagccacacacctcagatccaccctcaactcctctaccataatgtaaatatgttgtttttgagacagagttttgctcttgttgcccaggctggagtacaatggtgcagtatcagctcactgcatccactgcctcttgggttcaggagattctcctgcctcagcctcccaagtagctgggattacaggcacccactaccacacgtggcaaatttttttatttttaatagagatggggttttaccatgttggccaggctggtctcgaactcccgacctcaggtgatccgcccgcctcaacctcccaaagtgctgggattacaggtgtgagccactgcgcctggcctacctcctaatatgttttgtccatatttactgcctgagcttaggtttggtcctttctcatctccagactggatcactacaatagcttcctagctggtcttcacctccattcttaacatcctccatactactgtcatatttctttataaaatacttatgactgtgacactcccttgcttaagccatcactgaactatctttacctttagcagcatttcccaaagtttttttttattttttttgagacagggtctcactctaatgagcaggccagaatgcagtggcgtgattttggctcactgcagcctccacctcccaggctcaaggaatcctcccacctcaacctccagagtagctaggtctataggcacacaccaccacacccaagtaattctttttaaattttttgtagaggtggatcttgctgtgttgcccaggctggtattgaactcctgaactcaaactatccacctgcctcggcctcccaaagtgctgggtttacaagcatgagctaccatgcctggcctaccatttcccagttttatatgtgttcctgagatgattttagatgatagatgggcaaacagtttttaatagttgtgcttttatctgaattcgtagtagaaaaatactgattttcctttcagtgtaaatttatgtttaaagtcagtctatttaaggaaaaataataagcaacaactagtatggaggctattttcaaatattaaaaaccatgaatactcaaatatttgaagtaggtaaatttcttgcctataggataaattccaaaatccttagcacagcagaccctaaactgtatttccagctttattttccagtcacatagcatcgggcagacagaatttcctgccattctaatattcattcattcgataagtatctaccaaatgtctaccatgagccagacattgggctaaacttcagggattttagttgtaaataactatctctgctataaggattacattctaacgggaaaaacagacaataaacaagttagaaagtaaacaaggtaattaaagattctgactggcctaagcaacatggcaagactccgtctctacaaaagattttttaaaaattagccgtgtgcagtggcgtgtgcctgtagtcccagatattcgggaggctgaggcaagagaatcacttgggcctgggaggttggctgctgtgagccataattgcaccactgcactcagcctggttgacagagtgagaccttgtcttaaaaaaaaaaaaagaatgaaagaagattctgatttaagttctgtgaaggaaatacacagttaaagacaggagggtagagaagacccctttgggtgacagtactattgagatcttaaaaatgaggtcgaactcggccgggcgcggtggctcacgcctgtaatcccagcactttgggaggccgaggtgggtggatcacaaggtacggagttcaagactagcctggccaatatgctgaaaccccgtctctactaaaaaaattttaaaaagctgggcgtggtggcacgtgcctgtagtcccagctactccggaggctgaggcagaggaatcgcttgaacccagtaagtggaggttacagtgggccgagatcgtgccactgcactccagcctgggtgacagagcgatactccatctcaaaaaaaaaaaaaaaaaaaaaaaaatgaggtcgaacccaatatgtgaaaagctagaggaagagcaccaggaacagaaagctgcggggagcagtggctcatgcctgtaatccaaacactttgggaggccgagaagggcggatgaccggaagtcaggagttagaaaccagcctggccaacatggcgaaaccccgtctccactaaaaatacaaaaattagctaggtgtggtgccgcacgcctgtagtcccagctaatcgggaggctggcgcaggagaagccttgaacccaggagacagaggttgcagtgagccaagatcgcatcactgcactccagcctgagtgacagagtgagactccgtctcaaaaacaaaacaaaccaagttgcaaaagccctgggatgagaaagagcacaccacagttgggcgaaagagcaaggagagcttcatgggttaaggagaagaacggtggttgaacaggttgaaaacacaggcagagcaggctttgtgagtttgaatttttattctaagtgcagcaaaatgccaaggaaagagccgggtgcatggttacacccctgtcgtcccagatgcttgggaggcgagtttcaggccagcctgggtagtataaccaaacccctctaacaaaaagggtttttaggccgggcgcagtggctcacgcctgtaatcccagcactttgggaggtggaggctggtggatcacttgaggtcaggagttcaagaccagcctggccaacatggtgaaatcccgtctctactaaaaatacaaaaattagccgggtgtgtgtgtgtgtgtgggggggggcgcctgtagtcccaggtactcaggaggcttggagggcgcctgtagtcccaggtactcaggaggcttgaggcaggagaattgcttgaacccgggaggcagaggatgcagtgagccgagactgcaccactgcactcttagcctgggtgatagagcgagactacgtctcaaaacaacaacaacaaggatttttagtaggtatgtaaccaactgatttttaaaatgatcacagtacctactgtggagaatgaattagtgtctcctaatcgctttttaaattttatttttcgttttactcttattcactttttttttttttttttgagacagagtctcgctcttgtcccccagactggagtgcagtggcaagatctcggctcgctgcaacctccgtctcccgggttcaactgattctcctgcctcagcctcctaggtagctgggattacaggtgcactccaccacgcccagctaatcagcttccgtttctcgggttcaagcgattctcctgcctcagcctccctagtagctgggattacaggcagggagttttatatttaaaaaaaaaattgatatctgtctcaccaaccgtattgcaaccaagtctgttagtttcctgaagagaaatttggtgctgcaggttccagaagcagctctttatgccctcactgctgatcaaactattttttaaaaacgctcctatcatacaccacgctgcctaaagacaaggtacaggcctgggatttttgaaagaaaagggtttcttcaattaccatttcccagtttgggatgaagagacgtaaagaagccctctaataaggaaattacgccgggcctcactgttaatagtacagtatttatcagcagctgccgcggttaagaggaagccacggccccctgtagtctgtacctcctaagatggatgatttagcttgcgatctgttcaagatggccacagaaacacttccggtatctttccgcactaggcccgccccaatttgcgtgtttttaccgtgcagagggagggatttagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggatgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaacaatgggagaaaggaggagttttcggtgatctcgtgtatgtcccttatagaagaggggtcccgagcgcggatgcgtgaggattatgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgatctggcttgctcttcccctctcagttcattactcaccattttctagtcctcagctttagtagcattgagatcctctatcctccatcctccctagcatttctcctattttaattggtctaacacctatctctgaagaatcaaattttaacatctggaaagcttttcctgactgcacggctgtgtcagacacccctatccactccccacccccattgtcttctttagctcctttagcataacacttttgaatacactatattgtaattgcctaatttctttgtttcttgcagtagtctatacatttcttgaaggcaggattttgctgccctgtccttagcaaaatttgagtggcgctggagatgcatattactttttgaatggataaatgaaatgtaccacaaagttttacccaaaccactgacttcactctcttaatagatccccatgtatgtttttcttccctgccccaatctgaaggaggtgaaattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacctgtgccgtgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcaatagtttactgagaatgatgatttccaatttcatccatgtccctacaaaggacatgaactcatcattttttacggctgcatagtattccatggtgtatatgtgccacattttcttaatccagtctatcattattagacatttgggttggttccaagtctttgctgttgtgaatagtgccgcaataaacatgtgtgcatgtgtctttatagcagcatgatttatagtcctttgggtatatacccagtaatgggatggctgggtcaaatggtatttctagttctagatccctgaggaatcgaaaaggcaggctcttaacagatgtaaattaacatacaaataatcttacagaagagagagcagaggtagcagggtgcggtggctcacgcctgtaatctcagcactttgggaggctgagacaggtggatcatgaggtcaagagatggagaccacctggccaacatggtgaaacctcgcctctactaaaaatacaaaaattagccgggcatggtagcgggcgcctgtagcttctcgggaggctgagggaggagaattgcttgaacccgggaggcggaggttgcagtgagccggcaaaaaaaaaaaaaagcaagcagaggcttactccctgagaattaatggctaatggcccccaagcgcaccctttaactcatgctatggacccaaatccctgtcctgcccggtcctgagtcctaggtcactcacctgggggaaggcaagcaggaaactaagtccccaggctgcccccagaagtttccttacacctgaacgggatccaagcgggttgagtactgctgcctggcggtccaatccaatgaccacaggcaggaaagctgcagaatacgtggccattagtttcaggaacatcagtgtccgacatgcgatgtccacagccagccattgaacagtgatattccaggtggcatctaggggcataaccacaaaagtgactagtaagtcggcggctgctaaatggatgaagagtctcctgaccggagaggggcggagctggctgggttcccgccgtgtcactgaccacaggactgccaggttccctccagccgaagaaacaaacagcacaatggtcactcccactcggaccttggctgctgccgagaaggtgggcagctctgagccctccacctccactcctgatccagcccagacctcctcccccgctgctgaccccaaggggtgccgttgcctgcagacatggtggcctggagagaaactgaggaggatgaagtgtgggtatgaagcggttagctttggccactgattcttcgccctccttttcaggatctggagctgattattgcgaatttcgttcactaaagcctctgcttctggagactctccatctgttctggaggaggtcacttgttcaactgtcaaggttctgcagggaacgaagatctggtaccaatcacgctcctttttccttggacagaccagcctgggcttcaggcctctactgacctagacctctttagcccctacagccctggattcagtcggggcctgcgtgcatgtgtatttgtgaggttctgccaggcgcacacctatgccggcggcctccaagacgtggagatcactgcggcgctttctcgccccgccccggcccctgcaggccccgcccttggtcatgaatatttaaagaagaaggtgccgctggaggcgtgctagggagtaggggtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtaggtgcggcccgaataggaatgggggtggggcgggggagggatggacagaggaagactctagtgaggcgaagtcagtttaggctacaggggggtcaagaagggtcaactccggctacgggggcccgaacggaccgtgaggcgcagatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgacatttggtctggtccctcattttttggtaatttgaggcccctattcctgtcactgtggtttgggtttttctcgggattagccactaacatcacccacattatttttcttgagcacctacagtatgtaaagcaacatacttagtgggcatccaaaaatctaagaagctccacactcccaactttaagaagtttataacctagctgaggagttggggtggcagaggagtggtctaatactaaagttattgtcctggctccacaaagcacatctcataccagttcagatataatccctctaagaagcagaatgccatatgacagcataggctaagagccaaggacagaaccaagtggagtggggctggtaaggatttggagctgtgtcttcacaagttgagactcccctgggtgggtagggaaatgataccactgctatcagctctttcattttccatattccaggttgagataaataaggttaggaagtgaatctatcggccaggcgtggtggctcacgccggtaatcccagcactttgggaggccgaggcaggtggatctcttaaggtcaggagttcaagaccagcctggccaacatggtgaaaccctgcctctactaaaaataaaaaattagccaggcatggtggcatgtgcctgtagtcccagctacctgggaggctgaggcatgagaaatgcttgaacgtgggagacagaggttgcagtgagccaagattgtgccactgcactccagcctgggtgacagagtgagactctgccttaaaaaagaaaaaaaaaaatctgaatctatctcctatctcccagctgggtgcagtggctcactttgggaggctgaggtgggaggattccttgagttcaggagttcaagaccagcctgggtaacatagtgaaaccctgtctgtattctcaatataaataatttgtctaaaacttttaaacaaaagtttaagattcttttcttataaaaaagaatccatctcccactcctgttccaaatttgaggaaagcattattgacctggcaacaataaacagtagaaaaaaagaaatagcagaaatgggcaaaaaaatatgttctctggatatagagatgaggcctccagggggcagcaccaaggcagagaaatagactaagatcgctcagtgttttccttggtctggggctccccacagttccccaccatcactcctcccattccttccaactttatttttagctgccattgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtgagggaagttaacttcttggtttctggtggggatggaagatacatagattgtttggaattgggaccattatagttaaaattctttgggatttaggttaggaagcgaacactggttgtacatttcttgtatgtgtgtctgtgtccttgtgcatttttatgccctcacatatgactgtttgaatattgagactggcaggggctaaagctgcctaggaccttgtgtaagatttgtatctaataattatataatatataattgtataattatatattatatataatatacatataatatataacaattatatattatatataatatacatataatatataacataattatatattatatataatatacatataatatgtaacataattatatattatatataatatacatataatatataacataattatatattatatataatatacatataatatataacataattattatatataatatacatataatatataacataattatatattatatagttatatattgtatataataattattattattttttaaagatagggtctcactttgttgtctaggctggagtgcagtggtgcaaccacagctcagtagttgggactactaggtacgcgccaccacgcacagctaatttttttttttgaaacagggtctcactctgtcattcaagctggagtgcagtggcatgatcatggctcactctagcctcaacctcccaggctgaggtgatccttccaccttagcctcccgagtagctgggactataggcgtgtgctaccacgcctggctaatttttttttttttagagacagagttttgctatgttggccaggctggtctttaactcctggactcaagcaatccgcccccgacagccacccaaagtgccgggattataggcatgagccaccatgcttggctgagatttgtatctaaatatataaaatcttcatcctaagccctataggggtaaggagacaaaaaagaaatgtgatgtgaccttccacgtggctagtctgattcctattatcccctccctaacttcttacccttggtggtccctggggcctgaggcataactgactaactatgtggtcagaactctgggtttatctaaccaatgagctgcagtttctggtcatacagccctgccagttttctggatgcaaaactgctcacatactaaacacctttctgaaaatgagcatggtttgggataaagctatagccattggtaatggtgagggggtagcctgagagggggttgcttagaagtacagagcaagacatagttggggaaaggaccatgggaaggacaagaggcctggaatttttccttggcagtgccctgtaatcattgtttcctaaaataccagctctgattttaaaggcattggggtcaaaagggaagattagctagggtcgggcacctttagaatgggctgaaggctgaggaaaccatggaggtaggtaggggaccagttgggagagtagattagttaaaaaggaagcaggttgtgggaaacttcaggatgatgggacccttggaaaggatggatggcaaactatgtgtgtgggcaggcgagtggccccacccagttaattaccactgagatttccaaggctggaatcaaccagggacctagacattggaaaaagacagtgagagtgtgacaatgacactggaagtcaggaagagatagagaaggagagagccagacatgcagtgctccttagcttcctttcattccccctattttggggagaattggaagcaatggttgttctggggatacagaaaggccctctccctcttttgaccctcacagtttgttgaggagagtgtgtggaaggaatgttgtggaaaagagtagccaggcgcggtggctcacgcctgtaatcccagcactttgggaggccgaggcgggcggatcatgaggtcaggagatcgagaccatcctggctaacacggtgaaactccgtctctactaaaaataagaaaaattagccgggcgaggtggcaggcgcctgtagtgccagctacacgggaggctgaggcaggagaatggcgtgaacccaggggggcggagcctgcagtaagccgagatcacgccactgcactccagcctgggcgacagagagactccgtctcaaaaaaaaaaaaaaaaaaaaaaaaaaaaaaagtaacttgaccttttcagacatgtctgtgaatgaaatttcaggggtgggaatggaaatacagctgtacatcagcatggcagagggccacagtttaggcatctggacacaaacacaggaagggaatcatctttgcctggagctctgagtacatgacactgagagaggccagaaaagcttatgagtgaaaaagcaggcaggcagactgagattaagacgcttcctcacagcttctctcgggctgtgcctctagccattcactacctcatactaacattatgatcctgaccccacaggtctctgctccccctttaacctggatgaacatcacccacgcctattcccagggccaccagaagctgaatttggatacagtgtcttacaacatgttgggggtggacagcgatggtgaggaagaaaccggagtgccaggggattgggactgcagtagtgctaacaaaggggaggcaagatagatgggactctaaactaatctggtcttttgaaagtggctggggctctaaacttaccacctccatgctctttccctttggcctatgtcaagggtcatgtttgccctgtgcttacttacattcacatcctcttcccaggatgctggtgggcgccccctgggatgggccttcaggcgaccggaggggggacgtttatcgctgccctgtagggggggcccacaatgccccatgtgccaagggccacttaggtgagaagatgcctgacccttctcctcctaacccctgactttgatactctagaagcttcaactccctatacctcagctttttcacccctaaaatccgcatactccctgtccccaatctgataccaatccctgctcattctcctccaaaatcacatgaattcaagcaccccatctatgaccccatgatctcattctcttccacctccttccaaccaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagagagaccccatctctacaaaaataaaaaataaaaaaattagctgggtatggtggtgcatgcctgtggtcccagctactcaggaggccaaggtgggaggatcacttgagcccaggtggtccaggctgcagtgagccatgattatgccactacactccagcctgggcgacagagtgagactctgtctcaaaaacaaacaaaatgggccaggcgtggtggctcacgcctgtaatcccagcactttgggaggccgaggccagtggatcacgaggtcaggagatcgagaccatcctggctaacagagtaaaaccctgtctctgctaaaaacacaaaaaattagccgggtgtcgtggcgggcgcctgtagtcccagctactcgggaggctgaggcaggagaatggcgtgaacccaggaggcagagcttgcagtgagccgagattgcgccactgcactccagcctgggcaatagagcgagactctgtctcaaaaaaaaaaaaatgttctctacccacatgcctttcctaatattctcttctccttaaacattttcagtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaaatagccaggcatggtggcatgcgcctacagtcccagctactcaggaggctgaggcaagagatcagttgagcccaggagtttgaggctgtagtgagctttgatcacacaactgcactccagcctgggtgaaagagtgagacctcatttcttagagagagagagaaaggcaatatggatgggcttggaaggggagagacagagagagaggggataaatgtaggtgttgtcttcagtagtatccaggtgttcatctctcctctcttatatactttcttcttcctcctctccccccatctcacatacatacatttcatttgaatgcgctttattcccaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctggtgaggcattgggaagacaggtgtgggaggctagagcaatgaaggcttagaagagttagggcggggccaggcatggtggctcacgcctgtaatcccagcactttgggaggcaaggcaggcggatcacctgaggtcaggagttcgagaccagcctgaccaacatggagaaaccccatctctactaaaaatacaaaattagccaggcatggtggcgcatgcctgttcagaggcatgctacttcggaggctgaggcaggagaatcacttaatcccgggaggtggaggttgcagtgagtcgagatcacaacattgcactccagcctgggcaacgagagcaaaactccatctaaaataaaataaaataaaatgaaatgaaaatctttcccttaaaaaaaaaaaaagaagaagaagaagagttagggcaggtttggagtgcagtgtgtatatcccaagatgtcttgcatactttctttgtatgtacactaatggtacaaagaggaaggctaagtgggctgtcattgtactccctctcactgcatttctacaaagtatctatgtctgtgtctctccatatttcacagacagaagtctctttctatccctccactccaacaatgatcctggcccacaggttctccactactgatgtcctagcccacgttccaaacatgatccaaaactcatctctaggggcacggtggtaaaattgaaacaaaacaaaacaactcatctctgggaggagtccctgcccagatcattcttttccgttctatatttcatcgatatttcccctcccaagtgcaatatttgttgaatgaatctgagtgtatgaacgttgtacttatttggactgataagctactctgtatgttctatgaccttcaaacatttgagctctcactccatgccatctccatgttaaatactcaggaaatggcctaaaaggcaagatgcttgacctcagggaagtgctgatgttaaatcctgtgtgtgtgtgtgtgtgtgtgtgtgtgtgtgtgtgtgtgtatgtgtgtgtgtgtgtgtgtgtctgcatacatctgatctcacctcactcctttctcttctcagcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtgagaattcaccctggatctggaagagttggggagtggcaggggggcagtgtcttgtgaactgtccaaggactgggaacttgaggaaaacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaaggtgaggattactctggagaaatggacagggcgggagaagttctggagtgtaggtggggctctggagtgagttcagtaggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgttttttttctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcattgcagaaccatgcagcctacctgggtgagcagcagagagttgcagaggacttacagggtaggggaggaaatacatccctagtgggggcgggtatgaaatactccctcttaactcatgcggtttctcactgacctctggttacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgttggggaggagtgtgaagtgggtaagagagaggcctccaaagtctgtgcggaattctggttggcagagtctgtcagggatgtaaggagcagactagcaggctggtgagtgcttcccactgagtccacttgtctacagttaccttcccttttctctggggtcatcatcacccaccattccccagattggttcatactttggcagtgagctctgcccattggatacagatagggatggaacaactgatgtcttacttgtggctgcccccatgttcctgggaccccagaacaaggaaacaggacgtgtttatgtgtatctggtaggccaggtgagacttgctgggaccccctgccctggacttgcattgtgggggtggagggaggaaaggagggaaggtgcacatatttgagggtttgctgagaggttgggtctgccagattagcatcttctatcttctctcctccaccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccaggtcaggagtacccaaataaagcaggggcacggttgtaggaagaggaatagggggatgctctttgcttgtcaatagtctccttggcttgagacccaaactgaacaagtgcttttattagtaggcaaaaacataaggcagtggacaggttgctgaactaagaactcctgaacacaggcaagtttctcttattcccaggactgacgggagcattataaagagcaaggcatggccgggtgtggtggttcacgcctgtaatcccagcactttggaaggctgaggcaggcagatcacctgaggtcaggagttcgagaccagcctggccaacatgatgaaactctactaaaaatacaaaaaattagccgggcctggtggcgcacacctataatcccagttactcaggaggctagggcaggagaatcgcttgaacctgggaggcggaggttgcagtgagccaagatcacaccattgcactccagcctgggcaacaagagtgaaactccatctcaaaaataaataaataaataaaaagaaagagcaaggcaggaggcctgagaaactaggtgtatgggtccctgcctcagtattctctctcttcctctcagaggattgctgctgcctccatgccacatgccctcagctactttggccgaagtgtggatggtcggctagatctggatggagatgatctggtcgatgtggctgtgggtgcccagggggcagccatcctgctcaggtgaggggtcccagctcaggtggtggtggacagcatagcatagctgttaaaggcaagggccttaaagtcacagatggagatttggttttcttggtcaacttactctgtgcctccattcttagtttataaaatgacagtagtaatagtacctaccttataggtttattgtgaagattaaatgagataatccatataatgatttgaacacagtgcctagcatgtaagtgcgtattgaagtgaatctagggctgggtacagtggctcacacctgtaatcccagcactttgggaggcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcggggtagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatcataggagttgtattaaaattaaatttagccgggcgcagtggctcacgcttgtaatcccagcactttgggaggccgaggcaggtggatcacaaggtcaggagatcgagaccatcctggctaacatggtgaaaccccatctgtactaaaaatacaaaaaattagccgggcgtggtggcaggtgcctgtagtcccagctactcgggaggctgaggcaggagaatggcctgaacccaggaggcagagcttgcagtgagccgagatcatgccactgcactccagcctgggcgacagagcgagactctgtctcaaaaataaataaataaataaataaattaactaattaattaaatttagtaatacagttaagatcttaggacagtgcccagcacacagaaaatgcttcataaatgatcactacaattatcacaagatccttgactctgtgactctgtgactctgttttccttcaggatacatcagattacctccggccagtggccttgactgtgacctttgccttggacaatactacaaagccagggcctgtgctgaatgagggctcacccacctctatacaaaagctggtcagcagtgccatgccctgccccttgctcccaacactgccctccttcaagagaaaagggagggagggagaagacatgagatcatggtgaaatctgacctgggctcctctaatcaaaatatacccacttttgtcttttcactttccccctattctattcctttcctccttgctttcctctcaacccttagccccttccctttcttccaggtccccttctcaaaggattgtggccctgacaatgaatgtgtcacagacctggtgcttcaagtgaatatggacatcagaggctccaggttggatggacatgtactaggcaaaccagggtgacctgagacagactggaagggactcgaagggcgggtagggggttgtttcttacccatgataacaaaagtgagacttttggcactcccctccttcaactcctggtctctccctcattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctccagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaacattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccctcaatcctattcatgctgaatcttcccttttaagcatcttactttcctaggtatagtgttttgccaggccttgggcactggagctgggatgaggggatatgggatgtagccataaagcttgcattgtctgtgtcatgttctacttctgtcttctccatgtacccccacctctttatccatgtgctggccctgcctcctctgaatccacgtctgtgtgctgatcatatgcccctgtgtctgtgttatggctgtgaccatgtacttcctgacttggtgttcacacagtgagtctaccctgcaccgctatgaggttcacccatatgggaccctcccagtgggtcctggcccagaattcaaaaccactctcagggtgagaagctggaggggtcttggcatgaggagaatgtgggggaacaacagctttgtgggaaaaggatgggaagggtctctcttggattttaatggtatctagggtgaaggggaacaaatgaggaagggtcttctgtctcccacttcttcctattcccaaccttcctcttaggttcagaacctaggctgctatgtggtcagtggcctcatcatctcagccctccttccagctgtggcccatgggggcaattacttcctatcactgtctcaagtcatcactaacaatgtgagtctggtctaggagggcatggaatcctgccaccttgagctggtggactcactgaagctggacaccacaccagctccctatctgttgggcctctgctcttggggctcttctctctggggggctttctttttacacatgtggcttattagagagaagaaaaaggtattataaggggaagaactacaagggtgtaggtatgttccaactcagccttgagtggctagcgccaccccatcaggagggtctttcaagttggatcttcctctaggcaagctgcatagtgcagaacctgactgaacccccaggcccacctgtgcatccagaggagcttcaacacacaaacagactggtatgagtcacaaaggggtgtccagagtgggaatgcaagtggagttgggtgacttgggacaagagggtaggaactggagtggggaagaagggatctttccaccccagggtcctgatctggagtgggaatgaaaatggagtcaggtgccttgggacaagactgtgtgaactagaggtggggaaagaggatgtttctaccccagagtcctgatctgtctctctctgtctcttctgttagaatgggagcaatactcagtgtcaggtggtgaggtgccaccttgggcagctggcaaaggggactgaggtctctgttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctagttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaactgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgtaatccctgcactttgggaggccaaggtgggcagatcatgagatcaggagatcgagaccatcctggctaacacggtgaaaccctgtctctattaaaaataaaaaaattagccaggtgtggtggcaggcgcctatagtcccagctacttgggaggttgaggcaggagaatggcattaacccgagagatggagtttgcagtgagccgagatcacgccactgcactccagcctgggtgacagagcgagactccatctcaaaaaaaaaaaaaagaaaccactacatacttggtactctgctatctagtaggcactaaggacacaaaggttagtaaggcacagcctttaacctagaggatcttatagttcaggagtgaaaaacagaagtaaacaccagtgttggtgggggttaggaggaatgatttccctaaatcccagaggggatgacatctaaacttcaatctaaaggaggggtagaggtcagccaaaggaaagaggagtagaatgcatttcaggtaaagcaccagatgtattgattgtccttggaaaacaaacagcagcagcagatgtgaccaggggttttccatctattacccttcctctcttttcccattggtcttcagccttttcttctggtcttgagagccctcaacattatgcctctcagcctcaactttgctgttgggattccaaagaactatatcacctgataatggctcattttaaatgtcttcctatccacttgttccataggccaagttcaagtccctgacggtggtcagcacctttgagctgggaaccgaagagggcagtgtcctacagctgactgaagcctcccgttggagtgaggtagggctggagaccgagtctgagagctgtgaaaataatgatgatgggtatgtggtagggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaaggtaagcactgctttagtggggagtgtggagcatgatgcccatgagttgagggatccttgattatagcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgacttttggctctatatgtattccctaggatatagactgctcagtaatagtgagaggtagatacttgttttgcctgggattttacagagtggagtccctggaaggcaaagttaagaagtattttaaatgttttctgtggctttcccacaggagatgtattctagcctcctgtaattctcacctgcttaagtgaccagaaagtataaaggtctgggaagcacagaggtttagattgaaatcctatctgccatttattagctgtatggccttcagcaaatcataacttccttgaggctcagataataaaaggctgtgtattacagtggttaacaatgaaggcagatttgggtttaaatctaggctacacaacttaaaaagtctgtttgacctaggacagacttaacttctctaagtcttggctttctcatctttaaacctattagggtcatgaagacaaaatgaaataatccaagaaaagtgagcatttagtaaatgctcagtaaatggtaactattattataaaactattttgtcataaaataatctaccatatcatgccttgtgaggattaagggagaaagtatactggagcaccaggtggtggtgttcctgctctctgacccatctcccagattgtgaagatgtgtttctacgtgctgttgtctcatccactaaatcttgtcctatgcctcatcttttttttttttttttttttttttttgagacagagtctcgccctgtcgcccaggctggagtgcagtggcacgatctcagctcactgcaacctctgcctcctgggtccaagcaattctcctgcctcagcctcctgagtagttgggactacaggtgtgcaccaccatgcccagctaatttttggatatttagtagagacagggtttcaccatgttgaccaggctgatcttgaactcctgattcacgtgatctgcctgcctcagcctcccaaagtgctgggattacaggtatgagccactgtgcctggcctgcctcatcccttttgaaataagctctttgagccctctaaggtgataattagctgaagaatttaaggttctaatggtagagatcaaatctatttgattccattaagcaggtatcttctaggctcctcttgagacacccagagtttttccattatcctgagagaacacgtgcacttaagcaatggccttctagagaccgagtctctgcctctattgcctaaccctgagaattgtggcctgtctggcctatttggcatgaacaccattctgtgtcaacctgctgagttgttttgtgacaggaaagggtttccattgtgaccctcagtgcacttcatacaggctgtaacttgatcagcctttatggagcacacagtttctagggctgagaccgcaaccagattatgttgacagactctcctctcctctttaccctcagtcagcccccaaatggaggtaggtttccttgagtactggttcatctaatgctcacacatatatacatatacacacatatatatgtgtgtgtgtttgtgtgtgtatacatatatatatatttaaattttttttagagagggggtctcactatgttgcctaggctggtctccaactcctggcctcaagcaatcctcccgtcttggcctttccacatgctgggattataggtgtgagccactgtgactgacctcatgtaattcttttttttttttttttaggattaatttcttttatttatttatttattttattttacttcaagttctagggtatgtgtgcacaacatgcaggtttgttacatatgtatacatgtgccgtgttggtgtgctgcacccattaactcatcatttacattaggtatatctcctaatgctatccctccctgctccctgacctcatgtaattctttatccatatgattaagagagcacttttaatatatttttccaactagagattcccctcctatccatcgtcagctccagactggggctttctctaaacccaatcttgttacccctttctttgcaatagtattagtttaagaagcaactgtgtattgttccttcctttccttgttgttgctcctttgcttcttcattaatttttttcattcatttattcatcagatatcaagcacgtaatatgtgcttgacaatggcaataatataaaacacaactaccatcaaagagtccagtccagtagcagaaacaaacatgtaaacaaatagtggcaaatacagcctggacgcagtggctcacacctgtgatcccaggactttgggaggtcgtggcaggtggatcacttgagttcaggagttcgagaccatcttggacaacatgtgaaaccctgtctttaccaaaaatacagaaacaattagctgggcatggtggtacgcacctgtagtcccatctacttgggaggctgaggtgggaggatggcacgagcccaggaagtggaggttacagtgagccgacatcacgccattgcgctgcagcctgggtgacagagtgagacactatctcaaaaacaaaaaaaaatggcaaatgcaaagaggtggttgctatatatcaacaagcactaggagtatgtcatacaagaggcatactttgttgggcggtgggggtggcggggttgtaagggaaaactttatagaaaaaagaaatttggctgcggggttgttctgtgcaggaaacgcacaaggggagaagaagagacacacacaatacctttaagggtaaacaagctttatcccatgtaaatggcaatggagatataataagcaaatggtacaagcaaattaatataataagcaaattatataataagtaagcaaatgatataataaacagattgatataataagcaaattgcaatgggaaggggagaagggaaaagatgtttacattcaccagactatggaggatttaccaccagactggaaagcaacagcctgggttccagagttgaacaccgcactcataagactatagaggattcaccaccagactgagaagcaacagcctgggctccagagttggccactcatccatgcacagacgaggagaggtctcatgaagttttggcgcagtctgggaccctagctctttttgtaacgagttgtttggcatgaggcccagtcacggggcccttggcgactgggctcaaggaacacaaaacattcaacttatttttgcaattgtctattgtttttcaataactaacgtgtaggaatagattgaaatagagatttctccaaaacagtgctggacgaacacctcaaggggctcacacaacctgttctgggacttggtgaccattgtttctgtccacgttcaattgagttcaaatttaatatttaacttttccaccgcagggatcaaatgtgacaggaggcattcttgggaggattaatcaccagctgcaaagggaattgtaaattagaacagtttgaggcctggtgctctgggagttgaggtgaggagaatcgcttgagcccaggagttcaaaaccagtctgggcaacatggtgaaaccccatctctaccaaatatatgaaaattagctgggcatggtgatgtgcacctatagtcccagctactcaggaggctgaagtgggaggatcccttgagcttaagaagtcaaggctgctgcagtgagccccgatcatgctatcacactccagcctgggtgacagcgagaccctgtctcaaaacaaaaaaaacaaggccaggcatagtggctcacgcctgtaatcccagcactttgggaggccaaggcaggtggatcacttgaggtcaggaatttgagaccagtccggccaacatggcaaaaccctgtctctactaaaaatacaaaacttagcgggcgtgatggcacatacctgtaatcccagccacttgggaggctgaggcaggagaattgcttggaccgggaaggcagaggctgcggtgagtgagccgagattgtgccactgcacttcagtctgggtgagactctgtctcaaaaaataaaaataataataataaaaaaagaaacagtttgagtggctcttttgtgtgaaagtaatgagagatgggactgggaaagagggcggcagcgtatgactcctgaagagccttgtaaaccacttaagaactttgggctttaccctgtaggttttcatatgcattttagtgagctctctccggcggggagaggagaaaagaaagacaggaagaccagttggctgcgactgactgttcaagaattaccaagagcctgaacttcaagggcagtggaaataatgaagacagttttttgtttggttattttttgtttctatgcgggggcgggggcggggggggcagcttaaaataaaattgctctcctcgctctctgctgttttctaattcagatgtgcgtttaaaaattgagcctgggccaggaatagtggtggctcatgcctataatcccagcgctttgggaggctacggtgaggagaatcgcttgaggcctggagttgaagaccagactgggtaacatagagacactccatctcttaaaaaaaaaaaaaaaaaattagccaggcgtggtggtgcatgcctgtagtctcagctactcgggaggctggagtgagagaatcccttaagcccacaagttggaggttacggtgagctatgatagcgccatgcactccagcctggccgacagagggacagattagagacactgtctcagaaaacagaaagaaaaaataaaattgaacctgatcacctttccttaggttttgtcccccaggttaccgtgggccgcgcattatctctgctctgcttaacactacaatctcctatttccgaactgctctcttcaaatgctcttttttgcttgggtttttggccggggaatagtggcgggggagaggcggggggagttggcgggggcagaggtaactttaccagtgattaaatgcaaatgcgacagtccgtgagaccgaagcccctggtagaagccgggaccctcctgcctctggctgccgctctccgaggggcggggctgaggcggggcttggggcggaggccccgcctggaactgagggtggggcgggtccgggtccgggaggagtctcagctggagcccacccggttcctttcctgattgagcaggtcggatcccagggtgggttcagatttgaagggcgaggttcgaggccaagcccccgtcgcagcctaagactgcgggcttttctcctctgcagggatggggtagggcagggccaggggcggagttttgagcccagcccttgggttcttgcctctgattgagcagggcgggttctgaggcggatcgtggggcggggcccgctctgctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtaggtgccaaaatgtgtgggaggatggggttgggatcccagctctgtggtgacagaagtctttagtcccgtctcaatgcatcatcgccttttctttttatcagtctttctagctcttctagtcttgcaaggaagcccgccagctttgccttcctcaagaccctgccctgcagcttctgacttgccctgctcacctctgccatccccaaggccctttccccggcccctttcttgtcctcctagcatctacacccccgatttctggttcgttttctgcaactctgtccccttcccatggccctgaccctacttctgctccgtctcccagtaccaaacctcccccaagcatcttcctcagcccctgcctggcctcaagctccattctacaccaccaagtcatgccccagagccccatatttcatccctgccctgtccccgcaatcttgccttccacgtagctctatccttgctgtttcctgttagttcaacaagcactcccagccctgtgccttctgctaaccctttttcacaatctcctctgtcattgcttccctcctgccccatgccactttcactcccatctctcaccagcactgctgttcctcaaacatcactccaaacctttttccaattgatgctcccacaacagcaaccttctgttctcccctccaacctctgccctactctgcccagtggtcgccagtcccacttttcctcctgcctgcttgctgtgagttaatattgcagtctggtcagcctcacaggcactgccagaggatgcacagttgcctgactgctccccagaggactgggtgagttgcctgcagagtccaccccagccagttcactgcagtgtctgatcatcagactggttcttgggccagtcaaggctcaaggcctttctgcctgcttttccccagattattcatttcctgaacccttgcccagttgcttaggaatgatactctctgtttcctttggttgaggtgggggaaagtgatgatgagagaagaggatagagcagactcagagttcccagcagaagtcactctattccccatgttctcccagaaaaaaaaaaacataagattatagaaggtggtggcttagggagggtattgcttcttcttctctagagatctcttacagagagcccccttatttggaaatggaattttctgtagaggttggggttacggctaatttagaagcaaattagccagctacttgtagcaatattgctttgctaacttgacttagtagtatcgttcataagaaaatatcagaaatgttcaattagctcattctgcatgggcaggttacagaatcctggaagcaagctatgaggcaagagtatgaactctgttgaggcctgtccttgtcccacttacatttgcatctctacttagtttccacacattgatcaaccaatcaaaaggtatttactattatatgcaccagaaactgaggctgcccagactcagtcttaactcataatgactttttagaaattcatatggactcttccttagttactgaaagtattcaatgttgcctttcccttacaggtttgtggagtctgcctgcttcttaggaatggggaaactatttcattctttctgatcccccaatccttgggcagtacctcctttccaaggtgctggaatgagtgggctggcttttggaatttggaaccatccctctgtcctccttgattctagctgtacagaggtttgaccataaagaatgaccacccattctaaacttttagtataacaagatcttactataatgagattatgggaagtaagttggatgggtttagaattatctagctggaaagaaaactgtttcttcagacagattggagtcatagaaagcttgcaaatagggcagtttcagctgcagattggttcctcatgaaatttccccacacttctcatgataaattcctccactgttttgggtggcaaactactctggaaccatttgtcagagaagtagtgtggcagtctttatggccactccaaaagcctggcttcccagtcacactggaagactgcctctacccatctccactcacacatttgggtccagggccagagccctgcactgtcagtctgagtaaggactgaaaaagcagtgatcattttaaagctaatctaagttaccagtatataggaaaatccacacacaaaaaaaccccaactcctataatcccattttattttagtcaagtagaggatatccttgagggtatcttacctatgagcttactctgcctaggtagaccagaagtagaccagaagagagctttaaataattggcactggatcatctgggcgcagtggctcacgcctgtaatcccagcactttgggaggctgaagcgggtggatcacctgaggtcaggagtttgggaccagcctggccaacatggcgataccctatctctactaaaaatacaaaaattagccgggtgtggtggcaggcacctgtaatcccagctacttgggaggctgaggcaggagaatcgcttgaacccgggaggcggaggttgcagtgagccgagatggtgccatcgcactccagcctgggcaacaagagcaagactccgtctcaaaaaaaaaaaaaaaaaaaaaaaaattggtactgtctactgcaattacaacgttgagaattaggtcctggttcccctttctgtttccactcacctgacctacagcagaagtcattccttctctctctacttgctggtgtgcttccatgttataggatgcttataggtacacagccagagatataaggagaaggtacaattacttctacaaaagtcctctaatctcagctatggaaatacaaagcttatacttattgagtctgctgattaatttggtgattgctcccttgaggctgtgatggtaatctagtgcctcctttccaaggtgctggggtaagctacagactggatcttgacatttgaaagcatctctctgtcctttacttcagctctgcagaggcttggccatgaaaagtttctacccattctaaactctacttagtataatgagattataggaagtaaattgggtggatttagaactatctagctggaaagaaaagtacccaggccaggcgtggtggctcacacctataatcccagcactttgggaggctgaggtgcggaggatcacttgagcccaggagtttttgagaccagcctgggcaatgcagtgatacctcatctctaaaaaaaaaaattacctgggtgtggtagagcatgcctgtagtcccagctactcagaagactgaggtgggaggatcacctgagcccagaggtcaaggctgcagtgagccatgatcatgccactgcacttcagcctgggcaacaaagcaagactctgtctcaaaaaaaaaaaaaaaaaaggaaagaaagaaaaagaaaaaagaaataaaaagaagtggaaagggccaggcgcggtggctcacgcttgtaatcccagcactttgggaggccgaggagggcagatcacgaggtcaggagattgagaccatcctggctaacatggtgaaaccctgtctctactaaaaatacaaaaaattatccgggtgtggtggcgggcgcctgtagtcccagctactcgggaggctgaggcaggagaatggcgtgaacctgggaggtggaggttgcagtgagccgagaccacgccactgcactccagcctgggcgacagagcaagactctgtctcaaaaaaaaaaaaaaaaaaaaaaagaaggggaaagaaaagtatctatattgctaagaagcatctttaccatctgtacagcttggctgttattcgctggctagtatcagcaagatcccttccactctcctggctggagaattctgagcccaggaacatctaaaatgtgctcaggaaggatggattgtgcatctactatgtggcagacaccgagctagatgccttataggttgttatagtattaggaaactgaggttcagagatgttgttacatgcctaaattcacagaggcagacagtgttagagtcaagacttgaaacatttcgagaactgcaggttgacgtcagctgatggcagcaccctgtcgtggggcatagttctagctctctgctttcctgggggtgacctggtctccaaaggccattagaaaatgcgttcttacatgtcagagtctgttagtatgtgaaggagtcattttgcttattttgtcctttgagagttaacctgtttggagactccatgagacagtagagtctgagggtgggtggctttgccctggaggcaacttgagactgtttatctggaaataagtaaacctgtttctatagcttgtagtagtgtggtctggtggggagagctaggatttggcatcaggtggactgggttctttttttgtttgtttgtttgtttgagatggagtcttgctcttgtcacccagactggagtgcaatggtgcaatctcagctcactgcaacctccacttcccaggttcaagcaattctcctgcctcagtctcctgtagctgggattacaggcaccggccaccacccccagctaattttttgtatttttagtagagacggggtttcaccatgttggccaagctggtcttgaactcctgacctcaggtgatccacccgtcttggcctcccaaagtgctgggattgcaggcgtgaaccaccgcacccagccatggcctggattctaattccaattttgccactctttttcgtgatcttgaatggttatctaatcttggtatacttctgtttcttctgtcaaagagatggaataatagccctagctactttccagggatgttgagagactaattgaaatagcatgtgaaaggactgtgagaagttacaacttctgtacaggagtattacctcagaatccatctaccttagataattttatggtttggatatttagagctttcctgtggttgattaataatttgccctggctacgtaaacagtgtttgaaaatgagttactgggcttccacagaccctatttttcttcacccctttctatagcctcttgttgagattataccttataaaatgctatgtgccaccaccaacaccccactacttcctgttttgttacaaggatgccatatatttgtatggctctttacagtttataaagagattttgtatatattagcttgtttaatagtcacagcatgatgaggtagttgttattagccgtattttatagaagaggaaacaggttaaaggtgtttaatggcttactttaggtcacatagccgagaatgtagctgaactaggtcccaaactcaggccagccagcgaaatatttgtctggcagcctttacatcagaccacagatctttgcatctgtctcttccttttcattcccttctctggacaaaaccaggcttttctgtactttcagccctgggtgtttttacatagctgtctcttttatgccctataacacttcaattattataattaccctaccacccacaaaacccaagctggaatgatagaacaatgcatgcccaggtgtggctgttgtctagacagctgctccctgccagggaaactgggagggaggagaaggggagctacctcttgctgcttcctcaaacataactagaaacctctttgccttttggttgttgttgccatggaaaggagagagacggtcgccaaagggcctagatatgatatgggaaaacagaaactctagtttcctcttttaactgtggggcccaaagccaatgaaaagaggtggaatggttaggtattggaactcctagctgtaacctgaagctcggtcggtgccttaatgtacttctcaaacaactgacaacaaaaagcagagcagcagggtttcaggggtggaggcggtggtgagaggcaacatgagtcctcaaaagtggtcacgttggttccatttgctccagcaagacctagagagcaaaagggaaaggattgctctgaggttgggcactgaacaacaactctaatcatgatgacaaaaggacatttgaaatactgtgcattcagcactcaaatgatttttaattcagtggtccagggtccttctggctcagggctggaaataaccagcaatagttcttggtggcatattagctggttaagatttagctaggcccacctaagaaggactaaatgatctaggatgtgtgacttgtggaagagaaaaagggatgttccttttctctcatttggcatcctaaccatttgcctcttttctttctccacactacccccatgccctatattcacacaacctgtggctctggaccaggtggagagatggaaccgccatgatcagaagctgctggaggcagtgcacaggggggatgtgggacgcgtggctgccctggcctccaggaaatctgcccgacccaccaagcttgactcgaatggccagtccccgtaagtcagtcctcctgcccctgccccttacatgtggctcccttttgaagcccccaaatccaatataacataggaccagggaatgcctacaacttcagagctcttttcattgtcttaattagcaagtatatcaatagttttttgctacatataagttctacacaaagtgaggaaagaaaatattgttcctgagctccatccattgcacaacccagattgacaccactgacttgtaaagtacataaagcccattaaacaaacagaaaatgaatatatacactaagtagagtgtttcttcattgcacaagtaggagggtgtgtatgcatgggaaatttgaaatgaagtggtagcatgggagtcacatggctagagggagtagtgattaagtcaaaggaaatgttatcccttgtctctacccaaagccttcgaatgtccagccttcactctgctctggctgactctttctgtgacacttccacttccgctaaggttctgtgctcagagaggcaggtaattatgtgttccctagacacccctgcaatagtctgagattccttgagacctgtagctcttatttcttccttgcttttagcatcctttgtgattggaggccatatagacttctctttctcagaaattcaagctaggggagcttcttttcctgcttttaggattggctttggggtagggagcatagcaagaagggcttatcaagattctcccattcctcatccctggtccctttatcctttggcctctcggccttgattctggcaggtttcatctggcagcctccaaaggcctgacagaatgtctgactatcctgcttgcaaatggggctgacatcaacagcaagaatgaggatggtgagtgagccggagcactgggccacgctgcttgcttgcccctggtacagcagcagtcgggggcggtgctgggccctgctggacattcctactgtggccccttgcttctctccttagtaagttctggccagcatccttccaggagttcccctccccgtaagctgggcacacctcacccccactcccaccttcatcacaggtaccaggcacttggggaacaggaatttctggccccgtgtggctgaaagcttctctccctaatctcctgattatctgtgcgtctcttgccttccctccctgtgagtcatcagcatgcatggggccacctaccctccttctccccttctttctgttccaggaagcactgccctacacttggccaccatctcctgccagccacagtgtgttaaggttctgcttcaggtaagagcagtcccttgataccactcttatgaagggaagaagtggtcccagagttttctaacttcatttcatacttaaaaggaatagttggccaaatgtactcgcctcatccccaataggagggctgataatcatttgtttgccaacatttatttaactactatgtgcaggcaccatgtttgatagtgcctttgagggcaggttataaagcagagttgccaggcactatcgattttgtcattagcagagccactgcagagacttcctgctatgatgaggggcaagaggaaggaggacagagatgttcaaattaaaccaaagccctactgtctgtttctgaagagtttatagtctagtagtataaagagaaatatacatgtaaaatgacatgtggatcatttataaatgagtctccaaaagcacaaaaggcagttactggccgggtgcggtggctcatgcctgtaatcccagactttgggagatggaggtgggcagatcacaagatcaggagatcgagaccatcctggctaacacagtgaaaccccatctctaataaaaatacaaaagattagctgggtgtggtggcacgtgcctgtagtcccagttactcgggaggctgaggcaggagaatcgcttcaacccaggaggcggaggttgcagtgatccaagatcgcaccactgcactccagtctgggaaacagagagagactctgtctcaaaaaaaaaaaaaaaaaatcagttatcttaaccggccatcaggcaaatggatgttctactttcgttcttcctaatcctttccaaatttcacaattatgtttctaaagtaccagccacggggacattgggtgtcattttccctaacacgtttattaccatctgatttttcttagccccttggtttagaaaccagggctgatattcaaggctgcctatcatcagcaatggatgaactgggcttgcctagtagatagccttctccaaagtggacctcctgcccctcctcatattaccatggaaattggtgacccaatgggggtatgggatgaggatgttaacaccaagctccatgctgcttccctttgtggccatttgcagcatggtgctaatgaagatgctgtggatgcagaaaaccgtagtccattgcactgggcaggtgtgtgcaggggactcatgggaacagggctgcagagactacagggtgggaaaggggaggcgtgaggagggaagggcagccagggccaaccaatgaaatggtcggaggggatgttgggtcatagtctgagtaggctttcttcatgcttccccttaacccaaacatcttctccccagcctcctctggctgtgcctcaagtgtgctcctgctgtgtgaccacgaagccttcctggacgtgttggataatgtgagtgtcagatgggcaagtgggcagtgtcctacacagaagggctgctgctctctctcagcttgactggccaacttccatgacctagggctgtgttagcaccacccttctcttccttctcctcctgcttctcctcttcttcctcacagagaggttaagccttatcttctggagagcttctaaccctccaaaagggagtgttcagacccaagatctgggcttttattttttttggacaggtgtgaggggaggggagccggtaggattgtcaagcctctgcagtccctggctgctcatgaacctcttcctacaatctgtgcaggatggacgtacacccctgatgatcgcatcgctgggtgggcacgcagctatctgctcacagctgctgcagcgaggcgcccgagttaatgttacagacaagaatgacaagtgagcccccctcgtctatgcaccccaattcccatgcctgaccaatttagaaagaagccagtgggcaacgtgtgtgtgtgtgtgtttgtgtgtgttggggaagaagtcaggttggtctttgtgttcttgggaacctcattccttcccagtggaggttctgaagagctctgcctgctgccaccaccatcttcatagatagatgaccccagaagtagaatcgacacttctggacccgttggctgaatttactggttgtcaaattatcttttatgcaagaggatccttttttccaataaaaaatgtatgtagaatccctgtgatcccagcactttgggaggccaaggcgggtggatcacgaggtcaagagattgagaccatcctagctaaaatggtgaaaccccatctctactaaaaatacaaaaaattggtcgggcatggtggtgggtgcctgtagtcccagctactcgggaggctgaggcaggagaatggcatgaatccgggaggtggaggttgcagtgagccgagattgcaccactgcactccagcctgggcgagagaggagcgagactccgtctcaaaaaaaaaagtatgtagaaccttgatatacagagcagataaaaatggagctcatccagttggccccctaatttctgttcctgcagctctaaggaatggcatttgaaaagcctagtcctggcctggtgcagtggctcacacctgtaatcccagcactttgggaggctgtggagggtggatcacctgaggtcaggagttcaagaccagcctgaccaacatggagaaaccctgtctctactaaaaatacaaaattagccgggtgtggtggtgcatgcctgtaatcccagctactcgggaggttgaggcaggagaatcgcatgaacctgggaggcagaggttgcagtgagccgagatcatgccattgcactccagcctgggcaacaagagtgaaactccgtctcaaaaaaaaaaaaagagaagtctagtctggtctaatgttggtctgttgttctcctgaccccactgaatgagagcttaccctgtgagtggaatgtctggaaccaggacttctgggttccatgtggaaagtctgtgctcagatttgtctcaacccacagatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtaaaggcccttgtgtaacttccacgttctctaagaatcagagaagtttcttagagtcccatttgtttccatggaagtaatctatctgacaaataattgtcacctgggttgagagtttacgtatttattgctgctactgtgagaggaccccaaatccccatcccaaaagtatgatcacaaaattctttaatgcagcctggtctctcactgaggacagctctggctagtgttgtttctggcgtttgtgagttgtaattgtacatctatttgtgtgatttgttggtcactctctctttcctctaccagattgtaacccccttaggtgacaggccatttctgttttgctcaccattgaagttccagtgcttattaaagtgctggacatagtgaccaataaataaatgagcgaacaaaatgaatgaagtggcccatttctgggataggaaaccaaagttgctggatagttagggatccactaaacaagattggcttctggcaccaggaagatgtgcagtgagattgatcacagagaggccactcctctcagaaaaagtctgaagataagaatgtgggctggaagtacatggaacctgtcttctctctcattttcctcatatcttttcttataggtcagaggctagtccagcacccagatctcgcatcccaggtaagaccctaagtgcctcccccttttgcttttgacacaccccaggctatcccactgtgactattcctagtggtccttggggtgtcaagacatttaagagaagaaaggcactcctagggctcagttcgttgcctagtggccacactttactattctgtttccaacataggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaaggtgagcagctgaggtagccctggggagcactggggaaagtttctgtgtatttgggagtttactaacctgaatccagcaacctttattgcagcagtgggtcagattaataccccaaacggagcaccagtcctttgcagggaccacactactatgttctcgtgggtctgagggggttggtgagattggaggtgaggtaaggtataagtggaagagagaagggggcttaggtactaaaatttggcacccagattcagaagcagtgtgctcagggctgccaccagtgcagcaccatcgtttattagcatttggacttgaattgcatattagcctgggaagaggcctaatagcatgatgggttgctgtggttttactgaagttctgaggaggtcactcaagaactaatgagttaagaaaagtagacccagcgagagctgctcttctcgcctccacttcagggtgggttctacaaaacgatgtccattggcaaagagggcaccaatgcaaagaaaaaaatcttgaggccgggcgcggtggctcacgcctgtaatcccagcactttgggatgccgaggcgggtggatcacctgaggtcaggggtttgagaccagcctgaccaacatggtgaaacccggtctccactaaaaatacaaaaattagctgggcgtggtgcgggcacctgtaatcccagctactcaggaggctgaggcaggagaatcgcctgaaccagagaggcagaggtagcagtgagccaagattgcaccattgcactccagcctgggtgacacagcaagactctgtctcaaaaaaaaaaaaaaaaaaaaaaaaaaaagaaaaaagaaaagaaagaaagaaagaaagaaaaaaagcttgaaaaccactattagataccagagtttcctaatgcttgctctaaatgtgagtctacatgtttctatgagacatgttttatgaactctaaatatcaatttacacatggatttagtacttccagacttaaccgtgaaatgaatgatttcagacttcttattaaaacttggatacatggtcaaatttagaatgattaaaaaatataaaaaggccgggcatggtggcaaaaattagatgggtgtggtggcatgtgcctgtaatcccagctcccaagaggctgaggcaggagaatcactggaacctgggaggtggaggttgcagtgagccaagatcgcaccactgcactccagtctgggcaacagagcgagactcctccttctcctcaaaaaacgttatatatatatatataaaagaatgtatgttttctatagtgtggagtacataaaaatagaaggaatgttatccagaataggaatcagtgcgggttgaggttaattaaagaaagtatttttatgttgcattgaaggagaagttgaaagtagacaatcgggtgaaagcaaacatagtgtcatggttaagaatgtgttctctggaccaagattgtctgatcttgggcaagttatttaacatctctagtcctcagttttcttatctataaaatgaggataataaaatggttgtgaagattgcattaaataagaaattatatttatttaaaagatttggggctgggtgcggtggctcatgcctgtaatcccagcactttgggaggctgaggcaggcagatcacgaggtcaggagatcgagaccatcctggctaacacggtgaaaccccgtctccactaaaaatacaaaaaaattatccgggcgtggtggtgggcgcctgtactcccagctactcggagaggctgaggcaggagaatggtgtgagcccgggacgtggagcttgcagtgagctgagatcgcgccactgcactccagcctgggcgacagagccagattctgcctcaaaaaaaaaaaaaaaaaaaaatttggaactcttggcccatggtaagtactcagtaaaaggtagctatcattattcctactaccactattcctattactgctagttaccattaactgcatttgtgcctctgcctcaataagccataaggactcatctccatttcccttagtggtcagtagccaggagtaggttaggatctgataccaagttaagagcatcggccaaggagtcaaagagattgtggttcaaatcatgatttcatcacttattagctgtgtgattttgacaaattacttaatttagtctctttatctacaaaacgtagattataatacttccctcaggcggagcacagtggcttatgcctgtaatcccagcactttgggaggccaaggtggatggatcgcctgagcccacgagtttgagaccagcctggacaacatggcaaaaccccaactctacaaaaaaatacaaaaattagctgagtatggtggcatgtgcctgttcctgtgctactcaggaggctgaggttggcttgagcccaggatttagaggttgcagtgagctgagatcacatcactgcactccagcctgggtggcaggtgagaccctgcctccaaacacaaaacaggctgggcgcagtggctcacacctgtaatcccagcactttaggaggctgaggtgggcggatcacctgaggtcaggagttcgagaccagcctggccaacgtagtgaaaccccgcctctactaaaaatacaaaaattatctgagtgtggtggcgcatgcctgtaatcccagcttcttgggaggctgaggcaggagaatcacttgaacctggaggcggatgttgcagtgagcagatggtgtcactgcactctagcctgggtgacagagcaagactcagtctaaaaaacaaacaaacaaaaaaaaacaaaaaaacaaacttccttcagagaagtattgttcctcccggaagaaaagctgttttttttttaaatttttttaagttttcaatgttttatcatattggatagcagctttttttttaattggttacaaaacctaagcccatatacaaaattaggaacacatttagatgcctcttttgaaagaacattttagtctttttaaactgagttttaaaaaaataaaaacaatgcaatttttaaacactgttttgaaaacttaaaagtgcagcaatatagttagtttcctttatctacgaaatggggcaattccaattcagaactggtaaggtcacaaattgaatcaaggaaatgcatacaaatgtctgcactacttgatgctaatgttcacttaaatgttagtttgcactttaaaacatgagaggaaataggaatcatcacagtagaggcccacttttaatcataatgtgtgcaaattttaaaaggtaactgacaagtaaggaaagtccagaagaaactaaactggaaggggtatagttcacaatatcaaaaagatttggacttttaagggtttcaccgaagtttgtgaccttaattagcttttacgttgttattcctacttttagtgaacaccacacagaagaaaagctgttttgagtgttaaatgagacaatttgtataaaattggcacatattaaatactcagtaaaaggaagctgaccttgacccttgtgggagaaatgacttggagcctcattggttgcctctttcctcttggcctcagatcaaggagttgttgaagaagctggagcagctttcagaagaggttctagcaattcggggagaaaatgctcgccttgccctgcagctgcaggtatgttttggctgtcagggatggtgctggagaagaaggtcagcagtggaagtgatgtatatgtgggagacattctaggaattactgagggagacattctaggaattacagaggcctggctaggcagtggtccaggatgggccagtgatgggccaacgagcccacctggtactgctgaccacttcattgtgttgctcctcatgcttgggtgactgagggtggacatgtgacttcccattgatgttcattcccaggattcccagaagaaccatgaagagatcatctccacctacaggaatcatctactgaatgctgctcgggtgagcatggtggagttttgagggaggtatagacataaagctgagtatagggtattgcatttagggtccctctctcttctccagggtccctgtacacacttgctgtttctcggaaagctggatccagtgctaggtctctgatctcatttggtagatcaagagaggttgtgcatgaatgtgagaaggagaggtgtttccccctctgtttcaattctctggcctatagtaaggacttttcctgtccccaataccctttctcagtctcctcctggagccacttagtcctaaacaaggaagaagaggtaggtgtcttgctcccttgttaggaataataactacaaagaatggaacgaacacctattgtgtacctggtgctttgcttcatattcatggttgtaatcctcagagcaatcctgaaaagtagacatcattatcttccctgtgaagatagggaaaaagccatggagaagttaaatactataagtgaaggtatatagtaaataaatagccttccactgtaccacagaacctctccctcacctctctctctccattttctgttcttcatctccttttcttcctttcctgacatctacagggttacatggaacatgaagtgtacaatatcctgctgcaaatccttagcatggaagaggagtgaggcagcctcactgtgtgccctcagggatacgagattctctgttgtgagttgtgggttaagggtgatgagggaaggagtttgggagaaagggcttgggaaaggtgtatggaatgaaattagtcccttttgcccccgtggtggctgacaatggggagccttttggggcatagagcatttgaggtgactgagaagacagaacatggagaatcactgggtggagtcaggaatcagtgagcaggtggactaagggggctgacttatgagatggagactgaaaagaggggttgggtctggggtagggagatgccagtgaaagatgagtgatggtaggatagtggtagacagttgttccttagggcaggactctacaaaatccagaatctcttcactttgataccattcattcaaagagcagtcatcccccaaacctccccccaccccaatgcagatagtccccttctccagtccagatagatgagggtcccttttagcatgttgatatgagtgggaggagactgaggatatggaagtgggtgcatttcatctttgaatttcttctttcagggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggggctgagtgtaattttttttttttctaaaggggagtggggaaaggaatatctttcatccctttattcttttctttttttctggaaacaaatattaacagtatgtctttattcttaaaaacatttttttacaagtagattttttttttgaggcagagtcttgctctgtcgcccaggctggagtgcagtggcatgatctcagctcactgcaacctctgcctcctgggctcaagtgattcttgtgcctcagcctcccaagtagctgggattacaggcatgtgccaccatgcccagggatacaagtagattttgttttttattttgcaaatagactttatttttaaagcagttttaggttcacaacaaaattaagcagaaggtacagagattttcatatattctctgcccccatgcaggcactgcctccccaattatcaatatcctcaccagagtggtttatttgttataattgatgaacctacattgacacattattatcattcagagttcatagtatacattagggttcactcttggtgttagagagtctgttggtttggacacatttatattgacatatatccatcattatgttatcttttttttgtttttgtttgtttgtttgtttgttttgaggcagggtcttactctgctgcccaggctggagtgcagtggcatgatcataactcactgcagcctcaacttcctgggctccagtaatcctccaactcagcctcccaagtagctggggctacaggcgagcaccaccacaactggctgatttttctgtatatttaatagagaccaagttttgccatgttgcccaggctggtctcaaactcctgggctcaagcgatccacctgtcccagctccccaaagtgctggggattacaggcatgagccactgtgcctggccatctctatattatcatacacagtggtttcgctgccctaagaatcctctttgctctgtctgctcatctccccatccctgctaacccctggcaaccactgatctttctcccatccccagttgtgcttagttggaattatacagtatgtatccttttcagactggtttctttgagttagtaatatacatttaaatttcctccatgtctttccatggcttgataactcacttatttttagtaccgaataatattccattgtctgaatgtgtcacaatttatttatccattcacctactgaaggacatcttgattgtttccaagctttggcacttttttttttttttttttttttttagcagagtctcactctatcactcaggctggagtgcagtagggcagtctcagctcactgcaaccgccgcctcctgggttcatgcgattctcctgcttcagcctcccgagtagctgggattacaagtgcatgacgccacatccagctaatttttttctatttttagtagagacggggtttcaccatgttggccaagcagtcttgaactcctgacctcaggtgatccacccacctctgcctcccaaagtgctaggattacaggcttgagccaccatgcctggccttggcaattatttaatttgtttttgaatgaaattcacaaatggccctataagtcagcaactttcaaactttttgatccctagtaagaaataaaaaaaattttttttgaggcagagtctcactctgtcacccaggctggagtgcagtggtgtgatctcagctcactgcatcctctgcctcctgggttcaaggtattctcatgcctcagcctcctgagtagctggaattataggcgtgcaccaccatgcgtggctaagttttgtactttttgaagacacagggttttgccatgttggccaggctggtctcaaactcctgtcctcaagtgattctcctccctaagtactgggattacaggtatgagccactgcatctggccaagaaatacattttgtatcttgtgtatacatagctcgaataatactttactatttctcttctattctttgctaatatactccatcaaaatgcatccactaatgggtcaagacccacggtttgaaaaatagccctcagtgaaaatggggtttgacactcttcctttccactttctcgaatctgtcacagctctaatcttttttctctgccttgggactgttgaatccatgatttttttttttttttttaaggggagattgagagacctggattttcttcaggatatactttctaaagtattttatcaagtgttaaacaatgtgtctatatttgacacacatggtctcactgttctttgtcccaggtgacaaaagggatgaaaagtctgattcctgggtagaggatgaagggatacccaagtttcatttttgcctgtgattccattctcagactgaaaaaaaaaatgtatctctcttggccacttcccctgggtctcctcctctgcctgcccttccaccaggcatgctgttaggtgaaaatgaggcagtgaattcctctaaaatctggaattgcagtttggtggcccgcacgctgatccctccccattccttctctcagtccaccctctgcttggttacactgggtcagacagcagcagttttggcagtaaagaggctgggttgagaaaaaagagtggggaggggctgccatggaagacagggggctacacaagggctgcagaggccagctccagagtttggccaagagtgaaaaagagcatctgagatatctggatcagatcctagagaaggtgcagaggttttacgtggatgggcacgggactgctttacggccaggaaaatggaaaaaggagggattgatggagaaagggggaagaggtgcagctattgaagaaagatcatcaaaagggtctgagtcatttctattaaggggaacagaacctctccttgccttcctgctctcaattaccaatgtatattaaaggactattacatttcttgttatatatgacgtgtggggtggggagaatgaagaaactgtagagagaagggtccagaaagggggagatcattgggctaaactcaagaatgagtcaggaagcagctttggtaatggaagccaggactttggctccctccggggctcctggaaactgattccaggatgggctgagctatgggagtggtgagtgatgttaatgttaacacaggagtagaaacttccttagcccctggttttcccagtctccctccctaaaactccacaaacttacctcaacagccccagtcttaaaatttttcttgagttcataaatttttttccccaaagtagctataatcctaatgttccctttattcctcctgggctctctaatgggacttagcagggacttatgattcctgcttcatctccccaccccattccccaggcttgagatgtaggagtatgtgggtgaaagtaggtgaaacccgatgggccatgatcaggttcagaccatgtttttgaatgccttcaatctggaactttgcttctgattcacagtttccctcctttggtaacattaatttattaaacagatatttaaggagtctactatttgtcaggcactgggaatagagtagaggcagcacagaaaaccttcttatccttttggagcttgcatgcaggataagattcaggttccccggttccgtcatcctgtagggatgctagaacttataacctcaaattaacttttttccaatttattttttctctctttcaataactttagtaacctcaaattaattttttttagatgtattattgctctgtcacccaggctggagtgcagtggtgtgatctcagctcactgtaacctctgcctccctggttcgagtgattctcccacctcagcctcccaagtagctgggactacaggcatgcgccaccacacctggctaagttttgtatttttagtagagatggggtttcactatgttggccaggctggtcttgaactcctgacctcaagtgatctgcctgcctcggcctcccaaaatgttgggattacaggcgtgagccaccatgcctggccttcaaattaacttttttcgtttgtttgtttgttttttgagacggagtcttgctctgtcgccaggctggagtgcagtggcacgatctcagctcactgcaacctcagcctcccgggttcaagcaattcccctgcctcagactcccaagtagctgggattacaggcacacgccaccacgcccggcgaattttttgtattttagtagagacggggtttcactgtgttggccaaaatggtctcgatctcccaacctcatgatccgcccacctcggcctcccaaagtgctgggattacaggcgtgagccaccgtacctggcccaaattaacttttaaaggagattcttccttcatgaaatcactagaactcaaggtgaggttttctcttaaatgtttacagctttatttatttatttatttatttatctagagatggagtcttggtctgtgccaggctggagtgcagtggtgcagtctcggctcactgcaacctctgcctcctgggttcaagcagttctcctgcctcatcctcctgagtagctgaaattacaggcgtgcgctgccacgcctggctaacttttttgtatttttagtagagacagcgtttctccatgttgaccaggctagtctcgaactcccgacctcaggtgatccgcccacttcagcctcccaaagtgctgggattacaggcgtgagccaccgtgcccagcatttacagctttacttattttttattttattttattttatttttttgagacagagtctctgtcgcccaggctggagtgcagtggcgcgatctcggctcactgcaagctccgcctcccgggttcacgccattctcctgcctcaacctctccgagtagctgggactacaggcgcccgccaccacgcccggctaattttttgtatttttagtagagacagggttttaccgtggtctcgatctcctgacctcgtgatccgcccgcctcggcctcccaaagtgctgggattacaagcgtgagccaccgcgcccggccatttacagctttattgacgtacaactgatatacgtcaatatgtctctccatgtaaaatgcatgtatttgaagtatacaatttgatgtgttttcatatgcatatacacccataaaaccattacacaatcgagataatgaacatatccatcacttccgaaagatccccgctttgtctctttttaataatcctccctaccttcctcatcctgcaactactgaaaattcttagaaatacaaactatagtaacttttgatctagaggactgaacagaacaacagcaaaaaagatctcaggacctgatgaagactcaggtgttggaagggagcagctggaatttagaactagttgagtctgagtttagcttgaagcgctcaccaatttgggtagcaaagcagcaaggaaagaacctgagtgttaggagagggtggcatcttccctagggacaaaaaccacaaagtaactgggcctagttccagttcaactggcaccttcaatctttggcctgggtagggtcttatgaggaggattatactgaaggcttaagctaaataaaaggatttttcctatttattaaagcccttttttggtgtgctgattataggtttaacatgtcttgtctctgctgctagactgtgaactcctgcaaggcttttatgtcctcagcacctaatgatccctgataagcactcaaatatttattgaacaaatatgcagccaactataaaatgctgtgagtttctcagtatgtagtgcgggtacatttcccttaagttggtattttctgggtcaggcgcggcggctcacgcctgtaatcccagcactttgggaggccaaggtgaggcgggcgcatcacgaggtcaggagtttgagaccagcctggccaatatggtgaaaccctgtctccactaaaaatacaaaattagccgggcgtggtgacgcaggcctgtaatctcagctattcgggaggctgaggtaggagaattgcttgaacccggggggcggaggttgcagtgagccaagtcgcgccactgcactccagcctgggtgacagagtgagacttggtccccccccaaaaaaataaaaaaataggtatttccatggatacagaaacagatttaatttggtgcctgcatgtgagtgatcagcttggttgggatggggcctctggagggtccaaggctttggaggaaggagagtgggtaggcagttcagagagggacagaaagatcccttttgtgggtaagaaaacccctctgttcatcttcagctacaccaaaggtatgggggctctggtggaggtattctgcacgtgtatctagggtagttactgttaggtacactttggattcagtaccccaggctttgccctagggagggacagttgtcatttcaaggaagactgctttatactgtcagatacctggttcacaccggcttagcagcagtgtgccaccaccccaatcccatacgtaagcgttgaggggtcacagaggtagtgagaatgatgggatccaaggatctcgtctctccagatccactcacaccaggagttaatctctccaacgtcgagctctgagtccctccctctctcgcccgagctccgccccccttccctcttggcggtcctggcgggcttcccctggagggggcggccccagcccgagcgctaggcggggcggagctccggcccgggcggagccgcggccgccgcgtccggctgctggaccgaacttctgccgtgcggacagcaggagcagcgccgagccccattcccccacctctccagctcgccctctgagcctcccgagccctctctccatttcccacaattgtgctggtaagtcccgctccccgcaccaaacttttttttgctgccgagtttgagtcctacgatcggaccacgagctgcactgtagttggtgtatgggggaggaggagagggtgaattactgaatgccgactccacggcttccctaagacggatcagcgctcgcccatttcccgagttggaagacctctcgattttagttgattaaacttatgcagagatggagatgagggtttgcgctccaacttcgctaccccctcccccatttctctgagctctagcagttcccgatactttccctccatctttcaagtatctttggctccctaaaagcttgtcccctcccaactctgccgtggcaaagcccccctccaccaggcacttcgggcccgcctcctccccgttgccctagggaccccgcgatcttgggggccatacactccctccggggctacgcgtcctgccaaccggccgcagacgtgtagctgctgggtcggctgtggagggaggggctcaggctggggcttgtccgaagccaggcgggcggggccgggaaggggaggtatagggggccggactgggcggagcaggcggcatttgcggccggcgccagggtggagagttgtgcgccggtccctgggcctgagctccggctccggctggggcgcctgcgatgtctcaagatggcggagctgggcgaattaaaggtaccggccccctccccccatccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggtactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggggcgctgtaagttgtagaggagtattaatttctctgtgtaggagagatgccagattatggttcctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccctggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtgtctcttctctatctcctggacatctgactttcagcctttctgtgcattcacccttgccctctgggggctacatgctgacatctcttcatctccctccctgttacagagaggttctgccaggagccaaatgtgattataccatacaggtgcagctaaggtgagttcatcctccctgcctatcctgggtacccactgggggtaggagtgaagtaggggtatgacagatacccttacgagatgtccctgctctgccactgcctactgcagccctgcgactcttgttggatgctgagggcttcaggcatctatgactgattttctggggttccctgtctctctgccagattcaagttaagaaatttcttcccactctttcttcctttctcatctcttaccaggttctgtctctgtgagaccagctgcccccaggaagattattttccccccaacctctttgtcaaggtcaatgggaaactgtgccccctgccggtaaatgctctccccttcttctgtcagtaatcccttaccgtttcagttcataaatattaactacaaacctattctgaaagagacatgcctagcacagtgcgtggcacatagtaggtgctcagtttactgactgaatcaatagaatctcgagagtattaagatagggctgaacaaaggttttgtgagaactcggaggaggacattagttcaacccgagatgtaagaaagacttcttttttgttttttttttttgagacagagtcactcgctctgtcactcaggctggagtgcaatggtgcaatctctgctcactgcaacctctgcctccctagttcaagcaattctcttgcctcagcctcccaagtagctgggattacaggtgcccaccaccctgcccggctaatttttgtatttttagtagagacggagttttaccatgttagctaggctggtctcgaactcctgacctcaggtgatccacccacctcggcttcctaaagtgctgggattacaggcatgagccagtacacccggccagaaagacttgaccccagagctgagagttagaaaaggtgaggcatccttattcctcctcctcagggactcagtgagttccttttttctcagtcaataaataagctctcctttctccccaggagtgaaccccacacataaccctagacagtgctccagttttgtgagccactgaatgggcctccatccccttggtcagtgagtgagcgagttggccttccctccagggattgaataacccgagacaagatatcttttgttcaaagagcagagccccttcccagagccacttctccactgaccaatccctcccttctccagggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcctggccctccagccttcataattaaacccatacctcttttttgacaacttactccccttctcacatgaaccccaaccctccccctctacccctgaccagtcttccagtctttatagttgaagttggaccactcccaggcacccttgaatttccaatcatgtatctgctttgcacctcacagtccctaactccagccctgctagaatatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctaggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctaggagtttgagaccagcctgggcaacatagtagaccctctctctataaaaaattaaaaaaattagccaggcatgttataatagctcatgactgtagtcttagctgctcaggaggctgaggcaggaggatggcttgaacccaggagtttgaggctgcagtgagctatgattgcattactgcaccccagcctgggcaacagattgagaccctgtctcaaaaaaagaaataatcctatgattggctagtgacactcacccagaaaaaaaaaaagaaaaaaaaaaaccctatgagataggtagtatcattacacatgaggaaactgaggccgagagagattgagccttgctcaaggttatattgttaagtggcagagccagtgtactgaactgtcataatatatcacctataacaactacctgacttcccactgagcattgcaataaggttcttttcagggcctggatgttctaatcttttgatcttgctagtcttaacctctttttggaatctacattatggttcctgttcccagtgctcccccactttttgtttgtttgtttgtttttgagacagggtctcgttctgttgcccagactggagtatagtagcacaatcatagctcactgcagcctcgacctcctggcctcaagtgatcctcccaccttggcctcccaaagtgctaggattgcaggcatgagctaccatgcctggcccctagtgcctttatttatttatttttacacaagtgtttagaaagccaaagacccagtgccttttggagatggtttatggacttctgtgtctctgctccttttgttccttatactacacgtaagtgctcagattttttttttttttttttttgagacggtgtttcactctgtcacccaggctggagtggtatggcacagtctcgtgatctcagctcatgcaacctctgcctcctgggttcaagcaattctcctgcctcagcctcctgagtagctgggattacaggcatgtgccgccacatccggctaattttgtatttttggtagagatggggtttcaccatgttggccaggctggtctcgaactcctgacctcaggtgatccacccacctcagtctctgaaagtgtgattataggcgtgagccaccacgccggctttttttttttttttttttttgaggcagagccttgctctgtttcccagggtggagaacagtggtgtggtctaggctcactgcaacctctgcctcctgggttcaagcgattctcgtgcctcagcctcctaagtagctgggattataggcatgtgccaccacacctggctaatttttgtatttttagtagagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggttggatccgggcctggggtcagacatggtgacccctcagtcattgcctctccctgggctgcctgttcgtgatcaaaacctacccgcaggtttcatggagaaaggcaggagcaaggggaaagggcattgcatattcttcgttatctctgactacccccgccacccccgcccagctcctaatcacagtcagaaccaggttgcttgggctcccctgagccctgtttccttccctcactgccagccctacctgcaactgctgctgtgattcctgggagatcacgagtagatacagaacaatgtgatggtatttgggtaaaccccagctcagcctaggagggtaggcagactaggaaaagaaaacagcaaaagtgagaactttccgtcactttttttttttttttaagatggagtttcgctcttgtcgcccaggctggcatgcaatggcgtgatcttggctcactgcaacctctgcctcctgggttcaagcaattctccagcctcagcctccagagtagctgggattacaggcgcctgccgccacgcccagctaaaatttttgtatttttagtagagacggggtttcgccatgttgtccaggctggtctcaaacttctgacctcaggtgatccgcccacctcagcctcccaaagtgttgggattacaggcgtgagccaccgcacccggccctttgtgtcactttttgagactttgttaatacagctttagggtgaaacaaaatggtggccaaaagctgagggcgtggatggtacagatgacacagcagggacatgggtgagggttatggatttggggattccagcccacttatgtgctattgtttcccttgtagccaaggcaggtaggggctgatctatggaggagcttctcccagctacttgtctcacctcccataaacccagagggacccaagagaactggccctggggcaggtgtagtccactctcctcccaaagttctcgaagccctccgtccagcagctgggagtcagagaagacacatcagaggggccagtgcctgactcttccaagtccttttgcttgcccctccctcagcccacacccaagatggtcccaggcatgggtctcttggctcaggttggatcagctgactggttacctcctcctcaagttccacgtgcccacctgcaacaacagtggggccagtaggtgaatggtggtggtcttggccagggagcccccactcactgttgacactcctctcccctccagtggacacagagggagttgcagtcccttgtgactatgaacatgccacattttggggcccactttatccttctgagactgggaaaaacattgttgcggggaaagggcaaatttcttctctgtacttggggccttgtccccagaatactcacccgggggtacccagaggttgggggaaacgctcagggtgcgtgcccttcgggttagcaagacagtcttgtcgctggactgcagaatgacggccacacccaggtccacacctcgatctgtgggcagctcagccccagggaccctgggccgctcctccagggccgcaaaagggcagaaagggggtcgctggcagaaggaagccagctgggttaaggcttcagaagggcggcactgggtgggcgtgacttccaaaaatggggctacaccgcgcgttgggggcggggtcctcgccgccagttcccacccgatttcagtccccatctttggcccttcactgcccccgctctggggcccccttctgccgacctggagcggaagcctagcggaggcgcctgggaagggcctgctcgagaggacaagccgtcctcgcttcaagctgcagtgaatgggccacgtcccgagccctggtccggctcccaggaggccacacacactccgtgcgaagctcaccgactccggacgccgggacaggagcagctgcacccgcacctcggccataacgcgactctggagtcgctgcggcccgcctggcgccctctggtggcctagagaagcttccccacggaacgttccgcggggtcgtagcggggtttccgaaagtccccggggaaataagggcacatcttttgaggatgacccatgggtataatattaaaccacaaagaagaatacctctaaatgctcagctcctattccttcctatcttctctgtttaggacaatgacccccagaccgactgacttcaggacccacatgttacttccaaccagccctaagctgaactgtaagcatcctctacagcactatgcacacctgttacagcaggcatcacttcgaattaattatctccaagcgaaacacaccaaataacattttcgataccacttctcctttcacttcactcaaatggcaaccaagtatgcagatgctatctccttaaacttcctcaaacccatgttctctccagccttcattcattgccctagtttaagccttcctcgtattttgcctgaaatattattgcaagtctccaaatagtcttgaccctaccagttcattctctacagtgctgccagagtgatgttttgttttgagagtctcactctacagcccagacaggagtgcactggtgtgatcccagctcactgcaacctccatctcccaggttgaagcgattctcgtgctttagcttccgaagtagtagctgggattacagggcgcccaccaccacgcgcggcctttttttttttttgagacggagtctcgctctgtcacccaggctggagtgcagtggcgccatctcagctcactgcaacctccacctccctggttcaagcgcttctcccgtctcagcctcctgagtagctgtgattacagatgtgcactacccacacctggctaatttttaaatttttttgtaacgatgaaatctcactgttgcccaggctgttcttgaactcctggcttcaactgatcctcccagtgtgttgggattacaggatttaggcaccatcaaaattatcttctagctgttttgaaatgtacagtaaattaataactatgccaccctgatctatccaacaccagtcttacttcttcaaactgtattatctgtgcccactaatcaacctctcttcatcctccccatccttcctagcctctggtaactaccaatctattctttattttcttgagatccacttttttagctcctatgtgagacagaacatgcaatatttgtttctgtgcttggtttattttacttaacataatgacctccaattccatccatgttgctgccaatgacaggatttcattcattcttatggctgaataatacattttctttagcctttcatctattgatgggcacttaggttgattccatgttttggctatcgtgaatactgctgcaataaacatgggagtgcaggtatctttttgatacattgatttctttccttttggagatatatatatacccagtagtggaactgctggagcatagttctgtttttagttttttgaggaacctctgtagtcttccacagtggctgtaccaatttacattcccaacagtgtaccaggcagggctctcctttttccacatcctcactagcattcattctttcttcttgataaaagtaatgaattggggtgagatgttatctcattgattttgatttccatttctctgattagtgatgttgaacattttttgatgtatctgtcggccatttgtgtatcttctttcgaaaactacctattaagatcttttggccatttttaagttggattgttctttttgctattgtttgagctccttatatattctggttacgaatcccttgttaagatagtttgcaaataaagcatcctcatctttcaaactatacattgtcactctctgtgttcccttccctgcctgacccttttccctttctggcctctctgtacatagtgtttactcttctactgtagcacccctaatacttcctggtacttatgtacttatttgtctcctcctactagactgtatgctcaaaatttattaatctttatatccccaaggcttaccccagtacttagcacaaaacaggtgcttagtaaatgatggtgactggcttgagggcagagatggtgtcttatttatctatccttgtatgttgtgtttagtatggtggctggcaattgtttgacactcaagtgtttaaacaattagaaaacacattggtgagagaaaactgaagatattataaaacaacatctaactgctttaaatgaattaaagctgctgggacaaattatatccgtgatactgagagagagaatttagcgttgccagttttaaggaaccatggagaagaggaaggcgctaatttactgtgtgcttaccatatgccaggcattgagctagctgttctacatacacagtttcagatgtgttagaagcctggagctggcaaatgtggcttcagtccacagattctagtgtgactgcttgggacaatccacctgctaaccctgaaaataattttttcttctactctgtgatagtctttcacattccctacactgtgtgtgttaaaaattacagttcatcagcctgggcaacacagggaggccctgtctctacaaaaaaaaaaataaataaataaaaaatagctgggtatgtgtggtgcatgcctgtagtcccagctactccagaggctgaggtggaaggactgcttgagctcaggaggtcaaggctgtagggagctgtgattgcgctattacaccccagcctgagtgacagagtgagatcctgtctcaacaacaacaaattatctatcatctatctatctatctatctatctatctatctatctatctatctatctatctatcacctatctcaacaaaataaagaacaggcatagacatctgaaaataaaattaacttcttaggaagtttcctattgccagggatataggtaaccataggtgtgggtaacttctttatgggaacagatgcatctgatagatgattaaccttgttgatttaaggttcttcccactgccaagatttgatgaggggagactacagcaatggatctaaatatgccaaattctttcaggtgtatcctgggctgcaggggatagagaggggggtttagttgaagactctgcgacttatcccactgcaaataatgcatccaggcacctcctttattttgctttccatccccccagatcttctgaggaagatgcttcttctggatcactgtctcttcatggtgcactcaatgtaagactccagcaggaagatggtttcgtccacctggatctcactggcatccaacctgagtgaaaagtaaaggcatttgcctagactgaatgttcattagcatatttaagattagaggttagggtgggtgtggccatggataactgcttggttacccttgagagtggatggaaagaaagcaggagaaccagtagatcattttgctatttaccgagcatctttatgtgccagacaccatgcaaactgctaagaatacaaaatacagagcctctgtcctgggggaaggtagtcttcatttgcaatcaggaaaacgaacgtaaaggcacaggtataaaaggacctagtgtgttttaaaatagcaagaaactaagagtgtctgaagcttaaagtgagtggtgattaggaagaaatggaagcttcttcagcctgacaaaagccatctaggaaaaacccacagctaacatcatacttaatggtgaaagactaaaagcttttctcctaagatcagaaacaaaacaaagatgtctgcttttgtacttctattcaaccttttactggaggttctagccagggtaatggggcaggaaaaaaaaaaagtaaaggcatctagattgaaaagacagaagtaaaactctctctattcatggatgacataatcctattataaaaaatctcaaagaatctgcaaaaaaactactagaattaataaatgaatttagtaaagttgtgggatacaaaatcacaacacaaaagttggttgtttttgtataacactagcaatgaacaatctaaaactgaaataagcgaccactaaactagtatccaaaaaaatacttaagaaataaatttaatgaaagaggtgcacaaattgtgcactgaaatgtgaaggtctaggaaagaggtgatgaaggcctgcgtgtggaccaagatgaaaggccagatttgagacacatgactcaagtaaaattaagccagcgcagtggcacttgcctgtagtcccagctacttgggaggctgaggcaggaagactgtttgaacctacgagttcaaggccagtctgggcaacacagccaaaaccccgtctcttaaaaaaaatttatcagtacttgatgaacaagagagtgtatatggtgatggagaagaagctcagaacatcttcagaattgctagtttacaaaaataggtggattaaattctgttaagtgagctggaggagacagtgagtttaggtttgctcatgctaagctggagggttacaggaggtcaaaatggattttctggatggtattctgaaatgcaggtctgaagtttatgatgcttacttgttgacattacgtttcagggtctctagctgctgacgttcaggagctgtgatcatctcctctatttcttgtaactgtgcttcctctgcaccagtagcctgcatagatgcaatgatggcttctaccctctgagatttttctagtagacgcctgtcaaacaaacacaactctgagacatcttccctaacctgggagattctcttaccacgtgtgtctgaggcactacccaccaccctttaccattttcctgatcaaagtagataatgtcaccttctaaggacattttctacaaacttatttggaaatataacttcactcctgaaattcttattgcctctcatttgcacttaaaagtttggtgcttttgtacgtttctcacaaatttaatctgaaaaattatttcactgggagcatgttagaaaagtgtagactaatgcatgatttacactaatctaagccaatgattcaatgcaagtagactggttgctatctctactggttcctacttctcaaaaaaaaaatttttttttttgagatggagtctcactttgtcgcccaggctggagtgcagtggcgtgatcttggttcactgcaacctccactcactgggtttaagtgattctcctgccttagcctcccgagtagctgggactataggtgcccgccaccatgcccagctaatttttgtatttttagtgaagacagggtttcaccatgttggccaggttggtctcaaactcctgacctcaagtgatccacccgcctcagcctcccgaagtgctgggattacaggcatgagccaccctgccaggcccagcgtctattgattcctatttctagaggaaatttcccctgaggcccttgatcttgaaagatgtaaataactcaactgaaaatgttacttacttattctctttggtttcaaattgcctcctttctatcaagttggctatgctctgaggaaagagaagacagacaaggaatgcacatagttctatttcagcagctcagggcgaagtgggcacatgaggggtacttgaccgtatggaggaaatggggagaaggtccagattgagttaccttgtagcacctgtgcaacaacattcgggcagctgacaggatgttcacagtatataaatagaaggtcctggatggggcatggtctggtgttttgggaatttcctatttgtccaatagaaagaaaaatagcagaaattatactgttttagaactggcaaagcacacactcattctacctggagttacttagccctcctttttacttacactttcctgtttcctagtcattcagtacctgtgtttattttatttatttattttgagactgggtcttgctctgttacctaggatggagtgcggtggcgtgatatcagctcactgcaacttccacctccggctcaagcaatcctcccacctcagtcccccaagtagccggaactacaggcatgcaccaccatgctccgctaattttttaatcttttgggggtggtggagacatggtctcactatattttccaggctggtcttgaattcctgggctcaagtgatcatcccgccttggtttcccaaagtgctgagaatacaggtgtgcccggcccagtctttgtggtttatgtcataatcagtcaaatggagagctgggcttccctgttttttccatttgactgtcagcatcctgagctggggaagaaagggagggcaactaacatttactgaacaactctatgtgccaggtaaattctatttgatctttacaaaaaatcgtattattattatttttgagacagagtcttgctctgttgcccaggctggagtgcagtggcacaatgttggctcactgcaacctctgcctcccacgttcaagcaattctccttcctcagcctcctgagtagctgggattacagacacacggcaccacgcccagctaatttttgtatttttagtagagacagggtttcaccaggttggccaggctattctcgaattcctgacctcaagtgatccgtccgcctaggcctcccaaagtgctgggattacaggcatgagccaccgcacctggcaaccatattatttttattatcaccatccatcactgttttatagatgggaaacgtggtaacttgcttaatgtaactgggtaaggcagagctgtaatctgactccaaaaatccattctatctatttactcatatgctctactaaatagccctgcaaagactcagttagatgtgttgataaatttaaactataacagaattaaggcttaaggaaggacagaaatgagaagagaaaaaaaggcagggtgggtttggggtgatgtcctggctctgcctcttttttgttttttgttttttttgttttttgagacagagtctcactctgttgctcaggctagagtgcagtggcttgatctcggctcactgcaacctccccctcctgggttcaagagagtctccttcctgcctcagcctcccgagcagctgggactataggcgtgtgccaccaggcccagctaattgttttgtattttattagagacggagtttcaccatgttggccaggctggtctcgaactcctgacctcaagtgatttgcccaccttggcctcccaaagtgctgggactacaggcgcgaaccaccgtgcccggccacctctttctcactagggcagttaaggccccaaattatcctccaagtgctcgctatgtctctgtgaatcatgtttttctgtctcagagctggatatagagtttgcttgggggttcagtatgtttgcctaagaagcttctctcaccctaggccagctttgctggttggcaattattacgcccttggttggttacctggagtgacatgaaattttctgagagcatcttatatagcatatcctttgcctcctttgcaggaatcattgcaaagtcttccacttgcttctgctctatgtgtttcttctgcaaaactagacggaatattctagcacagcgagacccaaatctggaaaggaatgaagaaagcaaatggcatgctaacatagatcagctttagttcccagtcacagatggggtggttgttctattccatgtgtgaagccagtaccagacaggaacagtgatcagaaaattattctacagctccataggttggtgatggtaaggcatcaccaactgctgttaatcataaggcagtcaccaactgctgactcatttgagtgccacagttcctacatttgtaagcaaaggctttagggaggctggttaatttgcatcggtaggaattaaacagtaggttattttaaggtaaagagcagtattacatgagatccataggagtccagtgaaaaaatggggaaaagtatgccaaggtgtggttatattggtggcttacataatgatcaaattacttcactggggataggaagtatgtgatcccaaacccaaccagtgtcccccttacctctcctgtacgacggactccagagtggctgtggctagggatgctaatgccttatggaggtctttatgtagagaattaaggtcactcagtaatgttttggcctagttattgtgatctgagttttattcctaagtttctaatttataattaaattttaaatgctattttgtttttcatgttataatttatggtttcagtcatggtacataaatattccaaaactttaatacaagtgtttaagtaagggttttgcttaactaaaatttggttgattaaaagtcctttttccttttcttttttgagacagggtcacccaggttggagtacagtggcatgatctcagcttactgcaacgtctgtctcctgggctctagcgatcctcccacctcagcctcctgaggagctggactacaagcatgcatcgttacatctggctagtttttgtatttttggtagagatggggttttgccatgttgcttagctgatcttgaactcctgggttcatgcaattcacctgcctcagcctcccaaagtccaccatgcctggcctctttttacttcatcatcaatgcagttcactgaaaattcatagaaaaatttatttaacaattacttcaattttctaatttatttagtataataaacattaccaaatctttctttcctaaggcaccattctgatttataggtcaggctgcctgactctaaggaaataactggtaaggatactgatgacatacattcctccaccactgtcgccagactttccaacaaactctagctattaagaaaaagagagagtgttaactgaacggaaagtccagtgattctgtttccaatggaacaaatctgaccaaaagtctgcagcaggtagccctcctatcaaatgatgtggagaaattgtctgggctggctaggtagagaataactctgcaggaggatgatactaggtatcagtgcagaaataaattatcaacagtacaggctaaagaaaaaagaaaaaaagcaaaaacagacttactggatcatctgccagcagagtgagatactgatcaagaacttgcttagagatgttatagccaacaggtagggatctgaagatctatggagcaaaggacacttaaaatgggtttgggaacttagaactcctgaccttactgaaataaagatgttttaggccgggcacagtggctaaggcctgtaatccgaacactttgggaggctgaggcaggtggatcactttgggtcaagagttggagaccagcctgaccaatatggtgaaaccccgtctctagtaaaaatacagaattagctggacgtggtggcgcatgcctgtaatcccagctatttgggaggctgaggcaggagaactgcttgaacctgggaggcagaggttgcagtgagccgagattgcgccaatggactccagcctgggctacaagggcgaaactccgtctcaaaaaaaaaaaaaaaaaagttttaattttagttaccacaaaactgtccaaaaatattcacagcaggattgtttgtaagagtaaaaaactagaaacacccaaatgaccagtaccgagtacactaaaataaaatatagcacggccattaagtggaatatgatacagtcattatgaagagtgagacaaatctacagaaactaacatgaaaggaagttttacatacactgtcatataaaaaatcaagttatagaacagtatgactaggttgggtgtggtggatcacgactttgtaatgccagcactttgagaggctgaggtgggaggatcacttgatgtcaggagttcgagaccagcctggccaacacagtgaaaccctgtctctactaaaaatacaaaaattagcctggcgtggtggcatgtgcctgtgatctcagctactcggaaggatgagcaggagaatgccttgaacccaggaggcggaggttgcagtgagctgagattgcgctactgcactccagcctgggtgaaagagtacaagactctgtcacaaaaaaacaaaaacaaacaaacaaaacccaaccaaaaagccatatgaatagtcccattttggggttaaaaaatacatatacccacatatatgttagagtatgcaaggtctgaataaagatatataccaaactttttttttttttttgagacagagtctcactctgtttcccaggctagagtgcagtggtgcgatctcagctcactgcaacctcccattcccgggttcaagcgattctcctgcctcagcctcccaagtagctgggattacaggcgcccatcaccatgcctggctaatttctgtaattttagtagagatgaggtttcaccatgttggactatgctggtcttgaactcctcaggtgatctgcctgcctcggccacccaaagtactgggattacgggtgtgagctgctgcgtccggcctttttttttttttttttttttttgaaatagggttttgctctgttgtttaagctggagtgcagtggcatgatcatagttgactgcaacctcaactcttgggctcaagcaatcctcctgcctcagcctctcgaatagctgtgactacaggcatatggcaccacacccaactaattttttaaaaaaattttttgtagagacgggggtcttgtcatgttgcccaggttggtcttcaactcctggcctcaagggatccttctgcctcaacctcccaaagttctaggattacaagtgtgagtcactgcacctggccacagaactttaaaataaacaatataaaaatataggaatatttaaacatagtcatgcaccatataacattttagtcaacaacggaccgtgtgcagctgtggtcccatattatactggagctgaaaaattcctactgctttgtgatgtcatagctgttgtaacatcatagcacaatgccgttgtgaaacacattactcacatgtgtggtgaggctggagtgcagtggtatgatcttggctcactgcaacctctgcctcctgggttcaagcaattctcctgcctcagcctcccgagtagctgggaccacaggcgcatgccaccatgcccggctaattttttttttttttttttgtattttagtagatgggtttcaccatgttgcccaggctggtctcaaacgcctgagctcaggcaacccaccagcctgggcctcccaaagtgctaggattacaggcgtgagccaccccgctcagcctgttactggtttttaataaatacagtgtagcctgagcgtgtagaccatcacattcacattaatctgccattcattcactaactcccacagggcaacttttagtcctgaaagctccattcatgttaagtgcactaaacaggtgtggtttttaatttttcataccatatttttactgtaccttttctgtgattagatgtttagatacacagatgctactgcgttacaactgcctacagtattcagtacagtaacatgctgtacaggtttacagcctagaagccataggctatcccgttcagtctaggtgtgctgtagggctacaccatctaggtttgtgttaagtacaccctatgatgttcacacaatgatgaaatcacctaacgacacatttctcagaatgtatccctgctgttaagtgatgcatgactgtattactatgaaagtaatataaataacacatattggatatattaaatatcgatattttaagtacagggggtcaaataatgtcctgaatgccaaggctctcagagtccaaattgtggattcttaaaataattaggaataggctgtacttgacgaatagatactttgactaagtgaatagtgtagatttttaaaagctggatcctaagagaccaaacatttcagtgctcatcacttgaagataatccctgctccacatcaaatgcccttctctttcaaggctcagacctcaacccaaactcaggatctgtgtataataaacgttgataacacccaagaatctgtcagaaagttagtgcaagaacatgaaactcacctcattggaagacaatggctgggtgaagggagcactagaggaagtggtaatctcactcattcggagcatggttcgcacaatctcgctgcttgtctgtttgaaaagtaaactagaattcagaaatcacagtgctgcccctggctctatgtgccaatggccatatctgacaaataagtaaatgtccctgatgaccaatgacagacccacttaggtattacctggtccatcctgttagcaactgcgctcacaatggcttggtcacggaagtgttggtggaatctgtcaaggttggcctgccaataaatcccatcatctggaatgggctgaggaagagatttagagaaacatttagctatagtgtaaagttttctggtgaggagcttggatttaatggttcaccatttcttttcctacacagtaacaattacattggttggaaaaaaatcattcagtcatgtagactggtgtctagacaaattccgacttcaaacaggttttctaagctcatctccaatctttctctccctattttattatttaacatttattttaatttttttctgagacggagttttgctcgtcacccaggctggagtgcagtggcatgatctcggctcactgcaacctctgcctctcgggttcaagtgattctcctgtctcagcctactgagtagttgggattacaggcaaccaccactgcgctaggctaatttttgtatttttagtagagttggggttttacaatgttggccaggctggtctcgaactcctgacctcaggtgatctgcctgcctcggactccaagtgctgggattataggtgtgagccaccacatccggcctttctctctctattttaactcttctccattactttcaagtctccaacttgacccttcttccttctcactctcggcagatgactttgcctctcatttcacagagaaaatagaagacactaggccagaactcactcagctctgtgcacatcctcaccacatttcttttttgttcttgattcatattttcactcacttttatcacagctgaaaaatgctccttttacctaaggttaatgcccatattggtattccaaatcttactctctcattcattcttggggatccagctctattttaccctgtcctctaacatcttcaggctttccttctctaccgccttcttatcagcctttaccctgtccaagtctctttctactctagaattctctttcaaccctatgccttctcttcttttccttactgtcacagccaagcttctcaaacagttggccatctcagttgtatctctacctagatttacgcaacccatttccactattgtactgaaatgtcaattgtcactcgcattccagtgaaattccacaactgtccttaaggattctatgttgttaagttcaaataataatttccacttctgatcttatttaaccttttggaagcatatgacatggttggacattttttccttcttaaaactttatgtggctccttggttttatgacaccattttttttttccttttaaagacagggtctttgtcacccaggctggagtgcagtggtgtgattgtagctcactgcagccttgacctccctgggctcaggtgatcctctcatctcagcctcccaagcagctgggaccacaggtgcgtgccaccacgcttgggtaatttttgtatttttctgtagagacggtctcaccatgttgctcaggatggtctcaaattcctaggctcaagcgatctgcccgccttggccttccaaagtgttaggattacaagtgtgagccactgggcctggccgacaccattttttcttggcgttactttgaacctttctggctacctttcctcagtatccacagattcctctttcagatcccaactgtaatcctggtgttttgtcagggttctgtccatacctttcctttctttttactctacatgctctacttgggtaattttatctgctctccaggcttcaactattgatgcatttccaaatctgttactctatcctagaactctctcttttttttttttttttttgagatggagttttgctctttcgcccaggctggagtgaagtggcacaatctccgctcactgcaacctctgccccccaggttcaagcgattctcctgcctcagcttcccaagtagctgggattacaggcctgcgccaccatgcatggctaatttttgtatttttagtagagacggggtttcgccatcttggccaggctggtctcgaactcctgacctcaggtgatccacctgcctctgcctcccaaagtgctaggattacaggcattaccgcacccggcctatcctggaactctctattatgctccagatgcatagactcagctgcctatttgacacttccatttgttccccaaactgttctgttttgtaagttttcaggtaactacactataaccaacccaatttttttttttttttgagacagggtcttgctctgttgcccaggctgtagtgcagtggcaccatcatggctcactgaagccttgacttcctgggctcaagtgatcctcccacctcagcccctgagtagctgggactacaaacatgtgccaccaggtctggtgtttttttttttggtacagatggggtctcactatgttgtccaggctggtctcaaactcctgggctcaagtgattcttctacgtcagcctcccaaaatgctgggattacaggcacgagccactgtgcctagacaacccaatttcttttttttttttgagatggagtcttgctctgtcaccaaggatggagtgcagtggcgtgatctcagctcactgcaacccctgcctcccaggttcaggccattatcctgccgcagcctcccaagtagctgtaattacaggcacctaccaccatggccggttaatttttgtatttttagtagagacggggtttcaccatgttgaccaggctcatctcgaactctgacctcaggtgatccacctacctcggcctcccaaagtgctgggattacaggtgtgagccactgtgcttggccagccaacccgatttcttaagctacaaacttgggtatcacccctagtcccttgctctccataatctaccaccccattaccaagttctatctattctttatatttatcagatgtctacttttctttctcctatcattaccttatttcagactctaaatcttggcccatctggattactacaatagcctcctaactgggtttttttttttccctttaaaacatagcagacactataaaaggagtaactgggttttctccttctaattttgttttgcatcattcttcccatttcttagagtagtgcttttttttttttaaactgttttgggtcacagttcctttgaagaatgtaatgaaaggtacggagagcttcactgaaaaatgcacgtaagtataactggactctctgaaatccatccatggagtagaacaagttaggaactgctgtgctataataatctttctaaaatataaatccagtcacttcatttccctgcttaaaatccatcaatggctctcctttgccttcaggataaagcccaaacctcttagacaaacatgtacacaaataataaataattccagttataaatataaatgctgtgaagtatatgaaatgagaaatgtggtaggaactagtgtaggagtgggcaatggtgcttgaagtctatgaaaacagcatttaagatagaaatgataaaaacagagaccactacatgaagatctggggacaaacatttgaagccggagccaaagtctaaagaccagaaagagtttgacatgtttaagagataaagtcagtagagggaacacagtgagtaagatggagacggggcagaggtgaggttgaagagccctgtctccagcagatcatacgaagacctagatcacgtaaggcttcctagcccgtaccttggatttcttctaaaagtaaaggaaagctattaaaggagtctaatcagtggatgtgttgttttgttttgaacaacttagaaagtcattttggctactaagtaggtaagaatgcagctagggagaccattaacgaaagcgtttgcaaagagttgagagatggcagtgaaaagatgagaaatggttggatttgaggtaattttggaaactgggctgatatgttttactgtgagattagagggttccaaggattttggcttaagcagaaatggtggtgtcctaggcggctggcctacgtggtagtgtcttttactaagatgaggaagtttatgagggagcaagatatttgggaggaggaatcaattattctgttttggccacactaaatttgagatgcttactgacatctttataggtacgctaagaaggcatttgaatatgagttcaggcctatgtatagtttttagacccatttttcatcactggcccctgtaggtctttaggttctcgccatattgagcaacctaaactttttctaggcccctttttacataagctgttacctctgttcaatgaaagaattaagttaaggctcagaagggagacagtaatggttcattctttgttagtctattcctaatatttaatgaggttcataatcctactgcttcttagctcaggaagctttaagctctcttggggcttgttatctgagtgctctttctggcctgcttcagggtgaggacttctaatcaagaagccccattacctccttgttatctgtagtatattttggtctcttggccttgggctccccagcagcatcttcatcagatgatctcctccttttacctttccctgccaaacaaacaattaaacacttagactatatctcatatgatgacaggaaatgaccaaacatgagagcaggtgtctttcattccaaagacatctgtagctgcctctagatcagagttgcttagggggctgaagagctataagaaactcaagtaactgatgaaataatctgaaactcaacatgttcaaaaagagtcttatagtctttctcctccaatgctctctttcatggccagtgatatcatcctcccacatgtgcaagtcagacacacagatgtcactcttagtacttgtttccttcaccctctctctttcattttccaccagtctgtcaacatttacctttgccccattctcccatcctttctgtagacaaaaaatcttttgaaagtgcaaattagatcatgtcatttccttaaaaatccttcagtggtcttcctttgctcttagcataaagaacagatgctctataaggtcttacttgattcagcccctgcctgtctcccatccaagtactaagcaggttgatcctgattagcttctgagatcagacccctgcctagctatgtctctaaccttacctcatgcctctcttgctttgcttacaatgctttagctatactgacattctttcatttcctcaaatgctatttttttactacatactattccctctgccaaaaatgcttttcctgttacctcactgttagcttctacttcaaatcttagctcaaatgccaccttctcaaagaaacatgaggcctaaactcccagatgaatcccgtctctcgttatatattttcttttcttttttttttcccgagacagagtctcactctgtcacccaggctggagtacagtggtgcaatcttggctcactgcaatcgctgtctcctgggttcaagcaattctcctgccccagcctcccgagtagctgggattacaggcgtatgccaccatacctggctaatttttttttttttttttttttgagacggagtctggctctgttgcccaggctggagtgcagtggcacgatctcggctcactgcaacctccgcttcccgggttcatgccattttcctgcctcagcctcccaagtagctgggactacagatgcccgccaccacacccagctaattttttgtatttttagtatagacggggtttcccggtattagccaggatggtctcgatctcctgacctcgtgatccgcccaccttggcctcccaaagtgctgggattacaggcgtgaaccaccatgcccggctacctggctaatttttataattttagtagagatggggtttcaacatgttgcccaggctggtctcgaactcctggcctcatgcaattcgcctgcctcagtctcccaaagtctccattatatattttcataacacctcatacttttccttcatggcacttattacagtttaattatatactgatgtgattttctgattaatgcatgtctcataatactatgacagttccttcataggaatatttccttcatagtacttatcaccgtttaatgatatatcgatgtgattttccgattaatgtatgtctcctatactaaagccccatggcagagaccatgattttttcattgttatacaccacgatgtctggcacatagcaaatacttggtaaatacaatcacatttcatacacttgacaatcaagaagaatccacaattaaggcaagtcacagttccaggggttaaaattccttacctatcaagctgagtttaggaaccaggtacatgtccttttcattaatgacaagtgtgggggcaggtggtggtggcccagggtctgaattctcagtggtaggtaccgaagggcagcgttgtacaaagtgtgtgtctgccagtcgcacaaatgtgtttgatacttcagcatagtccatggtcttgccatctgtataacaggaggaaaaaggcagatgagatggcctaagatagctcagggttcactcccatagccagctgatctatgcttttgttaacagctatggataccatactgaccctccatggtctctgtgagccggtctgccactttcttcacaacagctgacattgtcagtttgccgttcaacagaagctcctcaacaatcagctctccagtgtcactgtacagagttttggtagtatagatgtaccggggatatctaagcattcgcaatacccggctgcactgggcttcatactccaccacaccacgtttgtgcacttgataactcaccaggttatgttggacgaggacacacagggctttcttcacctaaatggaacataaagagaagaaagagaggaaagacctgaagatatagctcattactgctggcaattttttgtccaacagcttagtaagcatcagaaaatggctagataatttctgcacttatttcctctctccactggaggagctaataagaatcacacatcaatacaataaatcaggaagattccttgctatatttcctctgatccttatctctcaaaacacaatttactttcatcattctcattccttaaaggcagtactgagattaatagacttattgtgaataaatgaggtacggcatgggaagagcaaagatttgcctaaaagctgtgatgaactaggaacactttgagaaacaaaatgttgatgtctaagtctcatccttttctccccgaaataacattgttctgctccaagggcaggctttcttcatttttccttttctggggtgagaagaacaatattcaaaggtgggtgaaataaattagtgaaagaaatgagagaaaatgaatgtcatttagacatacctgatccagtgatgttcctgtgtcatgggcaattactcttagtggctggctgccggttcttatcagatggactccaattttttctacaatctctccaaaatgctcttgcagcaacaaagaacagagcttaatttctgcttgagtcattgtactggggagtctgagagctagggaaaaaacaccaaaatggtacaatagaaagtctttcacgctggaagcagagctgctgagtgtaaattcatgtattctttctggagggcaatttgacaatacatatcaaaaagccttaaaaatcttgcatatctttgaaacaacaatttctttttggatattgtgtccaaagaaagaaaaagctaataataatgaagtcattagttctctttataataccgacttagtggaaacaatctaacgtctaacaataaatgatgccatacccatacaatggcatactacaccaacatttaaagttatttagtacgatgcgtattcatgtagaaaattattcataataggctggcgcggtggctcaggcctgtaatcctagcactttgggagaccgaggtgggcgtatcatgaggtcaggagtttgagaccagcctggccaatatagtgaaaccccttctctactaaaaacacacaaaaaaattagctgggcgtggtggcgggtgcctgtaatcccagctactagggaggctgagacaggagaatcgcttgaagccgggaggcagaggttgcagtgagccgagatcgcgccactgcactccaacccgggcgacagtgcgagattctgtctccaaaacaaaaaaaaccaaaaaaaattactcataatatattaagtgacagaagcaagctgaaaaaatataaaaattcaattattgtaaaaaaaaaggaaaaatgtatgcataggaaaagactatgcatcaaatttatctctatgggattatgcgtgattctgattttccttaaagattgggagatgattttgcggtctgtcacagaccttagtttctacacttccctgcttggaagaattaaggtcactgttcacagctcggtgggagtgaacaggcagtgttattctcagtccataaaggaaatgataatttcgaaaaagaaatttaggaggtaaaggactgcttctcaacagggtgtgtcaaacaggagatgaggttacgttgtttgcaggacagtattcaattcttaaacttctactccttgacaaagttgacacaatcagaaacggacgtagttaattttatgattacttccttattacaaattgctaccaaacattgtttacttatttcttccaattcctaagaagccaagtctttgcctccccgtccccaccccgcctcagtatcaccagagacctatttcgtccatccacatatctttggagaagcattcccagatcctttgccatcctcggaaagggcttccaaggcgcttggctcctagctctacacttcctttacacaggttcccgtttcggacgtggtctcttggtccagtcagtgccgccacgttcagacagcattttccactaacctcagggtcagcgcaatccgggggctccaactccaattcggctgagcttcccgcgacggcttcctacggctcccgctggccttctaggccgaggtggagcccaccgccctttctaggacgcggatcgccaccgaagaagacgcggaaaagcaaaaagcgcgtgccactctaccccagagtttcggcggcttccggggacgctctttctttcttctcgctggaagactggaggaccagcgaggggctgtttgtggagccggcgggcgggccgtttgtctctccttcctgcgcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggtaagagcgctgtgttctctatacttgggaacctcatagattcctggccccgatttcccggaactgggtctggagctttctgcacatcattgactcgcccgacatcggtctgccgaatacctgctgcccacttctaagccgccggccctaaaccctgggcatcacggcctcggccccgtacctcctgcccacctcttaattcatcctgggctgctccacctgacctcacctctttacctcccgtgtccttaatttttttttttcttagcaagtttccctctgataactctcccctcaattttcttgcattcttttatacctggtctttttcctacgatgacctccccccacacttcttccactgtgtcttctcaccttcctctgtgttcttttccacttttcaccccccaccgcccccgccacctcccttgtcagtgaagcgaaatagcggattgctgaggattgtcactcttcggttttttctagggaaggaagcacagaaagggggttggaaggtatctgtggggcgaaaagggggattttgctcttcagtggtttccagggtccttgtgacagtgaagacagcagcgtactaatgacttgcagacggtctgcactcctatcactgttgaaggaaatggctttaggaagaaggcaggacgtactgtttcaacttcgtttattttggttgtcatgctgccagtgtctttaatatcattgttccgccccccgccctgtccctttcttcacctaagaaaaagagccgggacagaatgttggggatgcttcctctgacgtgaaattggttttcacgagtttctgccagagtgttagccccttgagaggcagtgctgtggttgggaagaaaacacttttgtaggtcaggcgcggtggcttaggtctgtaatcccagtgctttgggaggacgaggcaggaggattgcttgaggccaggagtttgagaccagcctgggcaacagagtgagacccctctctacaaaaacaaacaacatttatgcagcatactagccagcaccagcatcacaaacccagaagctgttttgggttgggttgtagctactacgaggagctcccccagagtgaatgtcaatcctgtccttggccaactgtctttatggttgttcctttccttacaagtgtccaggttcagtcttgtgatagagtggcaacattatgtttctatttatggtgtctcagatacagtgtaggagaaaaccttctgaagtgagtctgtatatcttatttcttagaaacacaaatggagtccagtgaataagtgcttaaagggtgttttatagtcttctctcactcaaaagttttgtttaaggcattatgatacattctttcctctctacttgccgcaccccctacttcagagtcatagtttcatctaaatgctacttagctgtttttcttttttcttttttttttttgagacagcctctgtctatcacccaggagcatgatttcggctgactgcaacctccacctgccgggttcaagagagtctcctgcctcggcctccgggtagctgggactataggtgcacgaccaccgcaccctggctaatttttgtgtttttagtagagatgcagtttcaccatgttggccaggctggtctcgaactcttgacctcaagtgatccacccgactcgggctcccagagtgctgggattacaggcgtgagccactgctccccgcctaaatgctacttagctttgtttgctgattttgctgtgtgtttatgtttttttttttggccatatttcagtgctgggaagagcaggtgtctagtttttttccagccaacatcagagcctgcagaactcttttaccatagagagggagtctggaattcagccagtatgtgtgtgaccagtggtgtgttgttgaatgtgatgccttgttgaatattccatccttagcttttttgatctttaagttgctgttcactattttgcctttaagagtgagaagttggccaggcgtggtggctcaggcctgtaatcccaatactttgggagtccaaggcaggcagatcgcttgagctcaggagttcgagactagcctgggcaacatggagaaaccccgtctctaccaaaaaataaaaaaatttgccgtgtgtgtggtggcatgcacctgtagtcccagctattcaggaggctgaggtaggaggattgcctgaccccaggaagcagaggttgcagtgagctgagatcgcaccattgcactccagcctgggcaatagagccagaccctgtctcaaaaaaaaaaaaaaaaaaaaaagagtgagaagacagtctaaacttccccaattgattatatcttttcttctcacctttaagtccttacttcaaagggataatttgaaaagctgaataggtgtttttctaagccttagttaatgcctggagaagtttcttgatctttttggtgtgatatattatttgtcatatctgatttgtaaattgaggcctaacacaattgagtataaccggattcttcctaaatatatccaaggttctctgctgagtgtcctggaggtgatagggagtgatatgtggctcctgcccttaaggatcttacagcttttggggaaagacaaggcaaacatagaaaaagtaacagcataaagggaatgaggatatgtgctttaggattcagagaggggaatttcatagcgttggtgtggccagtgggatttaaattgagttttgagggatgggtgcatttcagattgagaattccaaagactgtgaggtagcaaaaggaagagggagttgatgaagaagggagaaatatttaataaatcatgtttttttcacaactaaaagttgtatactatattttttatagtgttcagcatgatttgatatatgtatacactgaatggttaaatcaagctatttaacatgcattacctcacatacttatttttgcgtggtgagaacacttaaaatctgtcttagcaattttcaaatatacagtatattccctttttctttttttgagactgagtctcgctctgtcaccaggctggagtgcagtggtgcgatctcggttcactacaacctccacctcctgggttcaagcagttctcctgcctcggcctcccaagtagtggggactacaggcacgtgccaccatgcccagctaatttttgtatttttagtagagacggggtttcaccatgttggccaggatggtctccatctcgaccttgtgatatgcccaccttggcctcccaaagtggtgggattacaggtgtgagccactgcacccggcctctttctttctttttaaatagagacagaatttattctgtcttgttgcccaggctgttcttgaatttgtgggctcaatgtgtcctcccactatatcctcctgagtagtagtagataggtgtgttccaccatgcctggctaatttttttttcttttttgtagagatgggattttgccatgttgccccggctggtctcaaatttctgggcttaagcaatctgcctgcctcagcctcccaaagtgctggggttacaggcatgagctattgcggctggcctgatatgtggtatttgtttttaattctgtttatgtgatgaatcacatttattgatttgcctatgttgaactaaccttgcatcccaggagtaaagactacttgattgtggtagattagcttttaatttttatttatttatttttttgagatggagtcttgctctttagcccaggctggagtgcagtggaacgagctcagctcactgcaacctctgcctcctgggttcaagcgattctcgtgcctcagcctcccagatacctgggattacaggtttgcaccactagacctggctaatttttgtatttttggtagagatggggtttccccgtgttggccgggttggctttgaaatcctgacctcaagtgatctgcctgccttggccccccaaagtgctgagattacaggtgtgagccaccacactggcctgcattagctttttaatgtgctgctggttcagtttgttagtattttatttagaatttttgtgtctgtgttcattagggatattggcccggagttttcttttttcattgtgtctttgccaggttttggtatcagaatgctgctggcctcatggaatgggttagggaagagtccctcctcgattttttggaataatttcagtaggattggtacaagctcttcttcgtgtctggtggggtttggctgtgagtccgtctggtccagggccttttctgattggtaagttttttatttttcattattttttgagacagggtctcactgtgtcgcccatactggagttcagtggcatgatcacggctcactgctgcagcctcgacttcccagactcaggtgatcctcccaccttagcctcctgagtagctggacctacgggtatgtgctaccacacctggctgttttttttttttttttgagagataaggtttcgtcatgttgcccagcctggtcttgaactcctaggctcaagcgatccgcctgcctttgcctcccaaagtgctgggattgtaggcatgagccatggccctggccaggttttttattactgattcaattttggaactcgtcattggtctgttcagaatttcagtttcttcctggttcagtcttgtgaggttgtatgtttccaggaatttatctggaattttaggttttctagtttgtgtgcataaaggtgtttgtaatagtctctgagggttctttgtatttctgtgggattggtggtaatgtcagttttgtcatttctgatggtgtttatttagatcgtctctctttttttctttattaatctagctagtggtctatcaattttattttttgaaagaaccaacttttggtttcgtttatcatttatttgtatggattttcgcatctcaatttcattcagttcagcactgattttggttatttcttctgctggctttggggttggtttgttcttgtttttctagtttctctaggtgtgatgttaggttgttaatttgagatctttctagctttttgatggaagtgtttagtgctataaactttcctcttaatactgctttaactgtatcctagtgattctggtatgctgtatctttgttttcattagtttcaaagaactttctgatttctcccttaatttcattttttactgaaaagtcattcaggaacaagttgtctcatttccatgtaattgtatagttttgagagacctttttagtattgatttctattttaattgcactataatccgagagtgtggttggtatgattttggtttttttgcctacgcacttctcaaaagaagacatatatgcagcccaataagcatatgaaaaaatgctcaggattactaatcgtcagagaaatgcaaaccaaaaccacagcgagataccatctcacaccagtcagaatagctattattagaaagttaaagaataacagttgttggcaaggttgtggagaaaagggaatgcctatacactgccggtgagaatgtaaattagttcagccactgtggaaggcagtttgatttcccaaagaacttaaaacggaactaccattctgcccagcaatccattactgggtatatacccagaggaatataaatcgttttaccaaaaagacacatgcacttgtatgtttattgtggcactgttcacaagagcaaagacatggaatcaacctagatgcccatcagtggtggacttaataaagaaaatgtggtacatatacatcatgggatactatacagctatttaaaaaaaacaaaaccgaaatcatgtcctttgcagcaacatggatgcagctggaggtcattatcctaagtgaattaaagcaggaacagaaagccaagtaccacgtgttctcacttaaaagtgggagctaaacattgagtacacatgggcataaacatggacacgagggcttacttgaggtggtgagggtaagaggaggatgagggtcaaaaaactgcctatcttgtactatggtcagttgctgggtgacgaaataatcagtacaccaaattccagtgacacagtttatccgtgtaacaaatgtacatatgtgcccccaaacctaaaatcaaaaaaaatatgtgtagaaaacaaagagcaaaatgaaggacctaaaacctaaaaaccatttatagtcaatatataaaaaggcttaataccccagttaaaatcagatatggataaattttataaaaacaaagtaaacaaagagggtactgactcttgtgatagttggataccaagaaccatccctcactggggcatgctgtggctcacacctgttataccaacactttgggaacccaaggcaggagaggattgcttgagcccaggagtttggcactagcctgggcaacaaagtgagaccctatctctacaaaaattaaaaaaattagccaggggtggtggtgtgtgtctgtggtcctagctactcaggaggctgagtcggggaagattgctcaagcccgggaggtcgaggctgcagtgagctgtgattgtgccattacactccagtctgggtgacagagcaagagcttatctcaaaaaagaaaaagactccatgatttaatctaatcaacttcaaaaacccaactcattcctccacacgccctgtgccttggccatagcatttacctcaccattctcctatgcattatctatttttagacctctgtctccctttgtttaaaatgttctcccagcctggataacatagcaagaccctgtctcaacaaaaaaaataaaaattagctgggtatggtggcatgtgcttgtagtcctagctacttgggaggctgaggtggaagaattacttgagcccaggatatttgaggttacagtgagctatggttgtgccactgtactccagcctgggcaacagagacccagtctggatgagagagaagagagaggggagagaggagagaaaaaagaaaagaaaagaaaaagaaaaagaaagaaagaacccatcatctatgagtgctgtcctcactgaacaccagaggctgggtattgagtttacatcagcttttaatgagctctcactaggtttcttcacccattcaatgggaaggtctgcttcagagccataattgtgttcaacgggactaggttgcaaggtttaataactcttctcttctttttaaaatttaattactttattatttcacctttttttttaaagccacatgtaggctgaattcatttaatttgacagaataacactccttactgctaatcctgatcaattttagctttgtgtgtctttgggttggatccactcagataagaggacaaaagagggccgggcatggtgactagtgcctgtaatcctagcactttgggaggccaaggtgggcggatcacctgaggtcaggacttcaaaaccagcctggccaacatggtgaaacccctgtctctactaaaaatacaaaaattagcctggcgtggtggtgggcgcctctaatctaagcaatttagtgatttgagctgggctcgggaggctgaggcaggagaatcgcttgaaaacccaggaggcggagcttgcagtgagctgagatcgtgccattgcactcgcaaaaagagcgagactccatctcaaaaaaaaaaaaaaaccattcaaaaagaggacaaaaggttcatttggaaagaggatattaagaaataaggagaaatcatgaagggaattttaaaatgaaaacatatttagtggcattgttttctgttaggtttcaaaaaagtctccattccaagtgagtattggtttaggaatttctttctccttattaaaagtgttttcctatttacagtgaaaataactttagtaaaattttgtgagtactaaacttggattttaaaatcagagatttcgattatatagtctggagcctcaggattttaagtttctgtaggattgggtaaaatgccattgtagattttttggtcatcagattatagaataaatacttaaagtaacttcagattattattttcaaaaccatagcagaaactcttaccttacctatcttattgagagacaatgtgaagccaagactaatggagttagtgtgctacattgatgatgaatgactgggtagtacaccacagagggctgtgtcatggagtgtaaaggtgttattccattcctacaccctaccatccgtctttccccattaaatcaaggtcagggaatgttaccttatgtgattaaatctggtagagtcatcattaaacaggtgagataaatcatatgcagagtaacctacttttggtattgatgagactagggtggttcttaagtattttatggagatcagggtatcttcctaaatccagatgaagagatcaggttaagaactgctcgctttcaggctccacctgaagaaactatgtagtaggcttctctccctctacttattttatcatcttctttgatctaataaaatgttttccttatcaataagtaatgttatctagtttggctctaccaggtgctagagaaggcattcatcattgtattgtacttgcaataactctaatacaggaaaatgttcaaaccacccataataaaagtagctaaaaagcagatttcttaaagactttgtgaccgtttaagctcagctgacctttctaagttgcatgattcttagaaaggtcccagagagatgtctatctggtgctatatagcagttgctaattaaatattttttaattgaatgattgatatgagttgaacacccagtaattatatttaaaaagtgatgacttcagtgttttgacgcctttaaaaggctacagtggtacaaaatgtaggtgctaccatgtgaaatttgaatgtacagtgaagtacatatattcactgcaatatctagaaataaatatgtattcttataggtagaggctagtttatccttgtaattctactgataaatataaatgtatatattggggaaatttgtgggactttttcagtataaggaagaaaaaaatctgaaaattgaactcactgcagaagaaattttttgtattttcgggggaagtaccaactagatgtgctaacactttgtatttctttatgtttagttgcctcttttttttttttttaaacggagtttccctctttcacccaggctggagtgcagtggcacgatctcggctcactgcatcctctgccttacagtttcaagtgattctcctgcctcagcctcccaagtagctgggattacaggcgcctgccaccacgcctggctaatttttgtatttttagtagagacgagggtttcaccatgttggccaggttggatctcttcacatcctactgagcaataaatgagatagcctagagcagtggttttcaatttcaggtagttttgtttcccggggaacatttggcaaagtctgtagacaattttttatcttttttttggagacagagtctgactttgttgcccaggttggagtgcagtggcatgatcacggctcactgcggcttccacctcctgggctcaagcaatcctcccacctcagcctcccaactagctgtaccaccacacccggctaattttttaattttttgtagagacagagtctcactgtgttgcctaggctggtgtcaaactcctggcctcaagcagtcctgcttcggcctcccaaagtattgggatggtaggtgtgagccaccacacccagcctgtagacatttttgatttttgtaactaggggctggaggagggttgctactgtcatgcagtgggtggaggccagagatgctgctgaacatgctgcagtgcacaggatagacccctcaaaacaaagaattatattgggcccaaaaaggtaagagggctgaggttgagaaaccctgggatagatagagggatagtcagtgtcatcttgtgctaattgtgtttaaggttttgttttggtgtaggtttgatttttaattttgggatcccagtgaattttcagtaagaaaattgagaccgtataattttaggcaaacctctgatgggagagagtgtttagaacaggaactagggctcagttagtggctgcaattccattatagcagtatctattggagttactttctgtctttggagttactgagaccagaggaattggattacccctctcaagttacatactgtaagggcaacttataaaagaaaactatccacatttttttgtcagttgggaattaattgagatagaaacactgcatgtaatttagtaagacagctggaaatcccagtttgaaaacaaaatgaaaagcagacaacaagcctaacttttagttttgctttctgtgtttctcttatacctctcagaagtttcataagctccagaaattttgtgtttaaccttttagtttcttcaaattcttggttgagagggtatattggagttattaatctttgttctaaaattcttcgggtgacttctcgctgagtcatctgaccgtctcagtttacctaagtatatcccattgtaaaatgatacttaggtgcacgtatgggaagcttgaatgaggaatggagctgtataatcctaattgaaaggcagtgtaagaatcatgagcaatccttatttgcagagaaatagggccattaccgtattagaagcattttaggttgttgttatagtttcacatacagaagtttaggtgctgaaaaattattcttttttagaaatttcttttttcaattgtttgctgttcagagtttctcagaggtccccagatgcatgtatatcagttagaagtaggacaggtatggtggctaacacctgtaatcccagcactttgggaggcagaggtgggtggataacttgagctcaggagtttgagaccagcctgggtgatatggcgaaaccccatctcttaaaaaaaaattaaaaaaagatagaagtgagttggcgccagtgatttttaaaccaggcatacttttcttgtatgataagtagactgttggtgactcttttcccaaaacagaccagttagattttgttttttgtttttttttgagacctgaagcctcactctgtcacccaggctggagtgcagtggtgtgatcttggctcactgcaacctccgcctcccacgttcaagcaattcttgtgcctcagcctcccgagtaactgagattatgggtgtgcgccaccacacctggctaatttttgtatttttagtagaggcggggtttcaccatgttggccaggctggtctcaaactcctgaccttgcaagtgatgcacctgcctcggccttccaaagtgctgggattacaggtgttagccaccacgcctggccagaccagttagttttgtcttccttgaaaatctgttaagacagattaatctctctccttgataatttgaacaagtgtcacaggaaacttcttagtagacaaggtaatgtttacctccttgccactcactttgatgttgtacagatttgaatagacttttaacccatagtaccatcttccagaagtttcattttgcttacctttcaccatgcttagaatttacattctcaaaagaaaaaacaattatagttacatgctctttcttaccttttgctggattaactgagacctgcaggtatcctacaatgatgctgatcttctagcccgttaattctcagacctctcagattcagtgccctcttcttataagtattttgaaatactctctttagtgaaatgaaatccacaggtaatacagcttttctacatatatgtgtgtgtgtgtatatatatatatatatatatatttttttttttttttttttgtgagacagaatctctgtcaaccaggctgcagtgcagtggcgtgatcttggctcactgtatcctctgcctcctgggtgcttcaagcgatgctcgtgcctcagccttccaagtagctgagattacaagcgtgcatcaccacacctggctaatttttttgtattattatttattctttgtagagacagggtttcaccatgttggccaggctggtctcgaactcctggcctcaagtgcgcccacctcggcctcccaaagtgctggggttataggcgtgagccaccacacccggccctacatatataattaaaaaaattatcttgcagtaagataaaggataaatagaaaatatttctgacagattagcttgacatgacagctacctgagtagactgctataagggtatttgcaacttaaataccaggagaagcaaaccagtacagtgaacaattctttgcaaatgtacaaataaaactcaagtacaacttctttcttcttcttcttttttcttttttttttttttttttttttggtagtgatggggtctcacttagttgcccaggctggttttgagttaggctcaagctgtcctcctccttggcctcccaaagtgctgagattacaaacgtgagccactgcatctgccccaaagtacagttttctcttactttattcagcagttgcttttctggacatttagtgcatgttaaaattatggactgggcacggtggcttacgcctgtaatcccagcactttgggataccaaggcggttggatcacttgagcccaggagttggagaacagcctgggcaacatggtaaaaccctgtctctacaaaaaatttttttaaaaattagccgggcttggtggcacgtgcctgaagtcccagctacctgggaggctgaggtgggaggattacctgagcccaagaggtcaaggctgtagtgaaccgtgatcacaccgctgcactccagcctgggtgacagagtgagaccctgtctcaaaaaataaataaataaataaataaaattatgcagaaggacttggtgcttatacgtagaatgtaattaggttctaggctttggtaattatacagattttaaaaatccagttaactattcataaggaagtttgagaataaagacattttttctttgtgctggacttgcctatgctttcctggcctctgccaattgaatgtcagtaacacttttttttttttctgcaacttttattttaagtcccggggcacatgtgcaggatgtgcaggttttgttatgtaggcaaacctgtgccatggtggttggctgcacagatcaactcatcacctagctattaagcccagcatccattagatattcttcctgaggctccctcaacaggccccagtgtgtgttgttccccaccatgtgtcctcctcatttagcccctacttacaaatgagaacgtgtgatgtgtggttttctgttcctatgttagtttgctgaggataacggcttccagctccatccacatccctgcaaagtaatcactcgtcctttttatggctgaatggtattccatggtgtatatgtaccacattttctttatctagtctctcactgatgggcatttgggtttattccatgtctttgctattgtgaatagtgagaagcacttcttaactgctgtgacaaccaaagcacttccatagatgtcccaactatcccctagatgattgtgttgtcctcattaagaatgacctctagtcatacaggaaaacatttttctgttttatcattcactcttcttttttttttcttgcttattattcactactttagcacagccttttagtctaaaagacaaagatttacttggcctttagacaattcctatatgtctttaaatttcttatttcctcaccactcttattattgatgttttcttttccataagtgttaggacagtgccttggtacatagtagatactcaattagtatttgttgaatgaaggaaacttaactgtaggctttttcttcttgccactttctgctttttgtacctgttgaaaatgatggaggtaccagtgttcataaaaaccttgaaaacaggctgggtgcagtggctcatgcctgtaatcccagcactttgggaggccgaggcaggcagatcactcgaggtcaggagttcaagaccaacctgatcaacatggtgaaaccccgtctgtactaaaaatacaaaattagccaggtatggtggcgcatgcctgtaatcccagctactcgggaggctgacgcagaagaattgcttgaacctggaaggtggagattgcagtgagccaagatcgcactactgcactccagcctgggcaacaagagtgaaagtcttgtctccaaaaaaaaaaaaaaaaaaaaaaattagctgggtctgggtgcagtggcgcacacctataatctcagcactttgggaggctgaagcgggcagatcacctgaggtcgggagtttgagaccagccagcatagtgaaatctgcatctactaaaagtacaaaaattagctgggtgtggtggcacatgcctgtaatcccagctacttgggaggctgagggaggataaccacttgaacccaggaggtggaggttgcagtgagctgaaattgcaccactgcactccagcctgggcaacagagtgagactctgtctcaaaaaaaaaaaaaaaaaatccttgaaaacaaagcacagacctgtagactaatgactaaagggttggctcaaagcagcagtttgatggaccacttgctattagttagtggccagtagagtggagcctcttgtggaatacggctttatttctgcatatgagagcttataagaagaggagtcatcccataattacatgcctttcagataaacagctgatgggctttgtaggcagagttactttaatgaagtcattaatagctgaatttgttgaatgaaagcttcttctagagaatcttttctaatttaggtactactgtgaggtatttttgctctcaaacttattaaactgttggttccctgattttgaatttatggtgccagttattagatcctgatctcttaatatggtcactgctaaatgtttacaggtattagcatacctagttaagacaagttaggttggggaacagaaatttttatatcttagcctcgttggtttgaaaaaaaattagttatttggattgctgatatagtgcaaaaactatttataatggtacatttactttctgtttaataacatgtaaaaggcaaacagcaaattaattttcactgctagtcttgatttgtatgttttagattaaagggttgttgaaactataataaaaaaccaaataatggttgggcaaaggaggacatgattagacatttctcaaaagaaggcatataaatggccaacaggtatatgaaacagtgcttaacatcactaatcatcagagaaatgcaaaccaaaaccagaatgagataccattataccccagttagaatggccattattaaaaagacaaaaataacagatgctgaccagaatgtggaagaaagggaactcttaaacactgttgatgagaatgtaaattagtatggtcactatggaaaacagaatggatatatttcaaaaaaaactgaaaactaccatacaatccagcaatcccgctactgggtagttatccagaggaaaagaaatcagtatatcaaagggatacttgcacttccatgttcattgtagtactattcacagcagcaaagacggaatcagagtatccatcagtggatgaatggataaagaaaatgtggtatatatatatatgcaagagaatagtgtttggccataagaaagaatgaagtcgtgccatttgtagcaacatggatggaactggaggttattatgttaagtgagataagccaggcacagaaagacaaatattgcatattcccactcatatgtgggagctaaaaaagttgatttcatgcaggtagagaatggaatgatatctgaggctgggaagggtgtgtgaaggcagagggggtgaggtatgtggataaagagaggttgattaatgggtataaacataaaattagatagaaggaataagttctgatgtttgatagcagagtagagtgactaaagttaacaacaatgtatatttcaaaatagctagatgagaggatttcagatattcccagcacatagaaatgataaatatttaaggtgatagatgccctaaatgccctgacttgatatgcatgtaccaaaatatcacatgtaccccatgaatatttacagatatctgtagcaataaaaaagtggttgaaagtaatattaataagtgagaatcataaaaatgtttaatttgctgaatttttcaaccttagtttactaatctttaaaattgttggtttattattctctatcaagtgcaggtgctgattgaatggatagggagaagttgttttaatattatattagcatcctattttaatatgcaatcagtattagatggacagattcagagttcctaaggtttttaataagattagcagtataatataggtctatctcgtcctgtaacactagtactgtaaaaggtttccagaagtatatctatttctattcctgagtgtgattgattctggatattttctttgaggacacacacatatactctatttgtgaagtacagcacttcgaatttagtttgtatttgataataacattaaaataacaggcactagattatgcaacagtaacagcagtccatttttatttattcagtaactgtattggtaccttctatattccaggagctgttctaggtacttgggctgttgtcttagtccattttgtgttgcttataaaggaataactgaagctgggtaacttaaaagaggtttacggctgggcgcagtggcgcgtacctgtaatcccagctgctcaggaggctgaggcaggagaattcttgaacccaggaggtggaggttgcagtgagccgagatcctgccactgcactccagcctgggcgacagaaaaagactctgtctcaacaaaaaataaacaaaagaagtttacttagctcattactctgcagacagtacaagaagcttcgcaccagcatctgcttctggtgggacctcaggaagcttccagtcatagtggaaggccaaggggaagcaggtgttccgcaaggcaagagagaaaggggaggggtaccacactcttttaaacaaccacatcactcattcctgtaaggactgcaccaagacattcatgagggatctgcgtccatgacctaaatacctcccactaggccctacctccaacattggggatcaaatttcaacatgagatttagaggggacacatatccaaactatatcagctatattcaggaagaagtacggagattaataaaatgttgagaaaaatgggtagtaaaatcaggatttaaatattttcttctccttttggctttctttaaatttaatatttatttatttatttatctattttatttttttgagatggagtcttcctctgttgcccaggctggagtgcagtggcacgatctcagctcactgaaacctctgcctcccgggttcaagcgattctcctgcttcagcttcctgagcagctgggattacaggtgtgggccacaatgcccagctaatttttgtatttttagtagagacggggtttcaccctgttggccaggctggtcttgaacacctgacctcaagtgatccacccgcctcagcttcccaaagtgctgggattatagtcgtgagccactgtgcctggacttaaatttaatatctcatttaaacattaaattaatgtagctatctctggattagagcaaatgcctttttgcccatttcaggtctgagatattgttgttgtaagaactaacaactagccctcattttgcaactgttgtcagccctttttatagctgattttatttattttaattaattatatataaattgtattctagtactgtgggaaaaaatgttttattttagctgttaaattattgaacctttcagggtcttcattttccttgtctgtaaaatgagatagttgtgtttattcctgctagctacggtttagtgatttgagctctggggtatttttggattttgtgtaagggaattttcttctgtagtttttccacatagatcatgtggtagccactgacatactaggatttaaattttacccctgaaataatctcctttatgagttacaaactattagtgcatattttatcttataatgatgaacagtcttgaaaatgttaggatggaggacataatgcaaagcaatgtcaaaattttccttttataaatcaaacaaagcaataatgctggtaatgttgactgaataaattaaaacttcattttttttttttttgaagacttgggattcagtaacaggtaaacttggcctggataattttttttttagaactattttataaatattctttgtttgctttgaggttgcatttacattgcttttgtttttaaagttgtattcagttaactgattgttttcttaatccaatggtcagtggctactgttaacaaccagtttgtatgtgatctttcctgacttgaatgttcctgctgtgagttgaattagatcatacttgtgaaattctcctatgtcattgatggcaagtcaatgctagaattccaagtattacttttatttcgatgaagagttctcagtcagaagctctgattgctctgtgggtacatggtaaaatagtactttttaaaatgaaatggtgatggtagatggtttttttttaaatatttatacttggcaaaataaaaaagctggcaatccttgcaggtttccaattttttaatttgaaaattgaactgctttatgggaaccaaaagtatggaaatcagtagtctagatcagtgtttctcaaactgtgtgccaggagatttaataggagttcagaattatggtaaaatattgcataccaaattgttgccctatctccatccctccacttccccttttatgacatggaatggcatattaatggttctgaaaaatcattcattaaagcagcatgtttgatatttagttcaggcttttctaaatctagtttttctccccaccttaaccactggttaatatcctgtgaaacgtggtttgagaaatattccatatccaaatcactcagaataatttattagaacctacagtttgttgagaatttagtatattcccagtactatctcatttagatgaagtgagctacccagtgtcacacaactggttggttattctgtgtttccagtccgattgtgtgtgtgtgtgtgtgtgtgtgtgtgtgcatgcatgcatgcatttaaggtggacaacatgatgttttgaagtgcacatacatagttgaaatgattaccagtccagctttgttttgcttcacattcattactctaaccacttaggctgttctgaagcattgcttagttctcatttcgaggctaagtacctaagactaggatattcagaagttcattttatatgccttttgacttccctaactactagaatgtggttaagggaagtatgattttatcagagcatatactttgtaggtgattttagtgacttttaatcccaggttatttttctttctacacaatgcttggaatgtagagcttagaatttttgctgagtgaatgaatgttgtcactttgtcaaagaagattctgtcagcctaagctaaaagcaagaaagtacattttacttctaaactattgtggtacacatcagagctaaacatctatactttttggctcatttatcattttatatttatgccactgggttgttccctttcttgctgcctttagtgtgagcaagccaaaaacactataaatcttttctgctatattatgttgtctgaggttaattaacattttctctggtaattcttgtagtcctgtgtgtttcttccttagaaaatttggcttcttgaccatctgatcaagcttgtatcaagtaacactttgtcttgtgacctgattttctgccttggtacacaatgagctaaagaagcttggttgattatgcactcctgtttggaatctgtaatgtcagtgttcaatcatggcctgaattaaggaacaaaatgataaaggtggctgggtgcggtggctcacgcctctaatcccagcactttgggaggctgaggcaggtggatcacttgaggtcaggagttcaacaccagcctggccaatgtggtgaaacccatctctactaaaaatacaaaaattagctgggcataatggcgggcacctgtattcccacctactgggaagctgaggtgggagaattgcttcagcctgggaggcagagtttgcagtgagccaagatcacgccactgcattccagcctgggcaacagagtgagactcagtctcaaaataaataaataaataaaggttgtgaatgtgaatgttactattcttagggggatgaaaccataaatcaaggtagttttattggcctggaactgaatcacagcccttcaaacagtatttaaattgtataggtatccttgtgtaacactgaaactgtggcctattgttttcctttttagtaaactgattttctttattaatagccaagtgaacaattgcttacaactccttgagctcagagaactaatttcaaaatgtttagactggaaactttctctttcttgtaatgaatgagaggtatgtcttccttaatttcttgaaggagagttgagagaaagaagtcagtgaggacagtatttgtactctagaaagagattttcacagagaccttgaggataatggtggaactgggaacagaactcagaagttctgttgtctttgttttggggttcacttgatgcttttgaaaagggaggaggatgtataacctggcttgaaaagggaaccagtctctttgacctagtgacgagacttagcatcagagtaaaagtatagtgggtactggcctaggagctgtgatgtgtggcaaacattttgtgttcttaatccttctaattagaaatttctgactgtcttgccatgtgatactcaaagagagtataaacaatagaatgtgactaacttaaaattgtggctgtcagactagacagaaaatgggcttcttttttttgacactttaatcaccattggaacttctgttttagataaaataaacactttaagttgataacgaagaggtagaaaaacatagctgtgaaattaggaaaaaagtagtaagtctttatattacatttgatgtactgaataagtattggatacaaacttgtataggtttcaagagtatttaaatttcacattatgtgacctgatataaataggtctgaatttgtagctccttgtcctctaaggtgtcacgtattgtgataactaatcctttgaaatacgggaggcaaaagaaataatgcattaaaaccacccttttcctttccttcctatatttctagtgctttgtgtcctcttgggctgttcttttaagtgggtaagcatcagggctaagctatgcttagggagttgttctcgattcagaacctgccactgagtatcttcactagagttgtttacagtaatcttttagagcctagggggaaagcagcttagtttggtggaaacagttgggttcctgtttccagtgattctaggtaagtaacttaggttttttgttatgcttttcttttacagatgggatgatagaaatgactcggctgggcgtggtggctcacgcctgtaatcccagcactttgggaggctaacatgagaggattgcttgagctcaggagttcgagactagcttgggcaacatggcaaaactccgtctctacaaaaaatataaaaattagctgggcgtaatggtatacacctgtagtcccagctactcgggaggctgaggtgggagaatctctggagcctgggaggcagaggttgcagtgagccgagatggtgccactgcactccagcctgggcaacagagcgagaccctgtctcagtttaaaaaaaaagagagaaatgagttactgaattagaaatgagttactgaaaaagagagaaatgagttactgaggggtaagatttcgtgactgcatacattggaaatattttggggagaggtttgttgtgaagacttgacgtattaataggtaagcgtaggatagatttccatagtgcctgacatataattggcatttgattattattcttgatttagtgttcctccctttaaaagcatagttattttctttctttctttctttttttttgacatggagtctcactctttcactcactgcaacctctgcctcctgggttcaagcaattctcctgcctcagcctgcacagtagctgggattacaggcatgtgccaccacgcctggctaatttttgtatttttagtagagacggggttttgccatgttgggccaggctcgaactcctggcctcaagtgatcctccctccgtggccttccaaagtgctgagattataggctgagccactgtgcctggcctaaaagcatagttattttcaatcagcatggtataatgaaaagaagatggaattttggattcaagaaagaccaaggtttaaagctccttttctttttctttttttttgagacggagtcttgctgtgcgctctgcgctgtgcccaggctggagtgcggtgtcgtaatcttggctcactgcaagccctgcctcttgggttcatgccattctcctgcctcagcctcttgagtagctgggactacaggctcccaacaccacgcccagctaatttttatgtatttttagtagagatggggtttcaccgtgttagccaggatggtctcgatctcctgactttgtgatctgcccgccttggccctcccaaagtgctgggattacaggcatgagccactgcgcccgtcctaaagctccttttcatcccttgggcaatgttctgattttctattattgcctaacaagtctatccaaaatgtagtggcttaatacaataacttattattatctctcatgtttctgtggattgacagggttcagctggacacttctccccttaaggtctttcatgtggttgtggtcagatagtacctggagatggggccatctgaagactctgccctaggctggatccaagatggtgttttccttttacttgtctgatgtctcagtgctctttgagatggcctctttatccagcagagtagcctaaacttatgtggctgctcagggttccaagagttaggaagtagaagttgccaggcagttaagggctttggaactggcatagtattgtatctattaaagaagtcacagggcctcccagattcaaggggcttgagaaataaactgcatgtctttaaagggagtgggaaggtcacattgcagaagaatatatgggctgagaggtcttattggggctgtctctggaaggccatctgggcacaattttttttcattttcttgtttgtaaaatagcaataacaatatttacctcacagagtggttaagtggaatagcacagtgtcaagcacatcatgtgtttagtaaatataagtagacttccccccttaattctctaatgtaacaaattacttctgatctacttttattttaaatggccgcaagtttgctcagtatatggtttggttaactgtttcttcacccgactatgtttctcagactgttgtaacttaaaacaaactttatcatggaaaatttcaaacacatcaaagtaaagagaataccacattaacagaataagggacaaaaactgcatcatcatctcaattcatgcagaaaaagcatttgatagatccagcatactttcatgataaaaacactcaactaggaatagaaggaaactcagcatatcaaagtgtatttatgaaaagcccacagtggctgggcctgttggctcatgcctgtaattccagcactctgggaggccaaggtgggaggatcacttgagtccaggagtttgagaccagcctgggcaacaaagtgagacctaatctctgcaaaaaataaacacaattagccaggcatggtgatgtacgcctatagtcctagctacttgggacgctttggtgggaggattggttgagtctgcagtgagcaaagatcgtaccatatcacttcagaatgggcaacagagcaagacccttcccaccctcacccaccccctccccccaacaaaaaaaagcccacagtgaacatctcattcagtggtgaaagaccgaaagctttccccctaacatcaggaacatggcaaagatgcccattcttgccactgctatttcaacatagtattaagagtcctggccagagccaatttaggcaagaaaaagaaaagcacccaaattagaaaggaagaagtaaaattatctctgttcacagatgatatgatcttatttgttgaaaacccggaagctggctgcagtggctcatgcctgtaatcccagcactttgggaggccgaggcaggcggatcacgaggtcaagagatcgagaccatcctggccaacatggtgaaaccccgtctttactaaaaatacaaaaattagctgggcatgatggcaggcatttgtagtcccagctactcgggaggctgaggcaggagatttgcttgaacccaggaggcagaggttgcagtgagccgagattgcgccactgcaccccagcctggtgacagagcgacactccatctaaaaaaaaaaagaaagaaaaccctaaacattccacaaaaaaccctgttataactaataaatgaattcagcaaagttgcaggatacaaaatcaacacacaaaaattagttatgtttccatacacagtgaacaacttgaaaaattaagaaaacaattccattaacagtagcatcagaaagaatgaaagttaggaatgaccctaaccaaagaagtgaaaaatttgaatattaaaaaccgtaaaatactgctgaaaagaattaaagagcatacaaataaatagaaagacatcctgtgttcatggattggaagacttaatattgttaagatatgaattcttcccaaagcgatctacagattcaacagaatacctatcaaaatcccaacagcattttttttgcaaatagaagtttcatcccaaaattaatttggaatctcacgttacccctaatagccagaacagttttcaaaaagaaaaacaaagctggaggactcaaactttctgatttcaaaatatattactaagctatggtaataaaactagtgtggtactggcataacaacagacatatagacaatggaatagagactccagaaataaacccttgcatatgtggtcagatgatcttggacagaggtgctaggacccctctgtggagcaaggacagtctcttcagcaaacagtgttgggaaaactggactttcacatacaaaacaaaaatttggactcatattttacactatatataaaaataaactcaaagtggattaaagacctaaatataagacctaaaactgtaaaactcctaaaagaaaacttagaggaaaggcttataacttaaaacttagaggaaaggctttataactttggatttggcagtgatttctggcatatgacaccataagcacaggcaacaaaaggaaaaataggcaaatgggactgcatcaaacttaaaaactttggtgcatcaatgaacacaatcaacttgaaaaggcaacctgtggaatgggagaaaatgtttgtaaattgtgtatctgttaaagtattaatatccagaatgtagaaagaacaacaactcaacaacaaaaaatcaaataaacagattaaaaaataggcaaatgacttgaatagtcatttctccaaagatgataaaccaatggtcaagacacatttgaaaagatgttcaacatcactaatcatcagagagatccaaatcaaaaccacaatgagatatcacctcacatccattaggatggctactattaaaaaacaaacagggaattacgagtgttagtgaagattatgagaaattggaactattcttgtgcactgttgggactgtaaaatggtgcaactgtgatggaaaacagcatggcagttcctcaaaaaattaaaaatagaattactatgtaatccatcaaactcatttctggatatgtatccagaagtattcaatgcaggacctcagagagatatttgcacacctatgctcatagcacattcaggatagctaagaggtgaaaacaacgcagatgtccttgatgaataaataaaatatggtatatacacacaatggaatattatttagctttaaaaaggaaataaatcctgtcatatgcgacagtgtgggtgaaccttgaggatattgtgttaagtgaaataagccagtcaaagacgaatactgtatgctttcacttatattaggtattattactgaaacaccagggatgtgttctaggttatgctgcttgctgcacagaaagccagttgctgagacgatgagttttgccagagaaggaggttttaattgggtgctgtagctgaggagagggtaactcagtctcaaatccatctccctggctgactacaattaagggcttatatagcagggaagaactgtaactacatgcaggaaaataggaattagggagagataaggaagagaagttggtcaacaggaagcaggaggtcacttaggcaatcatgatgggttgaggggtttgaggtttcattgtttagatgcagtgatctggtacgtttcagttccttgatatcatctgggagacctgatggttggtttcctgagaaaggaactcagataagacaaatgtaactttttcaagttttaagactgggagggtcaatttctatctttattcaaaagaaactataatggtcagttctatgggacagttaggttgttggtgtcagtatcaaaaattataaattcatagaaacagaggtagaatggtggttaccagggaatgaaggggagaaatgggttgttgttgtttaatgggtatagagtttcagttttgcaagatgagaaggttctggagatgtttcacagcagtgtgaatatacttaacacttctgaactgtacacttaaaaatggttaatatgggctgagtgtggtggctcatgcctgtaatcctagtattttgggaggctgaggcaggcagattgcttgagcttaggagttcaagaccagcctgggcaacgtggtgaagcctcatgtctacaaaaaatacaaaaattagccaggtgcagtggcatgcacctgtagtctcaggaggcggaagttacaatgagttgagatcatgccactgcgctccagcttgggtgacagagggagaccctgtctcagaaaaaaaaaaaaagttaagatgggaaatttttatgtattttctaccacaaaatgtgtagacagaataatacaacaaatctacatgtatacagcttcaacaattatcaacttataaacaatcttattttatttctgtcctcatctaacaccttgtctcttgattagttggaagcaattgatagagtttttgagctcttagagtgaaggggtggacccttaacatagctggaaatcatgggaaagctagtgacttgtgtgaatccagaagaaaagtggtactagtaagtggagtgatatgaagtctttataaggaaaatctagaaacaggaaatataataactttagagtatcattttggggtttccaagtatctaagaggcagattaaagaaatggaagtgagatagttttttgagaccagactttgttctgaaatcagacttaagatacaaatgtgcattttttactttgataattagagaatgaagatcttgtgtattctaaaaagttctctgtttttcctgtaatgttgattgcaggaggatagtccagggctgtgtggtttgttttataagtagctacttttatcaagaataattagcagagcatttgggaagagttttggcttttcttccctgaaatcaaaatataactatttagaaagcttttattgtcgcttataaatggaaggagtacttgtcacttccaaatgacaggaagaaccatagagcacttctacagtttgatttatatctcttaagtgtcatgttcctgtgcgggagctgtagtggttgacagcctggttcctagaactgagaggtgaagcccgctgagcttctggattgggtggggacttggagaacttttgtgtctagctaaagcattgtaaatgcaccaatcagtgccctgtgtctagctaaaggattgtaaacacactaatcagcactctgtaaaaatgtaccaatcagcactctgtaaaatggaccaatcagcgctctgtaaaatggaccaatcaagcaggacgtgggcggggacaaataagggaataaaagctggccgtaccagccagcagcagcaagcagcttgggtcccttccgcgctgtggaagctttgttcttggctcttctcagtaaaacttgctgctgctcactctttgggtctgcactacttttatgagctgtaacactcacctggagggtctgtggcttcattcctgaagtcagtgagaccgtgaacccaccgggaggatcaaacaattccggacgtgccaactttaagagctgtaacactccctgcgaaggtctgcggcttcactcctgaagtcagcgagaccacgaaccaaccagaatgaagaaaccccagacacatctgaacatctgaaggaacaaactccggacacactatctttttttttttttttttttttgaaatggagtctcgctctgtcacccaggctggagtgcggtggcgcgatctaggctcacggcaagctccgcctcccgggttcacaccattctcctgcttcagccttcccagtagctgggactacaggcgcccgccaccacgcacggctaattttttgtatttttagtagagacagggtttcaccgtgttagccaggatagtctcaatctcctgactttgtgatccaccctcctcggcctcccaaagtgctagaattacaggcgtgagctactgcgcctggtcaggacacaccatctttaagaagtgtaacactcaccgggagggtccgcgcttcatttttgaagtcagtgagaccaagaacccacgggaaggaataaattccggacacagaaccgtgactgggaccatgtgaagtggggacttcacatgatcccaataggagatcgcaccactgcactccagcctgtgtgtcagagtgagactctgtctcaaaaaaaaaaaaaaaaaaaaaaaaaaagaaagagattagatgccccttgccatgcagaaagttagggaaatagtgttctagttacaggaagcttttaggcagtgctgagcttgatgagttcaaagaatcaaaagaagtccagtgtgtggctggaacacactgaaggaggggaggggtgacaatgagattgtcaagttgagcacagaccagccttgtaaatcatgttaaagaatttaactttaagtgtttttgtaaataattgaaatattttaagctgggtaatgacatggtctgttttatgctttaaaaaagatggttcttttttgatttcagattggaaaggactaaaagagaagcaggacacgacttaagagggaagatattcgggctgggcgtggtggctcacgcctgtaattccagcactttgggaggctgaggcaggcggatcactcgaggtcaggagttcgagaccagcctggccatcgtggcgaaacaccgtctctactagaaatacaaaaattagccaggtgtggtggcacatgcctgtaatcccagccactctggaggctgaggtgggagaattgcttgaacccaggaggcagaggttgcagtgagccaagattgtgccattgcactccagcctgagtgacagagcgagacttcgtctcaaaaaaaaaaaaaaaaaaaagaaagagggtaagatatttagtgctcagaaccagtgctggcttgggttaaggtagcagcagcggcacaaggagtatgtagatgtgggaaatgtgtttgtgtttggagtaccaggacttagtggtgggaggtgaaagagaggcgttatgaatgacccctgggtttctagtatgagcaaactgatatgccacctctcgagggtgtgtgtgtgtgtgtgagaaaaagcatgtgagagagcatacatataagagtaattgagtctggaattcagaagactggcctgggatagagatacacatttggggggagttggcatgtagagagatttaaagcaataggaatgagtgagagagggagagagaagaaagagggcctagcactgtgatttcatttttctattgactctgttttttgaatttaattttagacattagaatagataaggttagctttccaaaatcagtctcatttgtattcggcattcagataaactcatatatttgcatatattattgttattattttttgatacagggtctcgctgtgttacccagactgcagtgcagttgcaccatcacagcttactgcagcctcaacttcctgggctcaagtgatcctttggcctcagcctccaagtagctgggactacaggcatgcgccaccatacctggctaatttttaaatttttgtagagacaaggtctcactatgttgcccaggctgatctcaaactcctgagctctagcaatcttcctgcctcagcctcccaaagtattaagattataggcgtgagccaccacgcctgaccagataaattttcagaatgggaaagggatggagttgcagctttctgggagggtaggggatgaaggagtagaggaggactcagggatttatgtggtctccagattacttcatttctggagtagtttacagtatgcccattatgaatgtgtctcatcctttatgtgtgtagtggagaaaaaaggttgagtttctgatcctcaaggtaaagtcgatattaatagttaactaaagtttcctacattctggcccctatctgcctgtctgcatatccacattcataccattcccttccaacctccatgcatgctgttttctatcatcatggtcctagacctagaatttcctttttcattggacaaatattttaggtctctgtttcagtcagagctttccctagttcccccaggcaaactctgtatttgtttctgtttctagtgttcattggttatagcaattattgtattaaatttgctgtttcttggtttgactgtctcctcaagaaactaatctttttgacatgagggattttttttttcttttaaaaaagcacttgagggccaggcatggtgggttttgcctgtaatcccagcactttgggaggatgacttgagcacaggagttcgaggctgccttgagccgtgattgtgccactgcactccagtctaggtgacagaatgagaccccatctctttagaaaaaaagtgtttcagtgtttgaattaccatcctgtctttctttgaagagccaaatacagcttacatcatcttcaggtaaaacaaaatttagggttcagaaactatatggcataagaaaatagttgaactgggcacagtgtttcatgcctgtaattccagcactttgggaggccaaggtgggcagattgcttgagctcaggagttctttcagaccagccagggcaacgtggcaagaccttatctctaccaaaaatacaaatagctggtcatggtatgtgcctgtggtcccagctgaggccggcaggattgcctgagccctggaggtcaaggctacagtgagccaaaactgtgccactgcactccagcctgggcaacagagtgagatcctgtctcaaaaaaataaataaataaaataaaataaaaaataaaaaagaaacaaaatggttgaaaatgtctttcccatgcctttggagtctaggatgaggtttaaaaaaaaatgtgtttctcaggtctattttaataggtagttaaaatatactttaaaaaattattataaggcagtctctaaagtgtattcttatccccaaagcttgatattacttaaaagaaagatgtattactgaaggaaatagaaattgaattaatggaattgttttggttatttgaattgccatttctgtagggtatttgagaattgttaggtcttgtttggaaccattgataaacagaagatagaatagaaatattgtactgcctcattgttcctagtctacaaattgatttatgctgttattcagtttatgtctctctttctctttttttttttttttgagatggagtttcgctcttgttgcccaggctggagtgcaatggcatgatcttggctcactccaaccttgacctcctgggttcaagcgattctcctgccttagcctctcgagtagctgggattacaggcatgtgccaccatggctaatttttttttttttttttaagtagagatggggtttctccatgttggtcaggctgatctcgaattcccgacctcaggtgatctgcctgcctggcctccgaaagtgctgggattacaggcatgagccaccacacctggcccagtttatgtcttttgtatgtacacagtaaaaagtagtagtctctttctttacatagtaaaaagtagcagtttcttactttttttttttgagacagagtctcgatctgtcgcccaggctgaagtgcaatggcactatctgggctcactgcgacctctgcctcctgggttcaagcagttctcctgcctcagcctcccaagtaactgggactacaggcacacgccaccacaccccagctaattttacatttttagtagagatggagtttcaccatgttggcaagggtggtcttgaactcctgacctcaagtgatctgcccaccttggcctcccaaagtgttaggattgcaggcgtgagccaccgcgcccagactaaaaagtagcagtttctatacccatcattattataatgttttactgcgttgatatgtatatagtggagcttttttgttagatttgaagaaaaaattggacgatgaattcattctaattaaaaaaataggccaggcacggtggctcacacctgtaatcccaccactttaggaggccaaggcaggcagatcacctgaggtcaggagttcgagaccagcctgaccaacatggtaaaaccccgtctctactaaaaatacaaaattagctgggcatggtggcaggtgcctataatcccagctacttgggaggctgaggcaggagaatggcttgagcctgggaagcagagattgcagtgagccaagaccgtgccattgcactccagcttgggcagcaagagcgaaactctgtcttaaaaaaaaaaggccgggcgcagtggctcatgcctataatcccagtactttgggaggctgaggcagggggatcacctgaggtcgggagttcaagaccagcctgaccaacatggagaaaccccgtctctaataaaaatacaaaattagccaggcgtggtgttgcatgcctgtaatcccagctactcgggagactgaggcaggagaatctcttgaacctgggaggcagaggttgtggtgagccaagatcgcaccattgcactccagcctgggcaacaagagtgaaactccgtctctaaataaacaaataaataacctaaattttaaaataaaaaaatctttgacactctacctttcagctgtcagtggaaaccacttaggtagctatgaagcaattctgcaaatattttatggaattctatatttgccagagtataatagaaaaaactaggccgggactgggcgtggtggctcgtgcctgtaatcccagcactttcggaggccgaggcgggtggatcgcctgaggtcaggagtttgagaccagcctgaccaacatggtgaaaccctgtctctactaaaaatacaaaaattagccaggggcttgtaatcccacctacctgggaggctgaggcaggagaatcacttaaacccaggaggtggaggttgcagtgagctgagatcacaccattgcactctagctcctgggcaagagagcgagactccatctcaaaaaaaaaaaaaaaaaaaaaaaaagaagtccgggtgtggtggctcacacctgtaatcccagcactttgggaggctgaggcaggtagttcagctgaggtcgggagttcgagactagcctgaccaacatggaaaaacctcgtctctcctaaaaatacaaaattagccaggcgtgttgtcgcatgcctgtaatcctagctacttgggaggctgaggcaggagaatcatttgaacccaggaggtggaggttgccgtgagccgagatcatgccattgcactccagcctgggcaacaaaaagaaaaacaaaaaaaaaagaaaaaaaactaggctgggctcagtggcttatgcctgtaattccagcactttgggaggctgaggcaggaagatcacttcagttcaggagtttgagatcagcttgggcaacatagcaagacctcatcctctacaaaaaataaaaaaaattaggtatgttggcatgtgcctgtggtcctagctactctgaaggctaaggcaggaggatctcttgagcctgggagatggaggctgcagtgagccatgatcataccactgcagtccagcctgggtgacagagtgagaccctgtctcacaaaagaaaaaaaaaaacaaaaactacttgagtcagcgagtacatagaacatttcagagcctcagcttgtatactgcatgttattctgaaactacagataccacgtagctttctaatgaaaaagttttatttgtttcttcctttcttttataggaatatatatgtcccagatgtgaatcaggctttattgaagaagtgacagatgattccaggtattgtacaagctcatgaataaatcagacattctattatcaaaactattttctctcagcatggactgagtaagttgaatttgttttacaacttacactctacagagagagcgagagtgagagagagagagtgagtgcatgagcttgcacaagagagggcagaagaatgggagaggaaaaagaaagaaaaatgggaaaatttggaaagtgatatcatagcagatgtggtgatacgcactgctcctgattgtatgtggcattccatgtacatctgtacgcatgtcagagtaaatctggtaagttttcatttattatctgagacttggggcttctcttagattattagttggtttttagtgaccactctgctgtctgaaggtaaactgctgttatacctctttggcgggttagggagtgacttctgacaaagatacctaatcaggtaaacaggctgttctagccaggaaaaccgattgttactctgctttgaggaggccttgaatctcttgttcttattaaggttatttggccagtgtggtggctcacgcctgtaatcccaacactttgggaggctgaggtgggtggatcacctgaggtcaggagctcaagaccagcgtggtcaacatggtgaaaccccgtctccattaaaaacacaaaaattagctgggtatagtggcgggcgcctgtaattccagttacttgggaggctgaggcaggagaatcacttgaaaccgggaggtggaggttgcagtgagccaagactccagcctgggcaacaagagtgaaactgtgtctcaaaaaaaagaaaaaagaaaagattattgctgtcaaacttaggccatctttccagggtgatattaatatatgggtttgtaatgcttggaatttgttcttattggccttcataaaggtatacagctgataaaaaggggaaatatttctgaaagtgactattacatattccttttttgtttatgtgaacaaaactataaaatcttttttcttttttcttttttttttgagacagagtcttgctctgttgccagattggagtgcagtggttcgatctcggctcactgcaacctctgcctcccaggttcaaatgattcttgggcctcagcttgcccagtagctgggactacaggtgtctgacactatgccctgctaatttttgtgtatttttagtagagatggggttttgccgtgttggccaggctggtcttgaactcctgacctcaagtgatccgcctgccttggcctcccaaagtgctgggattacaggcatgagccaccgtgcccaacctaaaatctttttcttttttttttttttttttgtgacggagtctcactcttttgcccaggctggagtgcaagggcacgatcttggctcactgcaatctctgcctcccaggttcaagtgattctcctgcctcagcctcccaagtagctgagattacaggcatgcaccaccacgcttggctaatttttgtattcttagtagagatggggtttcaccgtgtttgccaggctggtcttgaagtcctgacctcgtgatccgcccatcttggcctcccaaagtgttgggattacaagcgtgagccactgcacctggcctaacttaaaattttaataaattttagaatagcattgataggatggcctcttttggctaaacaaaatggcacatttgttcttttggggctatttggttaaacattcgtctgaaaattgaagaagtaccgactggtcaaaaagaatctgtaatctgaagcctcttaatcttggagtgactttggagattttaatggcagtaggtaattcctttactgttactgttggcagaatctaaagttgaaggtcccttccacaaccaggaaaaactacacattttacagtatgtactattagttttactttactaatgattggtgattatatgtgtaaataagctggagcttctggggcaatatgtggcatgggatctattttgatacagttaaatgtcatcttggttttaaatagtacaataccaacactaaacgtgtaagattagcatgactgcaaaattagcaattttgtgtggatggcatgctaacttgggatagctttttgtttgtgccattataattgcatcaaataacttatttcaggcacttatgctctgcatgtgctaattaaaagatatattggttgtgggagaacaattaatgggcttatcttttgccaacttttcaagtagtaaccctggtttctttaggcagatagtacttttatgcaaatacagttataaatgagaatgattaactgtaggatgaatctttgtctagcagggaactgtggattctgtggtttttgttcttaattcttttatgtgtctttgtagatcaaaggttgtcttatataggtgctattggtagcaatttactcaaatacaaagactctgtggtttgaaagagattagtgttttaaatgaaagaagaaatctttttcttagaatccttgtcttagaggcagtatgatatttccttctataaagttcataaacatttgctgatttaaatacttagcaattgcagtggtaagtagtggagggtaaaaaccagtaagaggagggccttgcatgtaaatattagataatgggctccatctgctcttaaacttccatgtagaggagcaccttgtaagttttcttaagctttgtaacatttctcagaacaatgtggtggtttttattatcccttctctatgattagctctattattctttaaaggaattttaaggaaagggaacggtgaggtagcttcagggagagcagaaccccagaaaataagagttgcggtttcaattaccaaggatgtttgaatccctgaaactgtgtagtaaaggcaggaaggaagagtcttggaagcctgtctgggcttgagcaatcaaatggatacatagccactcaatgtagttttttatggtatgtggtagttcaattagctgtttatttagcatagatgtacaagtacttttgggcttgttatacatttggagtgatttttacaaaagcgtttttctgaaattaatgcaggtattaaatggtttcttatcagggaataaggcttgagaatggttgcataaagagtggcattagctttgctttttcacttttggtttcagactaactagggtgtgtttgtttcctcagtgagctcagcacaatgcctggattggtattgtaatcctacaaatgaaaactatttgtagtagtttgtgaacttaccattggggtgagtgtttgtatgtttgtgtgcttaagtgtgtctcttgaagtaaaagtggtatccagcagttcctgtgattctttccatcccctcttcccggatgtgttaacttgttttctttgttctttgcaaatttcatggggacaatgggatttaatatttctctccactcttcagggtctttgggaatagatagttattttatcattttcacatgtgattaattcaacaacttttgagtgtcaatataggatattgacattgcaggattttaaaaggtgatagtactgtgtaatgtctgacacttaaacactctacatgtatttgaggcattaataaattgcagtctttgccttctgaatttatattaatgaaggagggaaatgggttgaaatggatgtggcaaatcctagatatttataatacaaggtaggttttagaatcaaagtgagagtgcagaagggtgtggaagagtcttatttggttggtgagttcagaagggcttgatggaggaggtagcatttgagatgggtcctgaaaggtgggtagggggagaaatatttattgaatccttttataatgttttaaatacagtaccaggccccttacattactacatttaatcattcctaagaaatattaactattgtagcctcaaatgttgtgttcatctggtggttgaatggttttttagtgaaacattttgttttgttagcgttcttgaggataaatatttgtcttttgataggtcaaatccgaattgcattgctgcctgtgggtcctccttccttctctatggtggcttctccaatttttcactggatttagccttgaaaaccacttgattttgtggtttatgatacttttcatagattaattcacatgccagttattcataatttcctttaataggtgttgtgttgggatgagttatttttccttattgggctttgttctcattatgccattctatatttagcttctgggaggggagcttgttcctgggaatagaatcaccactcattccttttctctttagttttttaggtggtggcggcagtcggatagacaataccacaacaacacattttgcagaggtaagttttcctttagctgtaggaattctttaagaagtggttaggtgttaaaatcatggcagatactaactttccagtgtggcacaacatcagagtttaactgaatgtataagaaaaaatgtgggccgtagtaacccttgggaagatttgtgttttcagtagctggggcttgggcgtgttacctttgataaacccttgattaggagaaagtaatagcctcaaactgtattcttttaaactggtagtgtttttaattcttgttttctactttgttattgtatatacagtgtgagaataagaagcttttgctgtttttgaaataacagtgttgcagactctgctttagtggtgtgacaaccaggtaaagtgcaggccaggataagttgtcgaagtcacaatgaaatagtcttcaaccttgtacagaggtactgatttccagggcttacctctagtcaacacagtagtttggtgtagattaaggatgtttacttgcctttcagatcccaagatggggtctgtaaataatttctatatcttcttataatgtggcgtccatattttttgggaaaaacaaatcttaactgtgatttgaaaacagggcattagtcttcattcttgaataccattttatattgaatccagagtaattttcttttttcacttcgtccattggcctaaagtctctttagttgtgttttttttttttaaaaaaagaaaccattgtaactgttcttaagtgtataattcagtggcattaatactctttgtttttaatcatttagagactacaacccagaaggtaccagtcagcctataaaaaacactgacgtttttcttttgcttgtttgtatgtgtaccctatattgccgtacaacttgttcagctctagaaagctgacagatgctaaaaggaagaaataagttaaatcccataatcaggatttctttatgttttaggatcacattagccttttccagagatagccgaagtgcctagagagatagcaaaatatttcactgttttgtatgtaaattgaaattgtactagtagtatatttgaaaagtgatatttaataagaagcctgtaaaaccctaagcttctctcccttattatttgaaaattattttaagacctgtagcccccacattttgatgttgttagatttatcaacattgtctgggtaatggtcctgttctatttagggtggtttttctgcttatggtctgtgctacttcttaatatacagtattaagagttttggttaactctgaactgcccgggttgattagagtgattccagacagatcgtgttttgaacttgcatttttattttcccattttaatggattgaaaaacattatttaatatgtgttctgggccaggcacagtggctcacgcctgtaatcgcaacactttgggaggccgaggtgagcagatcacctgaggtctggagttcgagaccagcctagccaacatggtgaaaccccatctctactaaaaatacaataaattagctgggcatggtggcatgagcctgtaatcctagctacatggtaggctgagacacgagaatcgcttgaacccgggaggcagaggttgaagtgagtcgagatcgcactactgcactccagcctgggtgacagagcgagactccatctcaaaaaagtaaaatacaataaaatgtattctgtttgccagtcctggaagcctttatgatttcagtattctttcctcttgtgtgtgctatttgtgataacacagattgtcacttactgattaggcatatgcagaagaagaaatttcatttgatttttctttagtgttctcttttaggtaatggaaatagatcggtctgccaattttgtaggtatgactcaccagaaagagatgcattgagtaagaagaaaaacaaatatatgtagtcagtttcctaactttagtaatgctaaatccaacactgatggcatgagttatccttcaggtgttaaagtatttttgctgattcatagcttgtaacttcgtgttctttagatgttgccagggatttttaataaattagctaagaagtgtgtgtgtgtgtgtttttaagagatggggccttattgcccaggctggactcgaacttctgagcttaagtgatcctcccacctcaggttccctagtagctgggattacaggcaggtgtcactgtgcctggctgaaagtatatactgaatgtttcatacatagcactctcctagaaataggggcaggaagtaaatgtcatggttgccttgcctgaaaggaacttaattttgttgtggagcaagtgcaaacacttaagaaaacaaggaaggctgggcgtggtggcttacgcttgtaatcccagcactttgggaggccgaggcaggtggatcacgggaggttgggagttcaagaccagcctggccaacatggtgaaaccccatctctactaaaaaatacaaaaaattagccaggcatggtggtgggcgcctgtaattccagctacttgggaggctgaggcaggagaattgcttgaacccagaaggcggaggttgcagtgagcggagattgcaccactggactccagcctgggcaataagagtgaaactcttatctccaaaaaaaaaaaaaaaaaggaaaagtgtacagagtataataaatttattctggggtatatgtaacaagtatagtagaaggaagagttaaggtgggccagggtcttgaggagaggtcatataacagtgattaagaacacagcctctggaaccagattgcctgagctcaaatcctgtgtctgccacttattggctgtgtaatctgggcaaagttacttagaatctctcagtgcctctcttgtccttgtctgtaaattgggaaataatcatccttccctcatagggatgttacgaggattaaatgagttaatacatgctaggtgtgtagaccgcaatgtgcctaccatctagtgagtgcttgatacattttagccattattaagacttcatagtgaagttagaacttgcactggagccttgaagagtaggtggaatttagataagcaaagatgtgaaaattatctcaaaatagtattcataagctataaggttttatgctcatgtccctgaagaaaaaacttagaaataaaattatatatagaaactaaagttgtttttcttttccctgctttagttggtaatttcggcaaagacttatgctcagttttgctctatttttctttagctggagctgcttgtacaatgaagtggttattttctataagtaacatttactgatagctgaattcttaaaatactgtctatattagaagaggcttattccaagaaaatttctgtcaaaatcagtattgacttttttttaaaaaaatgagactggggtaggagataagagactaatgggatagagagaaggtaggggagggttgccagttacatgggagcagtgtttgaataatgtgtgagggccggtggagagtgaatctgaaaatattgctagcagtttgtagagagaagacattgctatactaagcttcctggtggtaatctagaaagtgagccccatagctacctgaaggtttcattgattacttgcaaacttctgaccacgacctggtgccagtgggtcatctgatcttagagtctcagcttacctgaatggattgcttcagtgcaagagtggctctggctgctgcctcagattgggagaaaataagatacatggctttctggaaaaaagagctctcaggtatgcacaagagggcagggtgctctgagctgatttatatgtatttaaataaaatttgttatttgtttttgttacataagcagcattatagtggcagtaaaaaatttaaaaatatgtatcttgagtttcacttttttttttttttttttttttttagacggagtctcactctgttgcccaggctggggtgcagtggcgcaatctcggctcactgcaacctccgccttctgggttcaagcgattatcctgcctcagcctcctgagtagctgggaccacaggcgcgtgccaccacgcctggctaattttttatatttttagtagagacggggtttcaccgtgttagccaggatggtctcgatctcctgacctcgtgatctgcccgccttggtctcccaaagtgctgggattacaggtgtgagccactgcgcccggccgagtttcactattctaagagctcccttttccatacatttcctttcagattttgtcctaaggcatagttactgaaaaataacaaccttaagctcttttttgtttgtttttttgagacggggtctcgctctgttgcccaggctggagtgcaatggcacgatctcggcttactgcaacctctgcctcctgggttctagtgattctctcacctcagcctcccgagtagcttggattacaggcccccgccgccaaacctggctaatttttgtatttttggtagagatggggttttaccacgttggccaggctggtctggaactcctgacctcaggtcatcctctcgtcttggcctcccagagtgctgggattacgggcttgagtcaccgtgcctgggcctaagcttttttaaaaatgagaaatattggccgggcatgcagatcacttgaggtcaggagttccagaccagcctgtccaatgtgatgaaaccctgtctttactaaaaatacaaaaattagccgggtgtggtggcgggcacctgtaatcccagctattcgggaggctgaggcaggagaatcgcttgaacccaggaggcggaggttgcagtgggctgagattgtgccactgcactctagcctgagcaacagagcgagactccgtttcaaaaaataaagaaatatcccatattgtcattacttgattatagctttatgcattttttagcaaaatacttctcatttctcatgtgcatacctcataactgtttagagttgctgtcataagagtatattgtatttctgcctctaaaaatttacttggtattatgtcataaaccttttacttgtctctctatagttattagaattatagctggacgtggtggctcatgcctgtaatcctagcactttgggagggcggaggcaggcggattgtttgagcccaggagttcaagaccagcctgggcaacatggtaaaaccctgtgtctacaaaaataaaaataaaaagccaggtgtagtggcatatgtgtgtagtcccagctactcgagaagcggaggtgggagaatctcttgagcctgggaggcagaggttgcagtgagctgagctcgtgccactgcaccccagcctgggtgtcagagtgagaccctgtctccaaaaaaaaaaaaaaaattaggacttcatattctttaatggctacattatatttattaaactattatcctgtgttaggcatgtctagttatatatgatggttgatcatcgatcatacttcctttacctgagtctagaacatactgagaaaacatagaacaccagacagatggatataaaaatttaatttttattcagctgaattggaacacaaagttgaactgtggtcaaatggacatcctaagtttatacaggatgacctacctgagaattagaggctgcaaagcaggcacacataatcagaacaatgtactttgcatttgtgcaacttcctaatacatgaactccacttgctggagaaatgcgaaatcactagagattagactttgctattcactaatcagctacatcattcctctgttgaaaagtacatacaatatgatgccctttacataaaattctagaaaatgcaaaccacagaaagatcaggggttgcttggggatgggaaggggcaggagggaaggattacaaaggcacacgaggaaacatttcggggtgatgagtatcttccttactttgctttaatgttttcacaaaatcgcctgtgaactttttcaagattacatttctaaggttaataattataaaattatttacccttaattgactcatctttatacactctaatgttattttttgagatataattcatatactacgtaattcaccctgttaaagtgtacagctaagtggttttagtatattcacagagttatacaactattaccactgatttagaactttttcatcatccccaaaagaatccccatacacattagtagtcactacatatttctccacagttctctcagccctaggcaaccaccaatctattttctgtctctatggatttgcctatataggatatttgttataaatgaaatcatgcaatatgtgaacctttgtgactgactcttttctaattagaatactgttttcaaggttcatccatgctgtagcatgtatcagtacttcatttttatggctggataatactacatggtatggatattccacattttatttattcatcagttgatggacatttaggttgtttacactttttgcctgttatggataataatgctgctgtaaatatttttgtacaagtttttgtgtgatcatatgtttttaattttcttggttatataactaggagtgaaattgctgcgtcatatggtaactgttcaactcattgaggaacagaccataatattttaagaagtgctgatgtgatcatggttagtgtagagcaagttctgccaaatggaagatattgtccatcctgttttttattttgaatgtgtaaatagttcaccccaaatattttcagaaatactgtcattatacttacattcagagtaatgttttcagtttttcaaggcaaaacttgtcaaactgtctctgtgattctttagactgttttagcaaaactctatgatagtgttccctattagtttttacttatgtaagctgtgtcctgaatacccagttttgttgtatgagctattttttttttcttttatgcttatctaagtctactcagagacaaatgacctgaagctatttttatccttagtgctgatttggtataaatttgtgaggtgtgcttttccatcctgtgttctttggtcagggtacactattattttgagattaaaataggccacaaatacattgactgttactattaatttgcactaatttgcactttgtatactagtaggaaaatgcctcatgctgatgttgaagctgtttttaagcatggatcctttagaaattttgtatattattaggtgtggtaacaatttatagtcatctaaagtatgttagtatcaaagcagagtattatgaacttggtgcttgacttttctgccagtcaagattttaaatatttcatttttatattataatgaaactaatggttactttgagagttgtcttctgtgagcaaatgttgtggaattgtatatagtaagggaatcatagatttcttataattcaccttagtgagatagatgattgagaacatggaggagtctgctcgtactttttcacttattgaagacaagtatagttttaggtttttaaatgtcgtgtttactttggaattttgggtcaagagaattcttgtgttctagaccgtttttcagactagaaaccagtgatctctaatagatgaagactataattagaaagtaaagggaaataaggcagatttgataagaagcgcaaatggcagttaaaatgaaaaggtgttttatgtcaccagtatttagagaaatctttttgtttggagacagagtttcactcttgttgcccaggctggagtgcaatggcgcgatcttagatcactgcaacctctgcctcccgggttcaagcaattctcctgcctcagcttcccgagtagctgggattacaggcatgctccaccacgcccagctaactttttgtatttttagtagagacggggtttcaccatgctaggctggtcttgaactcctcacctcaggtgatccacccgcctcagcctcccagagtgctgggattacagatgtgagccactgtgcctggctgagaaatctaattgatgtttttactctgcatattactctttgttcttcagcttatatattagaatttttaaaactttaaaaaaatgttggtcaggctgggtgcagtggctaatgcctgtaattgcagcattctgggaggccgaggcaggtggatctcctgaggtcaggagttcaagaccagtctggccaacatggtgaaaccccatctctactgaaaataaaaaattagtcgggcatggtggcagacacctgtaatcccagctactctggaggctgaggcagcagaatggcttgaacctgggaggcggagtatgcggtgagccaggatggtgccactgcactccagcctgggtgacagagcgagactccttctcaaaaaaaaaaaaaaaaaaaatgttggtcagagtaggggtaaatgtaagcatttatactctggtaggagtctgaattggtacagtagcccccccccttaccctgtggtcaaccatggcctgaaaacaggtgagtatagtacaataagatattttattttatttatttttatttttatttttttgagacagggtcttgctctgttgcccaggctgaagtgccatggagtgatctcggctcactgcaacctctgcctcctgggtttgagtgattctcatgcctcagcctcctgagtagctgggactacaggcatatgccaccatgcccggctaattttttaatttttttagtagagacaaggtttcaccatgttggccaggctgatctcgaacttctggcctcagtgatcccccccaccgccttagcctctcaaagggctgggattataggcttgagctactgcgcccggttacaataagatattttaaagtggggcacagaggctcatggttcaatcccagtactttgggaggccgaggcaggaggattactttaagccagatgtttgagaccagccacaaaattagaccttatctctaaaaagaattttttttttaattagctgagtgtgatggtacatccctgtagtcctagctacttgggagattgaggtgggaggatcacttgagcctaggagattgaggctgcagtgaaccatgatcacggcgttgcactccagcctgagcgaccgagttgagaccttgtctcaaaaaaaaaaaaaaaaggccacattcacaaaacttttattattatatattgttataactgttctattttattattagttattgttgttaatttcttactatgtctaagttataaattaagttataagttataaattaaactttactgtaggtatgtgtgtataggaaaaaacatagcatataattagggttctgtatagctcactgtaaccttgacctcatgagcttgagctcaagatcctgggttcaagtgatcctccccactcagcctcccgagtagctggaacatcaggtgcttgctaccacacttagctaatgtttaaattttttgtagagacaggatctcactctgttgcccagactggtcttgaactcctgggctcaagcgatcctcctgccttggcctcccaaagtgctaggattacaggcataagccactgtgcccagcctgtttttgggttttctaggtacacaaattattaagagttcagcaaattttctgtatactaaggtcaatatacaaaaatcagttgcgtttctgttagcaggaattaactattaaaatatagaattttaaaaaaaagatactaaggcaattagaaagtcagttcaataggaaaatggacaaaagacatgaaacaagataagacataaaagagaaagaatagagatttaaaactgatttaattgaaacaactgatgagtactgaaaaagtaaactcagtgtgatttaacactgagtttaaatttaagaaataaatgtggctgggcgccatggctcacgcctgtaatcccagcactttgggaggccgaggtgggcggatcacttgaggtcaggagtttgagaccagcctggccaacatggtgaaaccccatctctactgcaaatataaaaaattagcggggcgtggtgtcacatgcctgtaatcccagcttctcgggaggctgaggcaggagaatggcttgaacccaggaggtggaggttgcagtgagccgagatcgtgccactgcaccccagcctgggcaacagagcaagactccatctcaaaaaggaaaaaaagaaaaaaaaagaaagaaatgtctggatttctaaaacaccaaaaaaaaaaaaaaaatgttgggggaaagagaagacatatgaatggctggtaaatattacatgacaagatgtttagccttattggtatattcgtatcagggaaagcaaactaaaaccacaatgacagggtgatgtcagcgaaaatggtagagtaggacttctgtgggtcatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcattttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaaacaaaaaaaccaaaaaaagaaaaaaaaaaaaacagggcaaacaataagatattgaaagcctgagaggaaaagctgtagagtgagtttttgtagaggaataggagctttgaaaagctattgtggatgagaaactagaaagccaagtgcacagctcagggcagtatgtgtgctcagaaaagacctgagaaagccattagctttcacctctggcttgtctttaggttcaacacaaacaggaagtgaatattaaggtagatttataaaggccctgggtaagttttgaaggagtgccccaacagctaatcagtagagacctggcgagcattttacttttctttttctttcttttttttttctttttggtttatttgttttgaaatgtggtcttgccttgctcaggctaatcttgaactcgttggttcaagcgatccttccacttcagcttcctgagtagctggaattacaggcacacaccactgtacccatctatttttgtttttattttttacacattataaatgttcagtttttttaaaaaaaattacgaagcatgtgaagaatctagaaaatatgcttcattcacaagaaaaaagaaatgaacagaaactaccccgaggaagcactaatactagaattactagacaaaaactttaaatcagctgtcttaagtatactcaaagagctaaaggacaccatggacaaagaagtaaaggaattcaagataataatgtctcaacaaatagagaatatcaataaagagaaatttttaaaagtaggcaaagagaaattttggagctgaaggttacaataattgaaatgaaaattcactaggggagctcaacaaaagatatgagcagacagaagaatcagcaaacttggagataggtccactgaaattatatagtttgaagagcacacatttaaaagactgaagaaaaatgaacagagtccaggagatgtgtgggataccaacatatatatcatggtaaggagagggagaaaggtgcagaaaacatgtttaagaagtaattgccaaaaccatttcaaatttgacaagacatgaatatacacatcaagaagctcagctaacacccaagaaggataaactcaaagacatccatacaagacacattataattaaaatttccgaagccagagataaagagagaatcttggaagcagcaagagagaagcaacttgtaaaatataagggatcttaaataagatgaatttctgttgatttcttagcggaaaccatggaggctagaaggcagtgggataacatatttaaagtgatgaaagacagacctgccaaccaagaattctaaatctggcaaaactatccttcaggaattaagaagaaatcatgacatacccagataaacaatagctgagggggcttcattgttaatagacctgccctgtaagaaatgctaaaaggagtcttcaggctcaccacagatctattaaattttctttttggcataggaccgaaacatgcattttaattaaacattcgtaatttttcttacacagcaaaaccaaaagccccacaatggaaaatcattttctgttcactgattgttaaaaactttttttaaaaaaagtcctgtgacatcaagtgcttgccaggatgtggcacagtagaaactcttaaacacttggtgggtgtttaaattgctacaaccagtttggaaaacaatttgtcattacccagtaaagttgaagatgtatagatcatgtaatagttttacagaccaaaaatatagaaactctggtacctctgcagaagaagacatacagtaatattcacagtggccatttgtaatataaaaaactgtaaacaatccaggtgtttattgattgatttttctaacatgtgacttatttctggtctttactagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaagggtgagttgttttattttaagttctttttaaggtagtttcaatgaaggacaaattggtataatctaatctttataagggtctcatacttattacctttgtggacaagatggacatatgtagaaaggatgaaagtgaagctaaattgaatgttagtactcacccgatgataaaccagagagtgagaaatgctatgtctctgattaacatttttattaatggctcagattaatttatagatgatatgtgtctcagtccattttgtgcagctatagcagaatacctgagactgggtgatttataaagaacagagattcatttcttatatttctggaggctgggaagtccaaggttgagggatccacatctggcgagggccttcttgctgtgtcattccatgttggaaggcagaagggcaagagagcatgcatgagcaagaaagaaaggtgccaaactcatccttttattaggaactcactcaacaataactaatccacttccaggataaaggcatttaatccactcacaggagattcatctcttaaagtctccacctttcaacactgctccactggggattaagtttccaacacatgaatttttgaggagggcacattcaaactatagcagtatatttatcaaaatttcaaaagggtatcaaatatattaggcattaggattaaatatttcaacagattggaacagtggacttaacatgaaatttaatcaagtatctgctttttgtgaagaaaggaaaaaaatttaataggataaatatgaagtcttgtgactgtaaaaacattcatgtaataaatgtttgttgagtgtcttttgtatgggacactgtactagacactaggaacacaatgatgagtcaaatagatggttttgctcatggatctcatttagttggaataataaacgttaattttaagtgtttaccatatgcagaggactgtgcttcatgctttatctgctttatgttgtttaatttgtgtgaagtaataggtgctattgctgttttcattttataaaataattaactgagtctcagagaaataaagtaacagccattggtggatctaagacttgaatctagggctatatgaatctagtgcgacattgtcttatatggtagctgctagccacatgtagctatatgtttacatttaagttaaccaaaagttaataaaactcaaaattcaaagtacctcaatcccaaatagctatattttgagtgctcattggccacatgtagctaatacttatcatatttgacagaacatattatagaaaatttccattatcttagttctattgaacagtgctgttctagagcctacactccccctttcccccaacacacaccttctaggctttattaacattttactatacttgcgttattacatatctatccattagtgtttctttgttaaacttgtttgcttttggttcctaatatatgcactatcatactaagaaagtttaattttattcataatttattaggggcttttaattaagaatgactaatgattttgtcacatgccctttgcagtcctatcaaaatgaccttagagtttttctcccttaaacagttaatgcattttattaacaagtaggttttctaatgttttctagtgtttttattcaagctgctttgtcaaggagcactaaaacctcttttttaggggtcggggttggggaaacagggtctcactttgtttcccaggctagaatgcagtagcaagatcatgtttcactacaacctcaaactcggtgggctcaagcaatcctcccacttcagcctatgaactaggtaggactacaagcatgtgccaccacgcctggctaatttttcaatttttggtagagactaggttgcccaagctggagtctcttaacacattattggagttgatttgttccttatctttttttttttttttttttaaggatttttacatttattcaaaagaggatgagtctctttatcaagttttggtgtcaggattatattagtttcataaaaggaactgggaaaacttgctgtattcttatgcttggaaatagtttacataacacaggaattacctattatttaaaggtttaatgcaagttacctgtaattccatctggacctggtatctttttgggaactagatctattacagtcttttcagttacttctgtggttgatagtatagggtagtgttttatttatctctgtattctcagcttctagtgcagtatcggttttatagtggctactaaacatgtttgttttgaataagtggataattgtaattatgtctctaaaaagtataaaaaacatatgaattaatagtaataatagctaagagtatgtgccagaaactagtctaaatgctttacaggtattcatttgtttaatcctcactataaccatgtgaagaaggtattgtgaatatctccattttactggagaaactgaggcacagagagtttaggtaaattgtctaagagtataaaggcagttaaatattggagccaggatagtgcaaaaatcaaagtatttgtatttggtgagatttttaactgttcacttatactaaaaaattttagtataactatttagtataagtcaaaaatttaaaattaagtagccttctcacttattttttaaccaaagatttaagcatttccctaattttctcagaaactttccttccaaggcaccagtatatcagtaaatagaacttgaaagtttttaattcagtttcttttctcttttctttcatagaagtataaataaacacagtatatctttggggcctattactatacccagctagcaggcctgcctagattgttccatatggttgttactttacagtaattgtcattatgatgtcactgtatgttttgaaagtacaatttcatgttttatacatttttaaaaattgattgaattttagcatggcttcttcctgataacagttttgtcctcttgctttgagaaggagcatatgggcattccacttatggtttccatgggctgcatctcagattcctgttcattctacgggtttcactgtagacagagtactttgtatttaatggccgggtgcggtggctcacacctgtaatcagcactttgggaggccgaggcaggtggatcacttgaggtcaggagttccagatcagcctggccaacatgatgaaatcccatctctactaaaaatccaaaaattaaccaggcatggtggcggttgcctgttatcgcagctactcaggaagctgaggcaggagaatcacttgaacctgggaggtggaggttgcagtgagccgagattgcgccactgtactccagcctgggcgacagagcaagacctcatttcaagaaaaagagtactttggctggcgccaacagggtccaggtctgtgcctgccattggagaggatgccacagccacaggggtgggcgctggcctggaggcctccaaggggcatctcctgtgagcccaggggatgggcaggatctgagcggagaagagtgaaagtggaggagtgaggccagaacaaaggctttgccgtgaaagaggtggtttcccgcctaggctctgaccttcactcactgtgtggcccaggccaagggcaagcgtctgacctcgctgggcctttgtttctcaggggtaagatgaaacaatggctccctctccctctccctctccctctccccacggtctccctctccctctcttgccatggtctctctctgatgccgagccgaagctggactgtgctgctgccatctcggctcactgcaacctccctgcctgattctcctgcctcagcctgccgagtgcctgcgattgcgggcgcgcgccgccacgcctgactggtttttgtatttttatggtggagacggggtttcgctgtgttggccgggctggtctccagctgctaaccgcgagtgatccgccagcctcggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccaccaccccttctgggaagtgaggagcgtctctgcctggccgcccatcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccaccccgtctgggatgtgaggagcgtctctgcccggccgccccgtctgggaagtgaggagaccctctgcctggcaactgccctgtctgagaagtgagaagctcctccgccgggcagccacaccgtctgagaagtgaggagcccctccgcccggcagccaccccgtctgggaagtgaggagcgtctccgcccggcagccaccccgtccgggaggtgaggagcccctccgcccggcagccgccctgtctgagaagtgaggagcccctctgccgggccagccgccccgtccgggaaggaggtgggggggtcagccccctgccctgccagccgccccgtccgggaggtgaggggcgcctctgcccggccacccctactgggaagtgaggagcccctctgcccggccagccaccccgaccgggagggaggtgggggggtcaggtcagccccccgcccggccagccgccccgtccgggaggtgaggggcgcctctgcctggccgcccctactgggaagtgaggagcccctctgcccggacagccgccccgtccgggagggaggtgggggggtcagccccccccggccagccaccctgtccgggaggtgaggggcgcctctgcccggccgcccctactgggaagtgaggagcccctctgcccggacagccgccccgtccgggagggaggtgggggggtcagccccccgcccggccagccgccccatccgggagggaggtgggggggtcagccccccgcccggccagccgccccgtccgggaggtgaggggcgcctctgcccggccgcccctactgggaagtgaggagcccctctgcccggccaccaccccgtctgggaggtgtactcaacagctcattgagaacaggccatgatgacaatggcggttttgtggaatagaaagcggggaaaggtgaggaaaagattgagaaatcagatggttgccgtgtctgtgtagaaagaggtagacatgggagacttttcattttgttctgtactaagaaaaattcttctgctttaggatcctgttgatctgtgaccttacccccaaccctgtgctctctgaaacatgtgctgtgtccactcagggttaaatggattaagggcggtgcaagatgtgctgtgttaaacagatgcttgaaggcagcatgcttgttaagagtcatcgccactccctaatttcaagtacccagggacacaaacactgcggaaggccgcagggtcctctgcctaggaaaaccagagacctttgttcacttatctgctgaccttccctccactattgtcctatgaccctgccaaatctccctctgcgagaaacacccaagaatgatcaattaaaaaaaaaaaaaagaaaaagagtactttgtatttgtatttaagaaatcagatgtcagagattagcctttgtgggattattagtgtgttcctcacaccaacttaataagtttccctgaaatgaggtccattttctttgactttttcattggcatgagtaaaacttttttactaacacagagacagggaactctcacattgttcattcattctgcaaatatttattcagtgtccctaaagtatgtgctttatcctctaatctgcagcttttgaatgatagttaattaggtcttgaatagactagctcatcttatctgactttaagtgcatctgacctgtgccagcagattaatttataaatttataactgagggtattctgtttcagtgactataaaactcatttgtttgttagcatactcttgtctttgaatttctcaagtatcaagaaatcaaaagcaatcagatggttgtttagtacatatagaatcagcaaggaaattgcatgatctttaagagaaattccatccagattgtgataaatgctaaggaattactcatatttcacttcaaataatttttttttaattttttttttttttattgatcattcttgggtgtttctcgcagagggggatttggcagggtcataggacaatagtggagggaaggtcagcagataagcaagtgaacaaaggtctctggttttcctaggcagagggccctgcggccttccacagtgtttgtgtccctgggtacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctacttctttctacacagacacaacaacaatccgatttctctatcccttccccacctttcccccttctctgttccacaaaaccgccatcgtcatcatggcccgttctcaatgagctgttgggtacacctcctagacggggtggtggccgggcagaggggctcatcacttcccagaaggggcggccgggcagaggcaccccccacctcccggacggggcggctggccgggcggaggcaccccccatctccctcccggatggggcggctggctgggcgggggctggcccccacctccctcctggatggggcagctggccgggcgggggctgaccccccacctccctcccggaccgagtggctgctgggcagagacgctcctcacttcccagacggggcggctgccgggtggaggggctcctcacttcccagacggggcggctgccgggcggaggggatcctcacttctcagacggggcggctgccgggcggaggggctcctcacttctcagacggggcggctgccgggcggaggggctcctcacctcccagacggggtcgcggccgggcagaggcgctcctcacatcccagacagggcggtggggccgaggcgctccccacatctcagacgatgggcggccggcagagacgctcctcacttcctagatgggatggcggccgggcagagacgctcctcacttcccagacggggtgtcggccaggcagaggctgcaatctcagcactttaggaggccaaggcaggcggctgggaggtggaggttgtagcgagccgagatcaagccactgcactccagcctgggcaacattgagcactgagtgaacaagactccgtctgcaatcccggcacctcgggaggccgaggctggcggatcactcgcggttaggagctggagaccagcccggccaacacagcgaaacccagtctccaccaaaaaaatacgaaaaccagtcaggcgtggtggcgcgcgcctgcaatagcaggcacttggcaggctgaggcaggagaatcaggcagggaggttgcagtgagccgagatggcagcagtacagtccagcttcggctcggcatcagagggagaccatggaaagagagggagagggagaccatggggagagggagagggggagggggagggggagggccaaatatttttttaagacggtaaaatattaatgcttgttaggttttttcctttgtgttaggtcaacaccagcacattcatgttttccagacaagtaatagagattaccacccattagtctgcacttactacattaaaacccatctttattttattttgttgtttttgttttgttttgtttttttgagagggagtctcactctgtcacccaggctgcagtgcagtggtgtgatctcggctcactgcaacctctgcttcccaggttcaagcaattctcctgcctcagcctcccaagtagctgggactacaggcatgagccaccatgcctggaaaattttttgtatttttagtagagatggggttttgccatgttggccaggctggtctcgaactcctgatctcaagtgatctgcctgctttggcctcccaaggtgttgggattacaggcgtgagccactgcgcccagccccatttttattttattgtgctttactcttttgtttttttgttacactttagcttggtagtttagtctccttcctggttatataaaggaagcctctttgattttagcagtaagctgtttctgattcgctttgtagggtacattacttctaagaaggtgtcccacctaaataatacgttcttttaaaaatttattatttttattttagattcgggggtacgtgtacaggtttggtttttattttttaatttttaaaaatttgctttcctggtaactcacaaaacagcaggtttattacacgggtatattgtgtgatgctggggtttgggcttctaatgatcccatggcctaagcagtgaacatagtacctataggtagtttctcaacctttgcccttctccctccctctcccttttgtgatctccagtgtttattattccttactttgtgtccttgtgtacccaatgtttagttcccatgtataagtgagaacatgtggtatttctgttttctgtgttaagttgcttaggctaatgacctccagctatattcatgttgctgcaaaggacatgatttcgttcttttttatggctatgtaaagaatatgttttaagatttcccacctagagaatatgttcttctgaaattaaccctaggttcttggaccatagatttctgaccactgatcacatctcagattttgagaactgactttttttggttaacttttttttttcttattaaaaaaaatttgttttggtatggaataaaaagacagccttatccagaaatagccatagttacaccttgatgtataatcttgtagacctttttaaatacatatatatgataattacatctatataattgaaattgaattgattatactacacatattttataatcttttttatcttaatagattgtatatatctttcaagataacatttgattggggcctgtattagtctgttttcacactactgataaagacatacctgagactgggaagaaaaagaggtttaattggatttaatagttccacatggctgagaaggcctcagaatcatggtgggaggctaaggcacttctaacatggcagcagccaaaccatgtcattctgcccctggcccctccaaatctcatgtcttcacatttcaaaaccagtcatgcattcccagcagtcccccaaagtcttaattcatttaggcattaacccaaaagtctgaagtccaaagtctcatctgagataaggcaagtcccttctgcctgtgagcctgtaaaatcaaaagcaagctagttacttcctagatacaatggaggtacaggtatttcgtaaatacggccattccaaatgggagaaattggccagaacaaaggggttacaggtcccatgcatgtccaaaatccagcaggacagtcaaattttgaagctccaaaatcatctcctttgagtccaagtctcacatccaggtcatgctgatgcaaaaggtgggttcccgtggtcttgggcagctccacccctgtagctttgcggggtccaacctccctcccggctgctttcactggctggtgttgagtgtctgtggcttttccaggcgcattggtgcaagctgtcagtggatctaccattctgggatctggaagatggtggcccacttctcacagatccgctaggcagttccccagtagggactctgtgtgggggctcccaccccacattttccttccgcaccgccctagcagaggttctccatgagggctccgcccctgcagcaaacttttgcctgggcatccgggtgtttccatacatcttctgaaatctaggcggaggttcccaaacctcagttcttgtcttcagtgcactcgcaggctcagcaccacatggacgctgccaaggctttgggcttgcactctctgaagccacaacccaagctctatgttggcccctttcagccatggctggagcaactgggacacagggcaccaagtccctaggctgcacacagcacggggaccctgggcccagcccacaaaaccactttttcctcttgggtctctgggcctgtgatgggaggggctgctgtgaaggtctctaacagggcctggagacattttgcctgtggtcttggggattaacattaggctccttgctacttatgcaaatttctgcagctggcttgaatttcccctcaaaaaatgggtttttcttttttgtcacataggctacaaattttccaaatttttatgctctgcttcccttataaaactggttaacagcacccaagttacctcctgaatgctttgctgcttagaagtttcttccaccagatattctgaatcatctctctcaagttcaaagttccacaaatctgtagggcaggggcaaaatgctgccagtctctttgttaaaacataacaagagtcttctttgctccagttcccaacaagtttcttatctccatctgagaccacctcagcctggaccttattgtccatatcactattagcattttgggcaaagccattgaacaagtctctaggaagttccaaattttcccacattttcttgtcttcttctgagcccttcaaactgttccaacttctgcctgttccttagttccaaagtcaattccacatttttggtatctcttcagcaatgccccactcctggcaccaatttactatattagtccattttcacgctgctgataaagacatacccaagactgggaagaaaaagagctttaattggacttacagttccacatgactggggaggcctcttaatcatggtgggaggtgaaaggcacttcttacatggcggcggcaagagaaatgaggaagaagcaaaagcagaaacccctgataaacccatcagatctcatgagacttactgtcatgagaatagcatgggaaagatcggcctccatgattcaattacctcccccagggtccctctcacagcatgtgggaattctgggagatacaattcaagctgagatttgggtggagacacagccaaaccatatcagagcccatctaggggaggtttcttaattaattttttcctgggctcaagtgatcttcccatctcagcttcctaagcatctaggaccacaggtgtgcagcactaggcccagctaatttttaaattttttttgtagagatggggtctccttatgttgtccaggctagtcttgtattcctgtcttggcctcccaatgtgctgggattacaggtgtgagccactctgcctggccccataagaggtctcttaatttattcagcagacattgtgtattactgtgtgccagatgttgggcatacagtagtcaataaatagtcaagaatgactgccctcgtggagcttaagtactaatggagaaagatagatgatcaaaataaatagaattttaagcagtagtaagtgctatggtggaagaaaagcagggatgggagatagggaatatggttgaagtgaagtttcaaaaagagcatagtcagcaaatgtcttattgagaaagtatctgaatagacaccaaggaagtgtagggatggacaaacaaggagagaccaatgtagggcagagaaggtgaggggaatggtaggagaagttgatgggagtgggaatggggaggtgggtattagattatatgaagcctagttggcaattataagagcttctgttccaatggagagttaggtgtcatttatatcttgaaatgattgctctaactgctgtgctgaaaatagaatggggggctgcgaggtgtgcgaggcaaagacacagcagagaaaccatttaagaggctattgcattaatataagctagagatgccagtggtttgggtgagagcagtgaaaaatggtttggtttcagatgcagtttggcaatattcatgataggagttactgacagattggatgtggggtgtaacagaaagaagagttatgacaccaaggtttttggcctgaaaacaagaagaatggagccaccatccactgacatggggaacattaggaggagtaagtttggaggaaaatatttaagagttcattcagtttgggacataataagtttgaggtgcttattatacaagtggaaatgttgaataggcagaggtcttggctggagataatatttggaagttgtggcctatatatgatatttaaaattataaagctggataaagtggtcaaagaagtcaagataggaaatagcagagctcagagaattgaggcctgggccctcgatggttagaagtttggaagataaggaagaataagcaaaggagactgagaagaaacagccagggaagtacaaggaaaacctagagaggctacagctctggaaactatgtgaagactcttacctggttttagcatgtgacttcccttccagacccagtgggttgatttttctcgtctgtgagtttctaaaattaaatgtatacactatcttccttccctccacatcttccccagacatttagctttaacaagaaaagatttttttttaataaacaaaattcattgtaaatactctgtcaactattgttctccgagcaacagctcttatgcattggggccaccctcagcagtctctgttactgctacaaaaacatgggactaacatctgacttccagagagtaagtagccaagaaagagaaatcatcagctgatcagctgctggtgagttgtccctcgtaattccaagcattcatataggattgacttttacagcttcaagaactaggctatctctcaaacttgattattaccatttacttattggtcagtgtaagcataagataatttgcccttcttgtcactgacaaataggtgggtatatattagttacctattgctgtgtaacactttaccccagaatttaacagcttatgacaatatttattatctcaatatttttgagggtcaggaatttgggagcaatttagctagatggttctggtgaagggcttcatgaggttataatcaacatgtcagctgtggctacagtcaaccgaacacttaactggacctggaacatccacttccaagatggctcactcacatgactgttggcaggaggccttagttcctcaccatctgggcctctccatagggctccttgaatgtccatattacttggcagctagcttctcttggagttagtgatccaagagaatgatagaggaagcaggaaaaaaacccataatatctttttatatcctaattttggaagtcacacactgtcattcctgctacattttgtctgtaagaggtgaatcactaaatctagcctacattcaaggagaagagaattagctccacctctagagaatttatggatgtattttaaaatcaccacagtttgccctctagccacaaattatttacacttcttctatgtgcaaaatgcactcacttcctcccgaaatctatcaaaaaagtctccttcttctatagcatcagcttgaaatataggtagctgtccttttaactaggtccaagtgtgggtgtggctccttgggtatagttcctcaggtatagttccttttgttgtgaagacctgtaaactaaagagacaggttaactacctatcacacacccaacatacagtgatatggacaggcagtgattctgaacaggtatagagatttcctgttccaaaagggaaaatgatggcacaaagaagttgctggttcacagcaattctgatagttgtctagacaaatgtcagaagttccttgactaggacttctacttctgcccaggagttcttctctgtgactctggaatccaccctgttagtcatcctttcttttccattaaaagtagttcatatttgtagctgcatagctttcttagcttgcttcttgccagtagaaatttcagggcccagagaccggttttcattttgtactatttttccacctttcagtttaagctggcagtgtttctttttaaaacttcgagtatcctgtgaatctcactgggattcatgccattaggcaaaagccacatccaccaatctcttctaaataggctttttccaccttgggtttctgctgggattgctgagagataccacttgtaatgggtagaattgtgtcccccaaaaagctgtgttcaagtcctaaccctgataaggtcaccgtgaatatgaccttatttggaaatagggtcattacagatgtagtcaagttatagtaagatcacactggatcaggaagggccctaatccaacggttgatagtcttataaggagagaaatttggctgggtgcggtggcttactcctgtaatctcagcactttgggaggccaaggtgggaggatcacctgaggtcagaagttcgagaccagcctggccaatgtggtaaaaccccgtgtctactaaaaatacaaaaattagccaggcgtggtggcccatgcctgtaatcccagctactcaggaggccgaggcgtgagaattgcttaaacctggaggcagaggttgcagtgagctgagatcgcaccactgcactctggcctgggcgagagtgagactctgcctcaaaaaaaaaaaaaaaaaaaaaaaaaagaagctagaaatttggacatgaacacatgaacacagaagacagaagaaagccatgtgatgacagaggcagaggttgtggggggcatacatctacaaatcaaggaatggcaaagattgctgtcaaacatcaccagaagccagagagaatcatggaattgatctccctcagaacttcctgaaggaactaaccctactgacacccacatcagtgaacgaataaattccttttgttttaagctacccagtttgtggtagtttgttatagcagccctaggaaactaacataacacccttaagcttcttagtccgattttctaattgaatgattctttaggtaccattctagatctttgtgaggttgtgttttttttgtttttttttttgagacagtctcagtctgtcacccaggctggagtgcagtggtgcaatctcggctcagtgcaacgtccgtgtcctgggttcaagtgattctcatgtttcagcctcccgagcagctggcattacaggtgtgtgccaccatgcccggctaatttttgtatttttagtagagacaggtttctccatcttggccaggctggtctcaaattcctggcctcaagtgatcctcctgccttgacctcccaaagtgctgggattataggcgtgagctaccgtgcctggccctttctgaggtcttaacaaagaagtgttatagtctgatccttggcttcatctgaaatcagtcttttggcagtgccttggattcgatctttgcttgaaatctcttaattttagtgtcatttactaatctggagatgctgggaattctcagaattatataattctgtcctttttgtttaactgttcttcctttaattcatccctcttttgcattttaaagtaagcagcaagaagccaggaggtactttcaaaagtgaaatcactttagctagattatcaaccagtttttggaccacaacatctactttccatgttatggtaaggccacagctttgccattatataacaaggatccttttccctccagtttctaatcagattttttctgccttttcttaatctctcacctttaacttcctcaaaggccatagtgcttctgtttttttttaaggctcttcaaacttcactgatgctctcctcaaagtccttttaacttctgccccactgctgggttccaaagatactctcaagttttgggtctttattgtggcggcaccggtatccagatatcgaaatctgtatattatctattgccatataacaaattatctcagagcttagtggcttaaaacaacaaatatttattatctcacagattcactgggtcaggaacaggttcagttgggagtagcatggctgagtggttctggcccaggatttcatgagcttatagtcaagatgttggccattgctgcagtataggattgactaggctttacacatattctggcaggtttgttctggctgttggcagtactcagttcctcatcacatggacctttctataggactgcttgatatggcactctcccagagcaagtgattgatccgacagaagtacaaggagaaagcactgccccccgccccccacctttttttttttgaggcaaagtctctgtcacccaggctggagtgtaatggcacaatcttggctcactgcaacctcctcctcctgggttcaagtgattctcctgccttatcctcctgagtagctgagactataggcacgtgccactaatgcctggttaatttttgtatttttagtagagatggggtcatgttggccaggctggtctcgaactcctgacctcaagtgatccacccacctcagcctcccaaagttctgggattataggcaagagccaccacacccggccatttcccccacttttttttaccttgtcttggaagtcacagattatcaattctgccatattctattgttaagtgagtcactaagtccagcccacactgaagggaagattatcaaataatttttggacatatttttaaaacaacacgaagcattctaaaaaaaagaaaacacaatgaattcatagaagcagagaatagaatggtagttactaggagctgtggggcagagggggtggattagagagatgttgaaggatacaaaattttagttaaaagttcaagagatctgttgtacaacgtgggtgacagtagttaataacaatgttttcagccaggtggggtggctcatgcctataatcccagcactttgggaggccaaggcgggcggattacttgacagcccggccaacatggtgaaaccccatctctactaaaaatacaaaaattagccaggcgtggtggtgtgcatctgtaatcccagctacttgggaggctgaagcacaagaattgcttgaacctgggatatagaggttgcagtgagctgagatggtgcctctgcactccatcctaggtgacagagcaagacttcatctcaaaaaaagaaaaaaaaaaacaaccagtgttttgtacatctgaaaattgctgagagagtagattttaagggttattgttgcaaataagtttgtgaggtaatgcatatgttgatagtttgatgtagtcattccacaatgcatacatatttcaaaatatgttatataccataatatatgcaatttttgtcagttaaaaataaataatgaaaaataatacaaaaaagcaagcaaacaaacggaatagtgtagttagctgctgttgaactttagtagcagggaaagtctaatgttggctattgccattgttatattaattggcctaataagtaaagtgggaaccagggacttaaaattgcatatcattgctgggcgtggtggctcacacctgtaatcccagcactttgggaggctgaggtcaggaggtcaagatcagctttgtcaacatggtgaaaccccatctctactaaatctactaagtatacaaaaaattagccgggtgtggtggcaggtgcctataatcccagctactcgggaggctaaggcaggagaattgcctgaacctgggaggcagaggttgcagtgagccgagatcgctccactgcactccagcctgggcggcagagcgagactctgtctcaaaaaagaaaaaaaattgcatatcatccagaacacagaagatccagtgaaacaatttcttcaggtttttcttttgctgaggcatcactccagtatctctttgggtaacaaagactcattcgtgtaaagaactgtgtacctgtgccatcttaagtattcagagtgacaaatgctaagcatgtgtgtgtttatatgtgtttgtgttataatcatctgaaacaaccttaacatagaattattgcttaaacttttttttaaaggactctttaaatgatatcttattcagaaacccaatgtgtacaacatacaaaaatggaactacccttgttaaagggaggtgggtccagagttccactggctcggcatcccttttaacccttccttatgttgatgtcagatattcagggaacatagtttgaaaaactataccataccatcagatccctttccagcttaattcacaaaaatctattaatctgtaagatagcagagctcaggaagatagccataatagcaaaatagcacaccgctgtgtggcaggctgatttctgatgctgtctcttgtgtactagccaatgaaaagccattttggtttagggaattagttggtgattaggcagccatggatatctgtagagtacttttcattagtctgttgtcttatctaattttttcttctgtaacagaatactacaacacatctttgcaggattctttgcaaattctgccattcctggatctccacaccctttttcctggtaagtaactaattgttttctatcttactctattggagtgacatattttaggtgctgtcatttctgtgcagtagagaaaaagagctgcataggccgggtgcggtggctcatgcctctaatcccagcactttgggaggccgaggctggcggatcacgaggtcaggagatcgaggccatcctggctaacatggtgaaaccccgtctctactaaaaatataaaaaattagccaggcgtggtggcatgcttctgtagtcccagctactcggaggctgaggcaggagaatcacttgaacccgggaggtggaggttgcagtgagccgagatcgcgccactgtactccagcttgggcgacagaaagagaccctgtctcaaaaaaaaaaaaaaaaaaaaaaaaaaaaaaaaaagagctgcataggtgagtatgtagatgtaactggaggctgctacactgccattatctgctaagcccaaacttaatcagaacttttttttttattattattcaggctcaggaaggccgtcctggtcccccaggatgtttgggtgctagaaatgtcttgattccttttatattcaggtctgagagttgtattgaggtagagaatgagatggtccctgccaggcttggtatctgatttgtgggtttccccagtagactacacaggaatattttactccttaagaatttctgaaattgaaaacattatgctgaacttcatttttttcaaagtaagaggatttgtcagaagaaacaataggctgtaattcagtatcagagtgacacttatgtatgatgggattaaagatggaatttcttcttgtctgagaaattatttgctgcttctaactgtggcccagaaggtttctttgctcaaaggaacctcagtccttttaggacctctgtcatccagtagtctggacctctgctggtagtgtaccagcagctctgagggaaaataaaaaaaaacggtgttgccaagtcccttttataattgctctaagttgtgattcagagagactgctatggctgcttctctacttgaaagctcctcattgtccagaactgtgggcggcctcttataatgagggatgtttgctgtagattttgaccagtcatgaagggaaaactctccttaaaaagcagctccatctgtgtttaatatcagtgggcacagaaaacacaaatttttgaaaccaacaggcaatgagtcactctttttgttctggcgtgtcatgtggtactttaggtagcttcacattttatgttctagttaagtaaaattcttagagaatgaggtactatctctggatagtctgtttgatcttgaaaatgtacagaattctttgcctcttgatcctggaggactagtgactttccagctctgagagagaacaggatccctctgccaatttttttctgtggtgtaaggcagagcctggtcactccatctaatgctgtctatctcatctcacgtataggagcgggatgctgcactccaaccctggggactatgcctggggtcagacagggcttgatgccattgtaacccaggtgaggagctgccttttgagggtgtctgttcagtgtgtctcatggttccacaggcttcctgctttccttctgctactttctgaaatggcagtcactctgctttctctaatattttgagctttggggtttccattttactaaagggatgaatgatttatggggttagctcagcatccatgcacttcctaggtctgagggaatttctagaagatggtttcacctccataggaagaaaagacttctataacaaatagtattttgtatttttgtctctcttgctcagttctataaggattctattaacaaatatttcacaaaaaaaggagggtttcctcacatgttgaagcagggatttctgctagatggagcaaagtaggggaaggaagcagagaaaaaagtattcccatgccatgtataattgcttccacttgtttatgttcattttaatttgattggtttttcatttccgttgtggatttctgagactagaaagcatgtcctttatattcagtcgtcttataggcagtaatttacctatttcttggctcacgttatgctacttttcatactctcgcttttttcttcttccagaagatgaagcttttggaccagttacattttactttttattaagctatagttttactcgtgacaccacaacccttttgctgcctctgaagttgctttatgcctagaggtgggccttgcaatcatgggtttgtctgtaggcttatacgaacgtcactctgaaattgtaaagcaattatgagtgttctggcagcaggaaaggggaaacccaagcctctcagagccttgcagaagtaagagtaactaacatacctaatgtctgcactgtttgttctcagctggagcagttccctctccagggatattgcgatgtctgccacttcgtctttttctttctctttttttgtagcttttaggacaactggaaaacacaggccctcccccagctgacaaggaaaagatcacatctcttccaacagtgacagtaactcaggaacaagttggtaggttcatttttatacttattctgtcatcttctgatctcggttcaaaatcccggtatcttctgacaggtgaaaagtttaaaaagtgaacaaaataaaaagacaaaaaaataagaaaaaaaatcccaataccttcctatattaaggacctttaagtgaagctatagccctctaaaattcctatctgggtgccaaatctggaaagttcctacccctttattaggttagtcagttggtatttcctgagcaattatgtctcttttttaggtgccattgggaataaagaggtacaaagatagataagaattgattgtaacaagttgaagaaaaactgatcaaatgattaaaaactgtgttggacacatgatactgacattggggaaaggagaagaaaaaaataggctgggagtttgtttcaaatctactttgtgtcaggtacagttaggtatcttagtcatagatactattttatttgtaagcactggaggaatttagtgacaagggacagcattttggtctgggagtttctgttcccatcagttcgggtttagagttagagattttaaagacaaggtgggccatcttaggtcattctatttaaggaaaagtatgaactaatatacgtggtgtgtgagtcaggtaaagtggtctttagggaagattagtctaggggcagtgtgtgaaacattggaagtgagagagagcagaaacagggattttagagtgttgcagcagtccagatgaggttcagttgatggtgacaatgctaacagaaaggaaaggattcagaagatcattttggagaaatgctttcctcactcattgcataatgggatgaagaaggggaaagagtcaaagagaattctgagatttcacagctttgtaactataaacatggtgctgccatcttaagggacagggaaatagtgaatggaccctggtttgggtaaggagatgaggtgatgttttacattttttaatttgttgatttttgaggtgccagctgagaatccaagtgaagaggagctggggattgctgtggagctggtttgagggaaaactaagttgtagcaaagtataggatatatttggagggttaagaccgtggaatttgggatactagctgggaggctgttgcagcagactaggcatgagaagtaaaagaattagggctaaggtgataggaatggagagtaaggagtgaatctattaagtagtagtactgctccaaatgccttatctgctgttagttcatggagcatatcccagccactaggcgtatagactagctgacagtattagccaaatttgggaaactcaaaacttgctgcttggagctcccagtatagttcatgactgtttcttctcagagaagagggctttctgtctcttgatttcgtgacctgagctagacttcgactttgcagttctgcagcaccacttctggtatagcttttctggtatggcttctggtattttcttcttttctggtatagcttttattaataatttttttttttttttgagacagagtcttgctctgtcatccaggctggagtgcagtggcgcaatcttggctctctgcaacctccgcctcccgggttcaagcaattctctgcctcagcctcctgagtaggtgggtttacaggcgctcaccatcacacccagctaatctttgtatttttagtagagacagggtttttaccatcttggccaggctggtcttgaactcctgacctcgtgatccacccgccttcaccctcattaacagtttttacagaggactttaggacagccacactgaaataggatgcttcatcccatgctgaaaagagcatggtgaaagtggcaagtggcttgagacgctgcactgataagattgctgagatgaatcccttggctatggtggacagattcacagtagcaactgactgccagagggctgtcacacattgggaagatgtttttcctgttttactgagcagatcatctaagccccagtttatttcttccaactctttacatcaaaaaataggccttatatagttcctatataggcctttttggagtaggccccattcatcattccttcttttcatgtctctgtctactaccacctttaccctcattttgaaatacaagtcatgcctcttagctgcctgctacttgggtgtacattttcttttgtctcttgtgtcttttctttatgcattcgtagggttggtagagacattgggttagttttttcttctttccttttgcctgtttactttaaaaggcatttccttcttcaacagatatgggtttagagtgtccagtatgcaaagaagattacacagttgaagaggaagtccggcagttaccttgcaatcacttctttcacagcagttgtattgtgccgtggctagaactggtgagtacagcaagtcatggcttctttgggggatgattcagagtaaaggtatagttaacagttcctcgagatccaagtagatcagattttatcccataaatccctggcttactctgatactgttatttgtttggaacttttctgaccaagggttgcaaactatgttctacaggtcattgtgtcctgccacctgttattgtaaataaaattttattggaacacagctatgttcatttggttatagattgtggctacttttgtgctacgtcagcagagttgattagttgtaacagctgtggtgtggcctgcaaagcctaaaatacttattttctgtcccttatgtatttgttttgagacagagtctcactctgtcacccagactggagtgcagtggcgtgatctcagctcactgaaacctctacctcctggtttcaagtgattcttgtgtctcagtctccagagtagctaggattacaggcgtgcaccaccatgcccagccaatttttgtgtttttagtagagacagggtttcgccatgctgatctcaaactcctgacctcaggtgatccacctgcctcggcctcccaaagtattgggatcacaggtgtgagccactgcactcggccaattttcctgtccctttaaacaaaaagtttgctgacctctgctctagaccatattgggaagtaatgggcagttaccctcctgtcatagatcactcactgtttctggttcgttctgtttggtggtatgtattagctgttattaacttgctggcctagaattattcctgtcagttctgcttaaagttctgtttgggagatatcctggtatcacaccttagagccagtgcatgctctatgaggatgcattctctattgtttttctgttccatgtcataatttttgatgtgacaattctcagggttatttaagtgtacaatactcccagcttctcaggccaggatcttcacatagactaatatttttctgtttcagcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttttgttttttttttttgagatggagtctcgctctgtcgcctaggctggagtgcagtggcacgatcttggctcattgcaaactctgcctcctgagttcaagcgattctcctacctcagcctccagagtagctgggaccacaggcatttgttaccatgcccagctaattttttgtatatttagtagagatggggtttcaccgtgttagccaggatggtctcaatctcctgaccttgtgctccgcctgcctcagcctcccaaagtgctgggattacaggcgtgagccactgcgcctggcctcttattttaatttttaaagactacttcagttgatgcagtttcccaagaaacctacataacatatattgggagccttatgttgataggaatctgattcccattcctttttgggaatgagttgggcagcatacaggcacagaaagacagatgtttgagacctttgcttctgagattttaaaaaatgattaccgctgggcgcggtggctcacgcctgtaatcccagcactttgggaggccgaggcaggcggatcacaaggtcaagagatcaagaccagcctggccaacaaggtaaaaccttgtctctactaaaaatataaaattagctgggcctggtggtgcatgcctgtaatcccagctactcatgaggctgaggtgggagaatcgcttgaacccaggaggtggaggttgcggtgagccggatcataccaatgcactccagtctgggcaacaagagcgaaactccatctcaaaaaaaaaaaaaaaatccccaactcactgctttttttgtttgtttctgtcgcctaggctggagtgcagtggcacgatctcagctcaccacagcctcgacctcccaggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccatattacacctctgtagtgattgtttatttggggaatgagatctacttactgtgcgttgcccctgaaatgtagcttgagaatacacactggttttgaattggggaggaggatggaaggaaattagaggtgtattatgaatatttggccactacttagatggaggaaggctatgttgaacttgggacacattgcagttttcaagtacacaatatcagttgtctcagaaaaatcatgacagcctggacatatttgcttgtcagtgtctggagatgccaggacaggcagttgtagttttacgtacagatagagaaccaatgcctagagaactagaaaggatctgagtagctttaaaaagggtggaaacaaagtactggataggggtctgcctttttatacacagtatagcaaacagcatcagacaaagttacatgaagttttcttcactttttttgctctgatggatagaggatgtgagactcattttactgtttcccagacctgtcccacttaatggatctgttgtgtttcttcttataatggcaggcacctcagatgtccaggttaatttatgttgaggagttaggattcttcagggatttattattattattattattatttatttatttatttatttatttatttattttttgagatggaggcttgctctgtcgcctaggctggagtgcagtggcgcaatctcagctcactgcaacctccacctcctgggttccagcgattcttctgccttagcctcccaagcagctgggattacaggcacctgccaccatgcccagctaattttttatatgtttagtagagacaaggttttaccttgttggccaggctggtcttgaactctagacctcaggtgatctgccagtcgtggcctcccaaagtgctgggattacagacgggagccaccatgcccagcctgagatttattataaggaattggttcacacaataatggagtttgagaaatcccaagatctgcagtgggccagctagagatccaggagagctgatggtgtagttccagtctgaaggccagcttggataccctagaagagctgatgtttctgttccagttcagaggcaggaaaagactgaggtcttagttcaagcagtcaggcaggaggacttctcccttacttgttctattcagaccttcaactgattggatgagggccacttacattagggagggccatgtgctgtattcagtctactgactgaaatgttagtctcttccaaaaacaccctcacagacacacccagaatactgtatgaccaaatatctgggcatcatgtggcctagtcaagttgacacataagattaaccatcacaatgaggaaaaacagaaatgatacatgtatacagagtgctcctcatcccaattaagtttcaccaagttaataatgtgtctctatgagaagtggttcaccatgttggtcaggctgttttcaaactcctgacctcaggtgaccacccgcctcggcctcccaaagtgctgggattacaggtgtgagctagcactcccagccgacaggtgcttcttaaatgttttctttgagcaggaattggtccaggaattggttctcaagttagaaggaaaatttgaggggaagaacttgttttttctccaatcagtctctgattaaatagttattaggaaaaactccttgcttatgtctttgtattgcacatttttatatatgtatatatgtgtaaatagagatatttatatattcacagacaaacacgtgtatgcacatttcacaatggaggaagaagggatatggtgtgcactgaggtaaagtgagcagggatacagaagagagctggagcctcacagtctgattctctcattgtacataacctttagggtctttgtttccctgagttctctggtatggggcactgttggcttgggctggtaccctgttattctctgtgatgaagggattcactggaggtaaaaacgtaatcatttccaaaggttgagaataaatgactttgaggaaagggtgttcattatccgttgcttctatattataatcagttgaactacaatacggttatctattgattttttttaatttttctgacaaattattgacaccaaattgaataattcatgacctgcatgcttcagcttctttctccctggtttccaggtgctattccctcaagaaatgcaaattaaatatgtcggtcttaataaatcaggagggaagcatagtctgtgtctgttttaaatgacaacaacaacaaaacagctttggggtttaagaagtggaagacacatttttatttttttgagacacaatctcactctttcgcccaggctggagtgcagtggcgtgatctcaggtcactgcaacctcccgctcctgggttcaagcgattctcttgcctcagcctcccaagtagctgggattacaggcacgtgccaccatgcccagctaatttttgtatttttagtagagatggggttttgccatgttgcccaggctggtctcgaactcctgatgtcaagtgatcaccgacctcagcatcccaaagtgctgggattacaggcattagccaccacgcccaggtgagaagacagattttaagagaaggagcagggctggtatctgaataggtatttggatgttaggggaaaaccctttttggcctctgtggtagagcgatcggaaggtaaaagtgctgtttacaagaataatccattggagatctggggattggggacgacttataggatagagtcctcttgttgagaatttcccgaatgaatctcatgtaggttctgtcacagtaagatggaggaaaactttgatggggtaagtatcacaagtggctgtcctatagggggaaatcctagcctgcagtaatgtcagtgtctcagtattcagccagcgagccactgagctgctccaggggtttaaaatagaatgcatagaatacaatgtatacagctggtgatgctttccaggatcaaaatagagcccttgtctgatcccattgacattgtaaggtttcgatctctcatacctgccacagacaagtacattgtaggcattcaacttttaaggttttatacatgcaaactttatgttttcctgccacactacacttggtgtccacagaagtgtagtttgtatgttgcctcttcttcctctttcaaccagaacacttagatctgtgatcataggatgtaagcctgtgattctttactttttctaataagaaatacaattttcaagatccaaaaattattagattcttggctgggcattgtggctcatgcctgtaatctcagcattttggaaggctgaggcaggcagatcacttgaggtcaggagtttgagaccagcctgggcagcacaataaaacaccatgtctactaaaaatacaaaaattagccaggtgtggtggcatgcacctgtagtcccagctacttgggaggctgaggagggagaatcgtttgaaccaaggaggcagaggttgtagtgagccaagattgtgccactgcactccagggcaacagagagagaccctgtctcaaaacaaaaacccccaaattattagattcccttccaacaacttgatagccatattattagtatttttgattaaagaatacataacaaaaagctgctatgatttcagtaatgcttttaagttaatttattagtcacaccagaatctacatccaattgaaatatatacaaatatttgaaagatatttattcaggctgaagattatggtatatagattccttctgataacctcatggcctcacaggttcaaaacccgtgtttgtgaatcactcatacagattggggctaagatgcgtgtccagaaaaccacctattatgcatgaaaatttgtaggcttatttgaaggcaattgtatcaacacattttgaaagccaagacacaagtattttaagtttctgtttaaccaagtctcgagataagcagagtaaataaactctttagaagcaagactcagttggtatgtacaaagtgggattgctttgtatatattccgcttagtttgagtcagagctagtaatctgatgctcttaaatgtcttcataaacttgggcagtgatgtttcctttctgtgattatgtgtcacagatttttatatgtggactataattagtatagtacaatggctgaaacttttcctatagttggatatatcttctgagacttccagtgattgtataatgttgagtagctccagaagattatttgaatagtaaaaacaaaagacatctctacctatgtgagtttattatttagttagaaacacagaactaactatttaaaacaggtagagaaagattaagatgaatgtgatgtagtggagaaagctttggagactttggagtcagaactcaaatggctctaggtcccaaatccagactctcattttgattctcagaacaattctgtggaaagagaagatacaataggcaatatccctttttacagataggtaaacagaaatagcatctcaaaacctcatttgcactgggtgaggtggctcacgcctgtaatcccagcactttgggaggctgaggcgggtggatcacttgaggtcaggagtttgagaccagcctggccaacatggtgaaaccccgtctctaccaaaaacacaaaaattagccaggcatggtggtgcatgcctgtaatcccagctacttgggagactgaggcaggagaattgcttgaacccgggaggtggaggttgcagtgagctgagatcatgccactgcactccagcctgggcaacagagtgagactccgtctcaaaaaaaaaaaaaaaaattcatttgcccaatgacaaatagctggtatgttgcagagccagaatttgaatccaggtctttttgcctccatggctagtccttttatctccatgggatacagtctaaaatccttagtttgaggttcaagactatcactaataagagtcttactcatctacttcagccatatctctttccgttcccacaaaccttagctcccacatttggcaggtccttgccaaggagcacaggtaaagtgtctctttccttttaatggctcaccatggagctgtagctaaatttctgtgctcttacccctttattcatgtagttcctcctatcaggaatatcctgcccactctctgcttaactatgacaagaggtcatctgtccaaagagaaagaagagagtttgtggatttaggagaaaagaaaatactccaaatactgctatgggcatttatttaaaaagagaaatgaccaaagaggttaacaagtatttagatgaagctgggcagttgtagtctgtggtgctcttggtctgcacaaatcttcctcttcctccagcagtgctgtatggatgttgttgaatgttgaggtctgtctgcattttctcattttcatgccaagtcaatcactggatctggctgtcttcctttctgtcctacctatctttgcttgttttctctctctttcctttgcagtgttaaataaaaatttattcccccaaaatttggtgttctcattttgtttgacttattttactatgttgatgaagagggaggaaaagtttttctggggtacaaaaacgcatatatttatccgatatttgaggactatactacccactttggtgaaagctgttctgtttatttactggagcttaggagggaagaaggcaagtttgccctgatggtgaggagcaaagtcaaggattacactgatttgccccagcttatatttccacagattcttggtatatttagcatctcttcccctgtgccctgttgcattcttctctgtgcctattgtaatgagaaagatactaagccatagtcagactcatcttgctgtagctgttttaaaagtttcttttggcacaaggcttacaaagctgtggaaagaaagtttgtattactgccttataacttagaatagcaacaaaatacctgatataatgaagtctcacctgtcctgagatgcgtgcgtgataggccctcatgactgtaaagggattggaaaaggaaagtgggaactattttatgtattgcatcttattactaaattagggttgtaatcttgagcaaatctgattctggtgggagtgggaagggggctagcctttgatcgctccttgctggaaggaacaatcaaagaagcaatagatgccactcaaaaagttgaaggtaggttttccacgtatagctctgaattgttggcacagtggtaagacaaggatattcactgaaactagttcatgagctgagagaggcacagaggtccaggaaactccctcctccttttccccacatgtaagcatgataacttgacctatgtggtgtttctggacctgaaaaagcatgtgtactattctactgaatactacctctttcaataattctactaagccttgagttggggaagaaggataaagaaaagaaagcttctaagtagtgtatattttctcgtttaatcaaatattgagctttggttttttcctttggttaactttaaagctacttgaattgaatataggagaaaacaaaaaattggattcaaaagctcattctcttcacctgagtggaaaaggaaaaaaaggccagagatgattttttttttttttttttttgctctaggatgacttgggaatcaaagatagtaactagtagtaggttgtatggctagactcaatttcccctttataatttttattctaaaataaaatttattttactggttacagtggcctaaccaagggaatttaaagtcaacaaaaaattatgtctaaaggtcagactgtttcatattcatgtttcctcctgaaaactggcataggcttaaatttggaagatccttaccaaggattacagataaggtctctgttttctttttgaaatctctgttttcttttgatgacttgcaaataagggactggaatagggaatgtttaggtggtcctgtttctggaaaggggaggagtcaatctcagaatgaatggggtggtgaaggatgtaagaggtgctttgcatatagtagatcattactgagtgtaaggttttagagtgagaaggatctgtattaattgctgtgacaggcaacaattaactctttttttttttttttttcctttgagaaagtgtctcaccctgtcacccaggctggagtacagtggcatgatcatggctcactgcaacctcaaccagcctgggctcaggtgatcctcatgccttagcttgggactacagttgtgtgccaccatgcctaatttttgtatttttttgtatagttggggttttgccatgttgcccagactggcctcaaactcctaggctcaaaggatctgcctgccttggcctcccaaagtgctgggattacaggcgtgagccaccgcaccaggccctatttaacttccttgtgtctgtttcctgatgagtaaccaggggatgtttgcttgcaagggttgtataaggttagaatcatcatgtgtaaagcatctgattcatcatacaggttttttaacaaatttattaagagcctgccatatgtgtgggacttttcgttggggtaaagaagacaaagtccttacatatatatagagcttacattctgatgccattcaaaacagtggtagttattgatttgaggaatgcctaaataaaatggagttaagaatgccaaggccaggcaaaaacctgaatcagttgcttgttatgcaaaaacgttatgacaaattattggaagtttcactttttgttatctaatagggaaaacgctaatctatattggtaaatggttttcagaggactcagctacatgtgtttaatatactcaatctggccatcagcctttgctgaggagccgcattgttcaaaacccatctccaaaccaagtctgtctcttgccttttcttcctctaatagctgaaaatctgttgcttcaacttgtagccctctgttcatgcagtgagtagaggtagttgtactaacttgcctctctcacaggccttcattcctaatgagtcttacctcctacccattgaaaagtctgatttatctgtcttcctccttagtgcctttggatcagtgaaactggtttgaactttcctgtggatagccagggcttgagtaacatttttctctccccctggacatcctttccaaccttctcctcctggagaataaccaaggtggcagaaatataatagcaccctcattgcttggggtgcttacggctcttttggacataccttgaagggccacaaggctggtgaccagcattacccagaccttttcttgtaggaagcctgaactgagagtgccttcattatggctgaactcaaggtgttgtctttgtttcaatcccgtcactgtgtagttccctgtctctggttcaaaagagaatcatggatcaggggagggtttcagaaatcatcagtatctccttttgcatcatctcataacatctcttttatgatctccaaggattcctccctctgtaattcgttgcccaaataagtatttttaacattgtgggtaatgatgatgtacttaggcagccataaataagtatagaatctcctgtgtgtcagacactagggatgcagatagatcttaaagtaattctaaagttttgccacagagatagctgaaacagcttagtcgccttggacttgggtatccccaaatagccccattttctagagtggttcaagcaatctagcataagttaaaatcttgcccttttggaatagatctgggttttttttgtttgtttgtttgttttgtttttgtttttttgagacagggtcttgctctgtcatccaggctagagtacagtggcatgatcatgggtcactgcagcctcatgccccgagcccaatcgatcctcccacctcagcttccctagtagctgggactacaggcatgtgccaccacgcccagccaatttttgtattttttgtagagacaggttttcactgtgttgcccaggctggtctcgaactcctgggttcaagtgatgcacctgccttggcctccctaagtgctggggttacaggcatgagacactgcacctggactagatctggatttttatccatcatttactgttggatgaacataaattatcttcaagcttgagttatcacaggacaatagctcaaaagaccatggagattaaataatataatatcacttagcacaatgcctggcccacagtaagcactcagtaaatggcagacattgttttttattttattttattatttctttttttgagacagagtctggctctgtcgcccaggctcgagtgcagtggcgcaatctcggctcactgcaacctctgcttcccgggttcaagtgattctcctgcctcagcctcccaagtagctgggattacaggtgcgtgctaccacactcggctattttttgtatttttagtagagacagggtttcaccatgttggccaggcttgtctcgaactcctgatctcaaatgatctgccagcctcagcctcctgaagtgctgggattacaggcgtgagccaccacccaccctgacattgtttattacctgtctcttcttaactagttttaccttccaaaatgcacctaatttccacacttggggaaccatctagatgtgctgactctaatacttaaatatgctgagaagatgagaaaagcattcttccttagggagaatcttcacaactaaaacaatatattaggagaacaggatttaggttataaggagcaaggactgtgttatacctcattctgttctccaaggcatagcgctgggcctgggatgcacaatacatatttgttagatgaatgaaagaggagtatccactagtgcagtttaactgaagcaatgtattcacataaatagaatgaaatgctatagagtctctagtgccaggctaatgtaatttagactttattccatagacagtgagaagccattaaaactttgagtgatgtggcatgtacaaattagcattttggaaagacaagctggtggtagtatgtagaatggattggaggcagaaacagtatttagagttgctggaccattaggcaacagctcagtgctaggccctgtggtaggtgtgggagatacaaaggtgactagggcacagttgctgaactcaagggactcactagttaggagactataggaatatgttaagtgtgaggtgatgaagacctgaaaaacacctttggaaggaaaggaataacaaagtactgctattcttccccactaagtactgctgtgcggaagaacagcagtacttagtaactctctgaattgggggttaagaaaaaaggaggaaccaaagttgactccgtcatgaacagaaatagggtctcaggaggatagctttgatactgagtttgaggaaatggtgggacatccaggagctaggagtacagtttttagtttaaacgtttaattaaaacttaggaaaggtgttcaagctggagaagttgatttgctggtcagttgcagggagatgctggtttaaatcgtgggtagatgagaactagggagagagagtaaagagaaaaggttgaaggggtgagaagtgagtcttggggaatactcatgtttgagaggtgggaggaggaaatagagaagacaaaagaacagccaggtgggtagaacagccaggggagtacagtcacagaagccactggagatgacagtttgatgaaggagggaatagtcagaagtgctgaatgctatagctaggtcagacaggaagacaccaggaagcaaggaacaaagtcagtcaaactaaacaagttgaaaatttgaattaactaggaaccataggaggtgattagaaacatttgttcaaaggctctgggccagtttttcatggggggagggtggtgagtgggtaatttatacttgtttttcttaaaaagtaagataggccaggcacggtggctcacacctgtaatcccagcactttggctaggctgaggcggatagatcacctgaggtcaggagtttgagaccagcctggccgtcatggcaaaaccccgtctcaactaaaaatacaaaaaaaattagttggatgggtggtggcgtgtgcctgtagtcccagctatttgggcggctgaggcaggagaatcacttgaaccttggaggtggaggttgcagtgagcagagatcacgccactgctctccagcccggaccacagagtgagagtctgtctcaaaaaatcaaagaaaaagaaaaaaaaaagtaagatagttgtaagttcatggagaagtaagatagttgtaaaagttcatagagaataatagcagtgcccttttgtcctcctaggcttattgtctgagacaaccactgtcaactcttcgagatgtcttattatattcctaaataatatgctcatattgctgcttcctagtgataaaatttagacattttctattggctttctgctacagtagatgaagatgtgctagaatatagtagatgaggattatactttcacccattttccttctctgcattcttctaaaaataattgtaccacaaattttatttaaattagtcatgtttacataatttggattctgtgttattttttgcaaaatcaagttgtgcgctatgtttcttttgtaaaatttagttttttctagagcctgattttatttttttactggcagagttttccatatccatttctttaatctttttattgggtctttaatgggcctttagaaagatgatatgtcgattccatttttacctcctagagatctcccttccagagtcgtctttctcttgctctcttctggactaactgcccttttttaattctagaatttccttttttttttcttttccactagagatggtgtctccctgtgttgcccaggcttatctctaactcctgggctcaagtgatcctcccaccttggcctccaaaagtgctggcatgagccactgtgtccagcctagaacttccttgttagactccttgtttcctgtatgtcattttatcccctttatggattcactttcttgttttactgaagcacatcctctggtagcttctttgaaaagatcacatggaaggcaaatttttttgagtcattgcatctcatgatagtgtcttttttctttccttacatttggtttatagtttggctgaatatataattctaggtaaattttttttttcccacagaattttgaaggcttgctctattgtctaggaatatagttacacagagagacactttctgttgggcacaatttgacttaaggaagccacttaaagctggggctggagtggccatatttaggatatgccaaagtagtaatggagcagggggagcatgcatagagtgaaagacagatgcagaagccagaggccttgctgcttcacagtttgaaacggtaactgttttgcgtcctgtcccctttctagtttctgattccaggagctagaactcatgagggccagctgtacttttttattttttcctcctttaatctatggtactttgaattggtttctgtttcctccaactaaatgctccttaagacagacacccatattatctcaaacctaatctcgttgtctgcctgaatttagaaatatagccacatttctgggagagttctgaattgggaatcaggaggcctaatttctttcttttcttttcttgttttttatttttttgagacacagtttcgctctagttgcccaagatagagtgcaatggcacaatctcggctcactgcaacctccgcctcccaggttcaagcgattctcttgccttagcctcctgagtagctgggattacaggcatgcgccaccacacccggctaattttgtatttttagtagagacagggtttctccatgttggctaggctgatctttaactcctgacctcgggtgatctgcctacctcagcctcccaaaatgctgggattacaggcatgagccaccatgcctggccaggaagcctaatttctatctgtttttactttcaccagtgagtagcactggacaagtctcttcaacccctgtgtcaccatctccctgtcagtaaaaatgcaatggccaccccaagtaagagttctaaaattaaagacaaaatgagattatgtttgtgtgtgcgctttgaagaaaggcagcatctgccaatggggatgttggaaaaggattgaggaagaaggaaactgcctttccaggacctgaactatctggttacatctccactgtcaaccctgctcactgtcccacctggtggcattaggagtatttgagcactcacctgtgaatagaatggagaaaaaatggccctgaaggcggatacctgacttctggcttctggcacaacactggtaggtcccactgtgcaacggtgtgacttggcttatggtgaacatcaactgagatgatatttcaccaacaccatctatcccaggatcccttttaagtctcagctgttttaaactggtctcaggagaacagtctccagacctgtccttgcacaaaaacactacaaacccctcagcctcttctttcttatgccatacagtacagattaagtttagtcgcgttccttcctgggaagctgagctggtgatgttaatgcatcctggaatggaaagggaagaattacccagaggtcaggtagcattctgtgaatttcaccgtaactgctccttatcactagaagtcttcaaggaaggactgaagcagaacctggcagtagtgctggcagacaggaaatacaaattccagctctatcgatggctgtgtgactgtaagcaagttacctaactccttgggcagtagtttattcatctggaaaatgaaaattaagggactaaataatatgctcaaagcatccattaattcataggtttatttgttcctccacttaacaaatatgtttaggtattcactctgccaagccctgctggggctgtgaggactaggacgtgagccctactgtcagaacttttttttcccctaaccattagatgaccggggatttttaatttaaaaaatttttttttaaaacaaggtcttgctgtgtcacccaggctggagggcagtggcacaatcgtaactcactgcacctttgaactcctgggctcaagcaatcctcctgcttccgccttccgaatagctaacactacaggtatgcaccactatgcctggctaattttttattttgtagagacagattctcactatgttgtccaggctagtcttgaactctaggcatcaagcaaccctcctgcctctgcctcccaaactgctgggattacaggcatgaaccactgtgcctggccactctcagagtttaaagcctaatgtaaaaacaaattagcaaaaagttacaatttaattccacagttattataattgaggaatcttagagattcctgagtctgaagcatcagggaaacttcacagtgaagttagtgctggagctgacttgaaggatgagtaaaagtttttctaagaaatataggatgagagagaccacagaaataccagagatgattaaaaacagccactgtgtggaaatggagtgagaatggactggagaaacagactaattattgagggaccattgatatccaaagaccatgactctgatggtgccagtctgcccacttgattttccctgtaagtaatctgtaacctggatacagaagtggagaaaatagttgggttaacccaggatgttttggctcgatgggtgtctctgacctaattttgcaatgcattggccctgccaactttgtactgcccctcactctcctcaaacttcacttccttctgtagtttatattttgtagtccattattaataatctctcccttatatccaccctcagctcccttagctttactcctactgtgatggatcctcgcaaaaccccaacctcggttaaatccagctctctgctgaaaactcatccggcagatgctgaggctgccagccccctcccccactcccttggcagcttgatccgctatgacttgcttttccttttaagactccccttggtatacatagtaaactaaattcactctcatgaaaacggtgaagaggcagagatggaggctgccccctgcatattgaatgccattctcctacaagagtaagagatatgggtcttccaagacccatatctgagggagacctgcaatcccagccattgattaactccaaaatggtttatattttatttctactttccagctggaacttctatagggtctctgttagagtgcttttctgtatatcaaatcctcagtatagccatagagggcaggtattactcttcccattttataaatacacaaattgaggcacagagtggttaaactagctgctgaagttaatgaagattgcagtatctggatctcaaacctggatttcataaatttatagtatataagagcctaaaggaatcttaggttgaggcgcagattgccaggctctttgaaacatatagcagagacagagtgtctgatagagaggcaatagtatcagttctaatgaaaaagaaaaagacaatatattcttcaccctttccttaatgtcaaggagagtgagtcagccgggcgcctgaggatcacctgaggtcaggcagagttcgaggccagcctgaccaatatggtgaaaccccgtctctactaaaaatacaaaaattagccggcggtggcggcataagcctgtagtcccagctactcgggaagctgagccagcagaattgcttgaacatgggaggcggaggttgcagtgagccgagatcgcgccactgcactccagcctgggtgacagagcgagactccctcaaaaaaaaaaaaaaaaaaaagagtcctttgtttccccactagagaaaatcacgggatccagcccttcccacaagcccaggatcctccccatggccgtctctgctctagggtctatcctcaccaccagactggatgtccacaattgccagcaggatggccagggcacagcagcctctgccgggttccaacagcatcctgcacgctgtcagcaggcccaggaacttgaagcaaatgttggctctgctggtatccttggcttcagtctcctaaaagcacagggggacccactagacaaagccttccagggttccaagaccatttccccatcccaggctctagctttgattggctagagtatgatggaggtagaggagggcttgggcatgagagtccagctggctgggaagtgaggcggtaaaccaagtgagatacactgggagccggggagggaggggcatagggagacactaaaggctattttctcatatatatatttttaagttaaattggattgctgcgtcaaagaatatgatgattaaaactttttttctactataatcagattgctctccaaaaaggctgttgataatcagatgttcaccaagaatgcttgatagtgtacatttcctcgtgcccttgctagctctgggtattatctgtactttaacatttttgccaatctgatggatgaaaaattagacctgctttatgttgcatttccatgattagtgaagttgaggatcttttcatatgcttattggtcattagtattcccttgtctgtgaattgtgtgttcatattcttcacatttcttaacttttaggcactttctccgtattagagatattaacccatctgccatttttttaggcaaatactttctcccaatttgttgtttgtctcttcactttttttatgaggcttttttttcacaaggaaagtttacattgtatgtaattaaatacaacatatctatcttttcctttaagttgtctgggtttcctgcattgtttaggaaagtttccctccaattgaggctataattttctttcaatatttttattgttttactttttatagttacatcttctaatcctggctaagaaaaattactcctgtttcaaaataaacaaactgaagaaaaacaaacacttgaatttcatcaatagggaaatggtttaataagtttcaattaatctatgtgacaaaatattatatattattaaaagaatgagatacttctataaatatgggcctggagggatgttcatgatatagcattaggtcaaaaagggcaaattgcaattatgtatataaaataaatacatttttattttaaaaaatcctctctatgtgtgtatgtgttttaaaaatatatttaaggttttgtagtttataacttttgaagtggtaattacattcacagcatttaaaattcaaaaggggaaaacaagaatttttctataaatttatttttctgatttttataatcagcttgtctagtcttgcccttcctactgtgtgtaccatcaagaaaaagtcctattggtattttaaaattgggatatgttcaatttatattttaacttagggagaactgaatttgttgtgacattgattcttttgatccgagaatgtgatattcatttttcaaatatgtgtgtctcaggtatgtatagaagttttcttcataaagtcctcgtccatttcttagctaagtttgtttcttgagtaattcatattttttcactattgaaaatgtcatcttttacccattatatcttttttttaatatactttaagttctagggtacatgtgcacaatgtgcaggtttgttacatagttgtacatgtttcatgttggtttgctgcacccatcaacttgtcatttacattaggtatttctcctaatgctatccctcccccgggcccccacccgtggaacgtcatcggtgtgtgatgttccccaccctgggttcatgtgttctcattgttcaactcctacttatgagcgagaacatgcagtgtttggtttcctgtccttgtgacagtttgcttagaatgatggtttccagcttcatctatgtccctgcaaaggacatgaactcatccttttttatggctgcatagtattccatggtgtatatgtgccacattttcttaatccagtctatcattgatggacatttgggttggttcccaggctttgctattgtgaatagtaccacaataaacatacttgtgcatctttatcgtagaatgatttataatcctttgggtatatgcccagtaatgagattgctgggtcaaatggtatttctagttctagatccttgaggaatccccacactgtcttccacagtggttgaactaatttacactcccatcaacagtgtaaaagcattcctatttctccacatcttctccagcatctgttgtttccactcgttgtatcttttaacttattttttcagtctctttatatcattcattatatcttttaatttttcattattgttcatatatgaaaggctatttgttttactagatattaatttcatacccagctcccctcccttaattctatcatttttcagttgattctcttggattttccagttatgcaatcatattatgtgtacataatgataattacttccttttctattttatatctctgatttctttcttctaattgtgttggttaatatctccagaaaaatattaaataataatggtaataatgaatctctgtcttttttctaagtttaatgggggatgcttaaatgtttccttattaagtattatagtagctttgagaatgagatgtattttattatgttaaggaatatacatttatttctattttattaagagttttaaaatgtcaaggatggatgtgaatgttttattaattgcctttaaatatcaactaaaatgatattatttttctttaagatatattaagatggcgatctacattaatagatttcctaaaattgatacatctttgcagtcccagacaaacaaacaaaaactgaagccatttggtcatagtatgttgttattttcttttgagacagagtctcactctgtcgcccaggctggagtgcagtggcacgatcttggcttactgcaacttccacctcctgggttcaagcgattctcctgcctcagcctgccgagtatctgggattacaggcgcctgccgagtatctgggattacaggcgcctgccactgcgctcggctaatttttgtatttttagtagagacggggtttcaccatcttggccagggtgatcttgaactcctaaccttgtgatccacccaccttggcctcccaaagtgctgggattacaggcgtgaaccaccacgcccggcctagtatgttattcttttcatgtgctgctgtattctgttttataatattttatttaaatttttaaaaattgaaaggcccagttgcggtggctcacgcctgtaatcccaagcctttgggaggccgaggtgggaggatcacttgagcccaggagtttgagaccagcctgggcagcaaagtgagaccatgtctttacaaaaaatacaaaaattagccacgtgtggtggtgcgtacctgaagtcccagctactcaagagacttaggtgggaggagcccgggagttcacggatgtagtgaggtatgatcttcactgcactctggcctggttgacagtgagaccctgtctcaagaaaaccaaaatcaaaaattacacacacacacaaattaaccaatcatacaagatattaaaaatataatacaccatgacaaatggaataaggtttcatttttagaaattcttggatgatttaatattaggaaatctattaattaacatactactggataaaaaagaaagtcaatattaccttctgataacatcttacattaattcccactaaaatcctaagtaaaatggtaatggatgaatactattcaatataatggagaaatgtatatctcagataaaattgcagcatcatatttaatggtaaaatatgggataatttctattaatattaggagcaaggcagagatgcttcctattatttctgttatttcacattgttctgaaagtgtttgccattatatttagacaagaaaataaagcaaagggtataaatattggaaatcttaaggcaaatttattactatttatatgtgatataacttacatctagaaaacccaagaaacttaattgagaattattagaaacaataaaagagtatctgaataggcagttcacaaaagacgaaatgcaataaaaagtttttcagttttacaagtattcagggaagtacaaattaaaaattcagagttcagaatttcagaattaccacctgttaagtgaacaaaaatttaaaagataaatcaaattttggtaagggtaagaagaaatatgtgcaatcattcactctaggtagaactatacattgttacggagctttgggggaatactcattatatattaacatttcaaatgcacataccctgtccctttggctatagcttacagaaataaaagcatgagtgtgctagtatagatgtacaaggatattcactgcagcattttttataataccaaaaaaatagaaacaggtgaaggccaggtgtggtggctcacacctgtaatcccagcactttgggaggcgtgcggatcacctgaggtcaggagttcgagaccagcctggcccacatggtgaaaccctggctctactaaaaatgcaaaaattagctgggtgttgtagcaggtgcctgtgatcccacctactcaggaggctgaggcaggataattgcttgaacctgggaggcagagattgcagtgagccaagatcacgccactgcactccagcctgggcaacagagcaaaactttgtcgccttcctgcccccataaaaaaaggaaacaggtgaagacccactggtgagaatggttgaataaattattgcagatccacagaatagaatgttatgtaattatagtttgtataaaacaataaactaaattagtgtatatacatacaatttaataaggtacttattaatacataagattaaaaattttcctggatctaattattagtcagaaaatatggtagaaggaaaagttccattcattatagcaaccaaaaaacccatcaaatgtccagaaaaatgtaacaacattccgaataggacctataggatacaaactatacagtactattaaggaacataaaagaaaatctaagtagagacgattgttaaattcttctgtacttatctatacatttgtcacaatcctaataaaacatcccagcagcagctcatggtatggccccaatgtcctttcctagccttgacctctccttgttccttctcctgtgttatcataccttcatgctacaccagaatgtcctggtgactcttgaaacatggaatattaagtgacaaagaggataaatgaataaaatgacaaatcattttattcaaagaggaagacaaagaaggattgcaattattcattcagcccagaattatggttaaaaagcgtagactctagagccagagtgtttgtgttcaaatcctggtcctaaaacttaatagtggcgccgggcgcggtgtctcacgcctgtaatcccagcactttgggaggccgaggtgggcagatcacgaggtcaggagatcgagaccatcctggctaacacggtgaaaccccatctctactaaaaaaaatacaaaaaattagccgggcgtggtggcgggcgcctgtagtcccagctactcgggaggctgaggcaggagaatggcgtgagcccgagaggcggagcttgcagtgagctgagatcgcgctactgcactccagcctgggcgacagagcaagattctgtctcgaaaaaacaaaaataaaaacaaaaaaaacttaatagttgcatgactcggtcaagtttcttaggctcctgggccaggcgctatgctcagcctttaataaatagacatatttcagaaacacggagcatctataatgtgtcagacaccatggggcacagagagatcactaacacagcagaggcggacgttttagtggttaaatggtctctagagtcagaccaggatgtttcagatctggctttgaaacttaactatctgtgtaatattgggcaagtttcttaatctcttaatgacctataaaatggtgacaaaatattctcttccttgggttgtgagggtcaaatgaggtcacctatgtaaattacttagcacagtgcctggcagagagtaagggctcaataaatgatagctatgattagttttatgctttcttatattggaatcaatggacagtgttccaggcacatctacctgcaagactgtgtttagtccttataaaacactaagccattattattttctaaaatttattatttgtacgaagcatatagaggcttggaggggacttgtgacttgcttaaaatcacagctcctaagttggggagcaggactctaacccaagttatgagagtctttctcttggagtcccctttgtccctctcctcacagccgctcatccattcacgaacagctgttaacacaagaacgactgtactaagtaataaggtcataaagtgtcaaggggcagcacaggagaaattctggatgagggatgtggaaaggctgcaagatggcaatgaagttaggccttcatagttgtttgtgggctctggggagctggtgactaaagaatacggtgggtgaattaaggtggggaatgggctgaggagatctggcttccagtcctggctccgcactaggtagctgtggaatgttgacaaggtcgtgtcccttctctaggcgtgtttcctaagggactggtgcagcgggatgggaggggcgcagggtagggaccgcttccaaggagagagaggacaggcgggaggggctgatgcagctggtcactccgctggagtggccagacttcgcggtgcctagggccgagttgaagaagagcatgtaagtctgttgtgggcccctcaccagcgctggggggcagcgaggtcactgggcaaggatgctctgggaagtgaccttggtgcccgggaggggagcaccctgttgtgatgcaggcggggcagcgcggagccggcggcgctgatttcgcactctggccgctagagggcgctgcctttcagccaaagccgagtgaccccctacctgccccgcgttggcccgcgtcactccagccatgggccatccagcgagcatgggggctagccagggaaagtctaaactaggaggggagatgagggggtgcaaagttgggcctggtgggtcctggggacgcagcatgtactagagcggcacctggccctcaacagaggggagagcgggtggtcgtgagaagtctgggaattttccgggcccactacacgccaggggcgggtctcccctcttaaaacgttgtgagccccagcgcgggcaggggggagggtgcccgtggagttggcatcctcatctttgatggtccccggggctcctgagctgcgctggtggccccagggctcggtgcctctctcaggcgacagctcacagacggcgggaaactcttccctcccgcaccttcggaggcggtcctggagtcttgtggactcctgggttcaaatccaagctttgtgtgaccagcacattgctggacctcactcagcctcacattcctcttgtgtttaaaactacctcataggaatgtggtgacggttagatgacacataaagctttgccagaggttttctggggagggtggggacaagagggcaaggaagagtctccatttcctctgccaccggagcccggatctaacctctcagaggagctggaaggtcagctctgagctccacaaatacctctgtatacagatctcccacgacactgaaaaagatgcccagaaagatctcatttgcagctgtgaaggggcttctttttcaatctccacaaccccaactgccttaaagtagaaccagacttgttagtagacagaggtttgggctggggggcccttgaagctcttgtctgagatctcaggcttcctgctcaacacaccaaagcaggtgcctgacataaaggcgccatggacctctttggtggtctgggaaggcatatggagtcccttctcagaacaacatttaaaaattaataagatacatgggataataaagggaacaaattatgacaagacagttgtcaaaacattagaagaatgtgtggtagagcagtacacatgcttctttagatttgacatcagcctaataactgttgtaattctgtagtagtgctgagcgttaaggacatttggagaaatctataaaaactgtaatgagatttgaaaatatttgtgttttctattgatggcaaattctattgtggttcattgtctacattcataactgaagcaagtgctgactttcaattaaagattagtgaaaataaagatgtatttttccccccaattcacaaatcccatgaataaatctattcacggacctccaagaggtccatgacgtgaaccacctaggacatgaacttcccccggaggtgcctcacagggccagctccaagccccgtggcacctcccggcttgtctcaggccaatccttgaagagctccagcagatctaaactttggtaactttcctctggtaatttgaggaattcctccatttgaggaatgtcagaatggggccaggattcctgaatgcccatggaagaaaagcgagcatgctggtctggcgggcagaaataaccttctccccaggctccagagggcagaggacatttccctccaaaaggcaagtttctcagggacctcatgagaagcctgtcctcacctgagcagttctgtcaaccatcccatcccttcacctggaccccaggtccccagcaggcctttttacctcgagacagaagttcttctttcttgttctcagactgggggctcacgttgaaatggctctcagtcctcagattgtccttgcatcttgttaaaaccctatctctccagtttcgtcattgctcacactttcatagctgttattatattcgctctttgaaaaccacagaatgggttgttagaagtcatagatcttccgccacccccactgtggatttttttctcctttctctcctgcaactggtcctccatctccttctcctttcctctcccttgttttgtctttttggtgttagaaatagactagggtgctgagggggctaagaaaaaccacttcttaaaattcttttctttaccctggggaacaaagattttgtatttgctaattcataataaggaaaggactgatgatagaataactagaagataaaaggacagaatgtcctctcaagtataaagaaaggtaccaagtcttctcctgagagtaggttttggttagaagtaggacagagaacacagctgctccaggctgaaagggaagaaggtcagggagctgtcaagaaggcttgggtgagggtggtggtgagcaggggaggcaacgagtgggggcaccaaaatggtcctgatgtggtggggggaggatgaatgactgaccttatcttcccacccacccattttttttctttttcttttttctttctttccttttttttttttttttttttgagacagggtcttgctctgtcaccaaggctggagtgcagtggggcaatcatggctcactgcaaccttgacctcctggggtcgagtgatcttcccacctcagcccctcaagcagctaggaccacaggtgtacgccaccacacctggataactttttatttattatttatttatttatttatttatttagagatggagtttcgctgtgtcacacaggctggagtacagtggcgtgatctcagctcactgtaacctctgcctcctgggctcaagtgatgctcctgcctcaaccttctgagtagctgggattacgagagcctgccaccatgctggactaattcttgtatttttagtagagacagtttcatcatgttggccaggctggtctcaaactcctgacctcaagtgatctgcctgccttggcctcccaaagtgctgggattacaggcgtgagccaccacgctcggttgataatttaaaaaatgatttgtatggatgaggtctccctatgctgccccgcctgctctggaactcctgggctcaaacaatcctctggccttggcctcccaaagtgctgggattacaggcctgaaccaccactcccagcttcccatccatttctattctgttctgttcttccttggtcagtgatggcttgggagattacaattgttcctaaattctagggttgtgcccttagatggcaggaacattagtctgagaattagaagcattgggctctaagtcctgcaaggctgggccaggccctgtgccaaagggcacagcacaccaggaagccccacggttctggaggaacacctgtcatgattgccacccagtgccaggctacccaggaattcaagggtggagggagggtgggggaaaatttttcataactagtctagagactctcttttccttcttattcctgttattgtagtactctgtggtcctaaaaacagtagggtgctctggggtttgagaactcccagatggctccactgaagccatcgtcaaatgagacagatattagaaatatttcttcactccaagccaggcgcagtggctcacacctgtaatcccagcactttgggaggccgaggcaggtggatcacgaggtcaggagattgagaccatcctggctaacacagtgaaacctgtctctactaaaaatacaaaaattagtcgggcctggtggtgggtgcctgtagtcccagctactggggaggctgaggcaggagaatggtgtgaccccccgggaggcggagcttgcagtgaaccgtgattgcgccactgcactccagcctggatgccagagtgagactgtgtctctaaaaaaaaaaaaaaaagaaaaaagaaaagaaatacttcttcactccatcaaagtgttagctttcactgcagaatgagtccattctgggagcctgggggttgggaacccatgttgggaagaggagtgtctcaccatcatcctggtcacaggaccagtccaccacagcccacaggatactgggtcccactggcataaactgctaaactgggcctggtctctgctctcccagtatccttatttgctgtctctatgatagtgttcaaacagatgacctctctgctctctaaaatggagacttctccctccttgggtctatgagaacctttcaaaggttggctctgagagcactcagcattccttatcatccaggagctgtaaaacagtgattattagcaacatgaagagaagttaaaggcaaccagagttgtgggtgagtgaggttggggccacttaagtactagctgacacacatgtattcatactggttattgcaaaaaacctcaaagttctgcaaagacctcagggctcaaaagtgaatcgcagcgcgcttccttttcaccagccatgtagtgtctgtccatcctgcaaacggttgcatgcacagttttctgcaaatgttgcttttggtcgcttctcacaaggttattgtgtgccaggccctgcggggttgacgatgactgaatggggcctgctgtcaaggcgagcacactgctgagagaggcctgcattcccgtgagatgaagcagaagcagaatgcaccaagagctctaagtaccccagaagtgagagagaacccaggaagcaggggaggttgggaggaagaaaaggagactgccctgtgggcgcagacagtgttaggcactctgtgtggacaatgtgacatttaaattgagctttgaaagaaggcaggatttcaaaaggcaggggtagaggaacagtatgaaccagcaaggagcagggacatatggggctggtttggaagtcagtgaagcaatgaggtggctgaaatataggctgcctcctggtcatccacagcctcccaaatatgtatcctgtgggcctttcaatgtctaaggtgtatgagtccagttacacaatttagcaactgatagattgttttcaagatactaatagtaagtgctcgacattaagacaaagaaaaactgagtggacattgaattgtatttccatcttacttctgtagaattatggggttttggaagcagaagagactgcagcagtcttccagtccctggaagtgtgcagacacttgcatgccagtgtttcccaaacttgagcgtgtattaacatcaccagcagggcatctttgaacaattcggatggctgggcccagctgcagagtttctaattcagggactcagggcaggggtgggggtggtccaagaagttgtattcctaacaagttccctggtgctattgttgctgtaatgctccttgcgaactgttcagggtaatacctcttgcatcctctgcttgaatctgtctactgttctgcagctcactaccacccaaagtatccacacaatatcccttgtggaatacttccagtaaaattcttccttgtgctgctgtcagtcctgcctgcctttaactttcaatgaagtctgctgagggccccacatgggaaatgtctatggatggcaggcaagtctcaggcacatgaggcagactgcctggatttacgtcctgactccacttactacgtgaccttggataagtcattcaacctttctgtgttttcctcaactgtggaatggggataataattgcagttatatcacagaactgctgtttagagtaaatgagaaagtgtgtaaaacaattggcatggtgcttggcatataaaagtactcaggtgtgggctagtatcattacctagtgttctttttctttttcttttttcttttttttttttttttgagacagagtcccactctgttgctcaggctggagtgcagtggcacaatcttggctcactgcaacctctgtctcctgggttcaagtgattcttgtgcctcagcctcctgagcagctgggattgcagccaccgctcccacgcccagctaattttttgtattttttagtagagaaggggtttcaccatgttggtcaggctggtctcaaactcctgactttaggcgatccacctgcctcggcctcccaaagtgctgggattacaggcgtgagccaccgcgcctggccagcattacctagttttcctttctactcaggagtctatcaactctctgaagaaagttaatcattctaaagtttctcctttctgggctaaatatccccagctcctgcaattatttcttacaattattttagtgctttcacggttccaatattttgtttgtcctttctcctcttctctgaacagagtccagtttgtcagtctcccttgttagatacatggctcagacctgctacctgcctcggcttagtccaagtctcgtgtgttcactgcagccaaaggtcactttagctttgtagctatttctacatttcactggactgtgttagacttccaggccacgaaggtgccagaggctacacccgcatgtaaagagtagagctcattctcctgtcacatttccccttgttgcttagcatgtgtgagtttggggagtgtgggtgagggagagtaactctgaccttggcccagttcagggcctactgtgatggttggtgagcagccccagtggctgtgagggagcacatttgaggctccaggggctggtgcgaggcccagcttctcccctggagaagggtgaactgacacctagcacagccaacagttttctggaaggaaaccaagcctcagagccagaggcacatacagcaaagctgtgcaggcatctcagcccctgtcccagccactgtcactgctggcctttagcccagggtcgttggtaatagaataatgataaaatatggagagggagtcagggctgggtttttttggttttgctttttttttttttttttttgagacagagtctcgctttgtcacccaggctggagtgcagtggcacaatctcagctcactgcaacctctgcctcccgggttcaagcgattctcctgcctctgcctcctgagtagctgggacaacaggcgcgtgccaccatgcctggctaatttttgtatttttagcagagacggggttttgccatgttagccagtcttgtcttaaactcctgacctcaggtaatccacctgcctcggcctcccaaagtgctaggattacaggcacgagccaccacacctgacctcagggctgttttattgtggagacagaggtggcagcttcaggggtttgggtatcaagatgacagggcaggcctggaaaaaaatgtctctctcagcctctattctaatttccagtctgtagtgaatggctcaccaggtactctcaagttatgtcttttaaaacagaaggcatagaaaaatgtgcccaaattactttggtgtcctatagagcctgtcttgtccctctccggtcatagaggacaccaagttcctttgcggccaggcctcctcctaagggagaccaggcctgtggggctgctccgagagctgcctgcaagccacactatgtgaatcccagtgcagggctcctctgaaaggcacctgcgaagctgtctttggctgaagaagttggggaaactggtctcccacacttggcaatggccattctttctcaaccttccctcaggcacgaagagtcccaggtcttgatgcctcattcttccatcaaagatttaacatttaccctccctggtattttcaattgatccagaggaaatgaataggtagtacttagcaaagggtgcttagcaaaaaaatactctgctgagtggaattgcaggcacttctacagttgtctggaggcacagaggctgcactctaccctaaggcaaactggatggtgccatcctcatgctgacttgggctttagaggagaaaatgtactttcttcagtggataataaagacaatcattggtcaggtgtggtggctcatgcctgcaatcccagtactctgggaggttgaggtgggtggatcacttgaggtcaggagttcaaattcagcctggccaacatagtgaaaccctgtcgctactaaaaatacaaaaattagctaggcgtggtagagcacacttggaatcctggttgggaggctgaggcaggaggatcacttgaacccaggaggcagaggttgcagtgagctgagatcatgccactgcactccagcctgggtgacagaacgagactacatttccaaaaaaaaaaaaaaaagacaagcattgctttttccttggcaagaattctttctcttttttttttttttttttgaaacagagtttcgctctttcactctgttgcccaggctggagtgcagtggcgcaacctcggcttattgcaacctctgcctcctgggttcaagtgattctcctgcctcagcctcccaagtagctgggactacaggtgcccaccaccacgcccagcccattttttgtatttttagtagagacggggtttcaccatgttagccaggctggtctcgaactcctgacctcaagtgatccacctgcctcggcctcccacagtgcagggattacaggtgtgagccaccgcgcccagcatcctggcaagaattctaagcaacagagtaaacaggatgggcacaattagtttactttccaagctagaatgtcagggggcactggaaccattctggggaaggtaatactttgaggtggaatgtcttttttttttctgagacagagtctcgttctcttgcccaggctggagtgcaatggcatgatctcagcttattgcaacctccacctcccgggttcaagcaattcttctgcctcagcctcccaagtagctgggattacaggcacctgccaccacgcccggaagattttttttttttttttttttgtatctttagcagagacagcgttttgccattttggccaggttagtctcgatctcctgacctcaggtgatctacccaccttggcctcccaaagtgctgggattatagacatgagccaccgcgcctggcagggatgtcttttctttttttgagacagagtcttgctctgtcgcccaggctggaatgcagtggcgcaatctcagctcacagcaacctctgcctcccaggttcaagcgattcttctgcctcagcctccctagtagttgggattacaggcatgcaccatcatgcctggctaattttgtatttttagtagagacagggtttttccatgttggccaggctgatcttgaactcccgacctcaggtgatccgcccaccacggcctcccaaagtgctgggattacaggcgtgagccaccgtgcccggccgagggatgtcttttaaatcaagctacagacttgggccactaggctgttcatggttcctgattctttctcactgaccctttacctctgcatgggatggtccccagagggatgaggtcaggctgaggctgtagccttgatatacctgacactttccttgctcttctcctgttccccattctggacctttgggggcccttgagggtctggctttttaaggcagaatccaaactgcccaagaaccactgattgtttctgtatctctcagaaaggggcaaccaaatacccttttaaccaacactccaagagtgccaagaccagaccttggtacatgcaggaacccagaacatggcatgttcttgttctgtgcctttttcttatggtggaaaaggattgtgtattctgacccctcatctgggaaaaggaagaacgagtgaattactactcggatatccttggcagccagcttgcaagtgttaataattcatagctctccaaggatcctcaggcctcccctgtcctgacacttggttactgaaaagaactagaaagttccagtcagcagtcatgtggggccacagtgtgtgctgcagccaagtggcattgccccgtctccagcctgtcacccacactgctatagaacatttatctcagtcttgcatctggactctggcctaataaattcctccaaaggtatgcagagtacacagtcgcctcttaaggtgggatgaggccagagtaacagagagagtggaaagggagactgtcataaatattgactctagacagggagagaaaaccactggagcttaaaattccaggctcagagtaagttaatgagctactaaaaagacaaggtagtaggacatgcatactaggacaatcagacctgaagttggaggaaaaatgtgaggatacccactgagccaggcagactggtatagtagaaagggcattggccacaaaagcaaaagcacagagtttttagccatgtttctgcctgagggggctttggctaagtcacttcacctctctgagtctttgttttataataaagaaaaattgagatgatacaattcaataacaacaaaaacaacttgattttaaaaatgggcaagcaaattgaatagacatttatctaaagaagatacaaatggccagtaagcacgtgaaaagatgcccaacatcatgaatcattaaggaaatgcaaatcaaaaccacaatgagatgtcacctcaaacccattaaaatggccatcaattaaaaaacaaacaaacaaaaaacagaaaagaacaagtgttcatgggaatgtggtgaaattggaacctttctatgttgctggtgagaaagcaaaatggtgcagccaccgtggaaaacagtatggtgtatggtggttccttaaaaaattaaatgtatgatccagcaattccttttctgggcaaatacccaaaagatttgaaaacagggacttgaacaaatatttgtacatccattttcatggcagcattattgactgcagcctaaaggtggtagcaatccattccttgatggacgaataaataaaatgtgatgtatgtacacagtggaatattattcacccttcaaaaggaaggaaattctgacatgtgctacaacatgaatgaactttgaagacatttgctaagtgaaataagccagtcacaaaaggacaaatagcatatgattccacacatagaaggtgcttagagtagtcaaatttgtagaaacaaagtagaaaggtagttgccaggggctggggaggaaggaatagaaaatcgtgtttaacggctacacagtttcactttgggaagatgaaaaagttctggagatggatggtggtgatggttgcccaatagtgtgaaagtacttaatgccactgaattgtataatcaaaatgattaaaatgataatttttttgttatgaatattttaccacaatttaattttttttttttttgagacagggtctcgctctgtagcccaggctggcgtgcagtggcatgatcgtgactcactgcagccttgacctcacaggctcaatcaatcctcctgcctcagtctcctgagtagctgggactacaggtgcacaccaccacacccagctaatttttgtattttctgtagagatggggtttcaccatgttgcccaggctggtctcaaactcctggactcaagcattcctcccgcctcaacctcccaaagtgctgagattataggcatgagctaccgtgcccagccaatttttaaaaattggagagatcaaagcttcctgaccagattgctcaggtgtgccacatgtaggttattggcatgccaagatattgatccctttcatttttgaatagatcatgcagagctgagcacagctgaaatcctcaggcaggtcactggaagagcttcttcttactccagtatgctatacacatattgtaatgtttaaaatttcaatataatttaattattatttatacagaataagtgcatgaaacaaaaatgcatagctcggtaattaatcttaaacacctgtgtaaccttcacttagctcaagaactagaatattgccagcataccagaagttagggtcgtgtgttaccacctaagcaggaatcccccaaagttctgccctatatttggacatcatgtaaatggaatcctagtatgaaaatgaatgaactacagctactcacagcaacgtgagtgaacctcacaaacatcatattgaatgaaataaaccagagacaaaaggaatacaccaggcctgtaatcccagtactttgggaggccaaggcgggaggatcacttgaggtcaggagttcgagaccagcctggccaacatggtgaaaccctgtctctactgaaaatacaaaaaattagccaggcatggtggcgggcacttgtaatcccagccactcgggaggctgaggcaggagaatcacttgaactcaggaagcggatgttgcagtgagctgagattgcaccactgcatttcagcctgggctgtaacagagtgagactccatctcaaacaacaacaacaacaacagcaatttttaaaaatttctaaaaaccatacaataacaactatttatacatgatgaaggtgagacccagagagttaaaaatgaattactctggatcaaacacctgggaaatgggaaatggtggcgtcagaattgaactcaggtgttctttctttcttttttgttttgttgttttttttttggagacagggtctcgctctgtcattgaggctggagtgcagtggcatgatcacggctcactgcaacctctgcctctcaatcaagtgatcctcccacctcagcctccagagtagctgggactacaggcatgcaccaccatgcctggctttttgtaccttttgtagagacaaggttttgccatgtggcccaggctggtttcgaactcttgagctcaggcaatctgcccgctttggcctcacaaattgctgggattgcgatgaactcaggtgttctgatcctaaatccagattttcccattctaccttctgctttgaaagatatagaggaggccaggagggcttagccccgaggtggaggaagataagctggtatgaggaagctgctcaatgtcattttaaaccgtttatccatgggctcaggtcatgtctttgttgggggccaagccaaggcccagcaaagacaaatggctcttccagtgtgggtggaagaggggtgaggtcacccagtcctcagcctgtggtttgctttgcctcagtgccgggagcaatctcttgccctgatttgcattgtgggctgaggattcaggtcagtgagaaggccagtgatagaattgtctgtgtgggtgctgctgatagggatcagctgctgatcatggctagggctagcggctgagcacacgggcaccagcctactgctcgggcagcaaggcagcaggatggaggggtttgtaaaaatgccttccacctaccctgctgggcttgcccgagaggctctgagtgtgtgaaggggaagacaattatcgctaggctggagaatagaaagagcaccatcaggtgagaaagagaagaaaaaaagagaggggagagagtggataagaagaaggaagcctgggacacaagaacaagggctttgcttgctctagggctttgcttgctaaactcctagggagcacacaagtgagaatccagggcagagggaagcaggatgggtgccctgagtgcttggccccatttcctggggcttactggcctcgtgggtgggagttttataggctactgctccttggggaggcctcagtgattgaggatactcctgtatgagcctcggccctgaccccaggatgggggactggaggatcctaacaggattgggggttggttgggtgtaaccaaggtatctgccaaagggagagtaccaaggaaagcggaggcacctcctccctggctgtccttcaccccctctcccctccttgttctctgggagtggctggcgagcagcggcctccccgcagggccaggcaggtgggccagagcttttggtttgctgaggtttgtcagattttccagctcagggcccagccagctggcaggaagcaggacagaggtcacttgaattcagaccacatgtccctgttaaatacattagcttttaaatcaatctttgttcaaagtccagtgagttgcaagcctaatgctcacctgcagagacagaattcctgagtgaacgaacagagcagctcctcttccatctccaggtaagaactgctcgtgtcctccttgagggtgctggccaccggggcctgaactaccttctttcttttccttttccctttttctttttccaagccagtagctggctgtctagggcagagaagagtcccatggggaggcagccaggcccctttggcggtggttgggggtgagagatgatccacgctctgagattctttctgctggagatgcccctcacctttgtaggctagggtctgcttcacaaagaaattggtaaaccgacctcagaaaaagccttcccggggttgtgtgggggtttgatgtgcagccaaagggagtgagacaactgacttcacaggtaaccaggcggatatgcccgggaccttcctactgatacaggggccttgggtagcagagaagactcttctggaagcagcctttaaaggatgcagcctaacttagcttgcccactagataataaaagcaggcatctttcctctctgtatcacactgcagcactaagacatgagaaaaaccagtggatttccaggctggctgaattttaaaacatacattccccaggctctcacctttggcatttctaagtctccaggccttgtgtgaattgaaagatctttatttgaaaactctcccagaatcattctgatcagtgcaggtaggtttgggaaccactagtagtttatttcttaagcagaagactcatgagacttaagtatgacacttacctaagggttcactcgctatgaagactcctggtctgggttgggtccagctatgaagatttgggcgttggctctgagaaacacattcttctttatttactaaaatctctgcaatgtgtcaccagggcagctttcagtcttgtatctagaaggcaagagggggtagcagggactgcctcaggccatgattgtccagtcatctgaagtctgcagcaaattactcagggtctttgaatttctgtgttatgatagtaacttgtgcttatctttgacttttgtatgttctctgcaccatagggtgtgaagttgctggtaatgatgtcttatattcatagaccactggctaggcagctacttctcccccaggggaaagaacataggactggaatacaaatcatcagagttttgattcagttgctagtgacaggccattagacaaactacttagccaactggagcctcaatttcattattgatcaagtgaaggtctgtcatcttttccccaagagtgtactgaaaataaaattataagtacaaatgtgtggtcctgcatggtggctcatgcctgtaatcccagcactttgggatgcccaagcgggaggatcacttgaggccaggagttcgagaccagcctgggcaatgaagtgagacccccgtctctacaaaaaataataataaattaatcctgcatggtggcatgtgtctgtggtgtcagctacttgggaggctgaaatggaagggttgcttgagcccagggggtcgaggctacagtgagccgtgattgcatcactgcactccagcctgggtgacagactgagatcctgtctaaaaaacaaaaaaccatgaatatgttaaaaacacgatgtaagatgcctagatttcaaatgtgtatatcgaaagtctctgtagaatagtaagaagaaacaaattgcagtcacttgggaaaccttgtcctagtcttttaatctcattgagcctctgtttgctcacttacaaataagaagttgagaccagatcatcattaatgtctttttcagttggccaagtataaggtagatcctggagccttgaagggtagctccttgtcattggggtatgaattaaaatgtcacctcccaggaaggactttctaaatcagcctcccacctccatgccaccagtatctctatcattcacagcgtgtaccatcagaaatcatctcatttgggctgggtgcagtggctcacatctgtaatcccagcactttgggaggctgaggcaggtggatcacctgaggtcaggagttcaagaccagcttggccaacatggtgaaaccccatctctactaaaaatacaaaaattagccgggcgtggtactgcctgtctgtagtattagctacttgggaggctgaggcaggagaattgcttgaacctgggaggtggaggttgcagtgagccaagattgtgccattgcaccctagcctgggtgacaaagtgagactccatctcgagaaaaaaaaaatcatctcttttacttgtcacctttgccagatgttaagcttcaagactgcagggatcttgtcatttgtgttacttgctgtattaccagccccttgagcactacctggcatagaacatatttgcataaatggaattagtgtggcagggaaggagctagaagaatagatgcagatggcgatggctttgatgaagtgttcctcaggaaaggaggttgaaggactccaatcctctctcagggcatctgaagtccagggtctaatcatatgggaatgggtttctctggtcacttcttagtgaaatgattcttgcattcgttgcatagggatgcaatgagagtggcaagctggagctagacgtgttttcctcaagatctcagcaacttctttctttggtccttcatgagggactgcccagatttccttaatctctttgcctgatgggtatcatggctaagtgattaagaaaatgagcactgggattggaaacctgcactctagatcaggctctctaagcttctatttccttgtcagtcaaatgggcatattagaacctagttccggaagttatgagggttaaatgaatgcacatagtgtctagcacatcttaagtgctattgagataatcttcagacagctttgctattacatgacccccggaaatgaaggaacccagggaatggcaggagttttggaaagtagaaaagatagccctagcccacttagtggcaactagagaaggtttgcttttggtctgaggtggtcactggtttctgaggtgccaagcctggttggaggcacagatagtcagcattcataaagctgcgtagaaccatggggtcccaatggggacatgaaactaaatgatccagaaaagcccgtggactttccaccagttgtattgaatacatacctgatggtgtgagaatacagaaaggggctgtggtgcctgctcttaagaaagcttatcttggctgggcatgatggccacgcctgtaatcccagcactttgggaggctgaggagggtggatcacttgaggtcaggagtttgagaccagcctggccaacatagtgaaaccccatctctactaaaaatacaaaaagtagccgggtgtggtggcgggtgccttcaatcccagcttctcaggaggctgaggcagaagaattgcttgaatccaagtggcagaggttgcagtgagccgagatcgcaccactgcactctagcctggaccacaagagcaagattccatccctcctggccaaaaaaaaaaagcttatcttgttggggacacacgacatggatcctgaagctcctctatagtctactggactgagtccagtgctcacagtctaacctacttctttttttcaacatataactgtgctctgatctttctgaaccattcaccattctgggaatgcatctcctgctgttccttctgcctgggatgacttcctcttcctagtctgactacttgtatttccagaatacattctacacctcaggcctgggaggcagggtagatggtggaaggaatccagactcaactgggtttgaatccagactctgcttatccaaatagtcaggggaaaccaagttaacttttcagagtctcttttctttttccttgtaaaatggcccatcaggattgaatcagaacccataaaaagtacctaggctggttcctaatcctagtagggagctcaataaatatatataacaataagaaagcttttgtatttaaatattccagcacccacaacgttgttcagcagttaaacttcataactctccccactggactccaggctctttcagggcaggacggtagctattctgggttgagccctgatacctgcctcgcagtaggtattacatagaacttgttaagtacatgagcgataactgaaattcagaagatgaaatgataccttcagactgtggtggtcatggaaggattcgtatataatctaaaatttgaactgagccttgaaaatggtaggtcttaaattcgttcacttggaacaaatgtttacttagcacgtactatgagtaagtgctcatggggcatgagcaaagggcaggctcgtgtgggtgaccatgcatagaccaattggggcttgctgaggagctgggggcctgaggtagggctggattatgctgagcctcagtgcctgagcaagaagcttgaacttctttttttttgagacggagtcttgctctgttgcccaggctggggtgcagtggcacgatcttggctcactgcaagctccgcctcttgggttcacaccattcccctacctcagcctcccgagtagcttggactacaggcgtccgccaccacacccagctaattttttgtatttttagtagagatggggtttcactgtgttagccaggatggtctcgatctcctgacctcgtgatccgcctgccttggcctcccaaagtgctgggattacaggcgtgagccactgcacccggccgagcttctttttcttgaattattattattattatttttgagatggtagtataataaaaccagggttagaaagtttgtctcgaggcaagactcttgtagtagtttaaacataccaaaaaaaaagtgggggggtagaaatgcaagttcaaaaagtcacaaaatgtcgatttggggaaagcacttgtctcagctggcactcaaggcggttgagctgtctatcagcagcatgagggtgtcctctctctgtgggtgcctctgtttccacacaatattggctctatccctctcccaactcatagaactcttagataagcaatcaaactgtgaaaggccttgaactccagcccagagtcttgccatataggacaaagtattgtttatggtggctggaggtagggaaggtacttagtatcagcaggccaaatgaactttgggataagtagattccattcttgatcataaatgagaaataaaaactactcagtgggtctgggatcactcttctccagataattctcaatggaatggatttcattgatttctcatatttgaaatttatccctggctaagaccaaacagtaactatcacaatgggaaagtacactaggcaaatacatattttagaatcttgcttctccttctatttttgatattaattatttaaagtaaatatacttgagtatttgaatttccatatgctttgcttttcagaggagaaatccaggcagccttaaatatgatctgcataaaaatataggatctgttctaggtaaaatatatttgaagaagggtgaaattgagttgtctttatctcttccttgctagagacatctgtcagtagcagctcagatacagcaggatttttttgcttatgctgttggaaggaacagcatgtgccaaggctctgtggcaggctctgaaggaggccagccatggctggtgtgaggcatgaagccttggagtcagggctgatgcctgtagggaattctcagcctgtctatagttgctggcttaatgttgcacagtctccaccaactgtattttcctaacaaaagtctagtgggtttgttttcttctttcttgttacacagatgcacacaagtgctgcaagaacagcattcctcaaagtgcacactgtggtcaagcgtcctgagaatgtggcttttttcttgctaaagttcagagtgttttataggcaagcatggagttcagtggaaagcaagtaatgtctaggtttaatgttgccggagagaccctgccctttcttttccttatgcctcaacaaaacagaagtaacttactctatggtttcatactagattatacaatcagatacccttccacagtcagagtaactagggttaaacattcctcaccagcagtcctgctaagtgtttgttttttttttgagatggagtctcgctctgttgcccaggttggagtgcagtggtactatcttggctcactgcaacctccacctcctgggttcaagcaattctcctgtctcagcctcccgagtagctgggactacaggcatgtgccaccacacccagctgatttttgtatttttagtagagacggggtttcaccatattggtcaggctggtctcaaactgctgacctcaggtgatcctcctgtctcagcctcccaaactgctgggattacaggcatgagcccccgcgcccagcccctgctaagtttttagtgtttagtgttttcatggattgagtgttggttatgtaagtgccttgtggggagaggctctgttgtcttcgtggtgtgatactgacggcataattgattcctagttactattagataaggtgatggtgggttcaggtgtagatgactatatttatggaataatcctgccacttctaagtcccagaccttggaagatgagcagagatgacagtacctgggctgtttctttcctgatggtatttcattgcatctggccatcgctggtgacagcccccttctgtctttctccctccaagcagaatgctgtttatcccatgccctctctctgatcttttggcatttcagtgatgctgtctggtgagtgagcctattcactagctactccttggctatgaaggtccctctctgggccaggtatctatagctaaggtaatgcttcactcactccatcttctccactgctgtctgttccttgggtccctatgttcacttctgttagagcttatccactccaggcggtggaactctctggccagcttagtcttgaaattctgttaaagctccctggactcttttacctccttgatacacagcatttggttctattttgtaattccctggcttttagacttacaggatacttttgagtccagagtttattatttgagctttctttcatggggaacaaaatctccagccctgacttttcagcagctaaaattagcttcgcagaagtgatctggactgagtagatagagaatcccttgcctgatcattgaggtgcctgcccattcttagtctgtaatttcttcctgtcttctgcaaaaagaaaatcaggaaaaatttcaaatattctcacagaaaatgggattcccattgcatcaggcgtttcatcagaggacaggaaagagtaacttggatggagtggacttctatgctccagaaactgtgctgagaggccttgcatgctctactgtgagccatcttcacggcatccacatgtgcttcctattctaggggtattctatcttcagctcaaaattaaggaactcacccatgttcttacagttaacaagcggtgaagccaggattaaaaactaggtttggctctaaaacccttgctctttctactctaccttactcagaatcgatcctgggggaagatggaaacaaaaatacagattcccttttgtatacacatctggctcctttagaattgcatcatggggaactattctgctctaaagatcttttcagataacttttcctgtgtcaacccactaacttttgaaactgcttccacagtcccttcttctttcttcccaactcatgctgctaagctagtccctgaaacatttcatcttcccaatcccaaactcctagctcctcttatctgccaattcatgttggccccacagtctgacattccagctctgtgccccttgtaaatctagaaatcctcacatcctactcttatgggcttgttagtttgagatggagtcttgctgtgtcactgaggctggagtgagtggtacaatcttggctcactgcaacctccacctcccgggttcaagcgattcctgtgcctcagcctcctgagtagctgggattacaggcacgcacaaccacgcccagctaatttttaaatttattttatttttttttaaatttgagatggagtttcactcgttgcccaggctggagtgtaatggcgtgatctcagctcactgcaacctttgcctcctgggttcaagtgattctcctgcctcagactcctgagtagctgggattacagatgcccaccaccaagcctggctaatttttgtatttttagtagagacagggtttcgccaagttggccacgctggtctcaaactcctgacctcaggtgatccgcctgcctcggcctccaaaagtgctgggattacaggcatgaaccactgtacctggcctttattttttattttttgaggcagactctcgttctgtcgcccaggctggagtgcagtggtgcaatcttggcttactgcagcctccgcctcccgcctcccgggttcaagcaattctcctgtctcagcctccggagtatatggggttataggtgcctgccaccacacctggctaatgttttttgtgtttttaggagagatgaggtttcaccatgttggccaagctggtctcgaactcctgacctcaagtaattcacccgtctcggcctcccaaagtgctgggattataggtgtgagccactgcgcctggcctacccttatgttttaaaaatatgttagccccaacttagggtaaaagttaccactttccttttctattcttgatgtatattactgtaagaaaaatccatgggaacccatgctgctgcaagtttattatatatatatattttaacctaagttgtttcttagacattttaattcaattcattgactctttgtagtgagctaatgctgtggccattagttcactgtcttagttcaccgccagctcgggggctccattctcttttggtttacatagaatttcttttaagtttgaaatagctgtcagtttttttaaatggggacattttatgtaaatctagatttccagagtctcttgaaaattgaaaggtggcatgctggcctcctcttcctcaggcagttgtcttctcatgaaaagcagcagcttttcctccgtcccctctcggccaccttcgctgatttacctgtttgaccctagagattatttttctgtggtacttttgctccatattctccaagttcctgatttttgtcagctacttcgtaggagagattgaggctgaggtaagtgaccttgttttcttctttatcatatttttttctacttctcttctgcccctggagaagaggtatttcctctcaccaaggctaaccccagtttccatgttctccatatcatctcttgatacagaaacatgctgatcgtttccttaatgttaaaaataaaaacatccaggctgggtgcagtggctcatgcctgtaatcccagcactttgggaggctgaggcgggcggaccacaaggtcaggagtttgagaccagcctgaccaacatggtgaaatcctgtctctactaaaaaaaaaaaaaaaaaaaaaaaaaaaaaaaaaaaaattagctgggcatggtggcgggtgcctgaaatcccaactactcaggaggctgagcaggagacttgcttgaatctgggaggcagaggttgcagtgagctgagatcgcaccactgcactccagcctgggtgacagagcgagactgtctcaaaaaataaaatatcaatattcgttgcttctgttacttggtatccacttgcttcttagtgttttatcaggcccagacttccattttctgaatgtcagtggcattttctgttttcattctctctacctcttagcattatttggcattgttaactatcccatcttaaaattcttcttttagttttgatgacactaaaattttggcattttgttttctgattattcctttttgcttcctctttcttttctctctttctctttctctctttcccttccttccttccttccctcctttctgtctcactcactctgttgcccagactagagtgcagtggtgtgatctcggctcaccgcaaccactgcctcccgggttcaagcgattctcctgcctcagcctcccaagtacctgggcttacaggcacgtgcctccatgcccggctaattcttgtatttttagaagagatggggcttcaccagttggccaggctggtcttgaactcctaacctcaaatgatctacccgcctcggcctcccaaagtactggaattacaggtgtgagccaccgcatccagcctcctttttgtttcattttcctatcacttagatacaggtattgcaaaggctttatccttggctcccctctttttgtaatctcattgatgggcttcatgtagtgctgctgtgcagatggtcccaaacctcgactctagtccagcatctcctaagctctaggtgatgttccgtcaagtcctctaattgaaacctacctcaaactgacattgccatctcattcctcatgactacaccatcttttaatggcatcacatttctgccagtcatcaaagcatgaattagtttcctttgacacattccctttcaaacacacagcctgggtgggcagcattcctcagaaggtgctagagctgctgtaatagaagaccacggaaggtgtggcttaaataacatttattttctcatgattctagaggctggaagtccaaggtgtcaacaggtttgggtcctcggaggcccctctcctgtcttctccctgtgtcctcacatggctttattctctgtgcaagtgcctctctgatgtctcttcctcttttcttaagggcatcagtcctgttgaattagggtcccacccttatgacctcatttaacctttgttacttctttaaagttcctgtctccaagtatagtcacattggggattagggcttcaatgtatgaattggaagttgggggcaaaaatcagtctataatagaaggggagttcggggcttgaagtaggaaagctatccaggctggttagtagaaaatactgagccagggttatcagttcagggaaagtatacagctggcccttgcggagaagcaggcagataagtgagtggctacagagctacagtgtccttgcaacccctggactaagaggagcccaaagcacagttgtgttcgaattgagctgtggcctcagaagacttaactgtgcatttgccactctgcgacaggggatctttcctcatgacagtgaaaccagaacaaaataactacatgccaggggagtaagccatcattaggaagagtggcaggagcctgtgggccctgacactgggtgctgcacacctgttgttcctcctggacacttgtcatggtgagtgtaaagaagtgttttggacatctgtgttgtcacagctgttctgtctgagataatctctgcatggagaaatctgagggaacaaggctgaagacttactacaatgtcacttagtcctctctgtagttcctccacctctgtcaccttcattctattctgatggctgctatgtgggtcaggcaggccctttatcacgtgtgagtaggattttgacaacagcctcttacctggcctctctgcagtgtgtctttgcttgaatccagcctacctgcccttcttggaacccaactctgatcctgttattcctctgcttaaaagccttgagtggtgcccctttccaccaagctaaggccagatcccttgggctgatattaaaggcctttatagtctaatttgtcacccatgatttcccttctgttggctgtccttcaaccacattgggttttagctcttccttgacgacacccaagctttccctctttctttctctctctcttgctctcctctttctctctctctctctctcctctttctctctttcgacagtgtctcactctgtcacccgggctggagttcagtgcactgtctcggctcactgcaacctccgcttcctgggttgaagtgattctcctgcctcagcctcctcaatagctgggactacaggtgcccaccaccacgcctggctaatttttgtattttttggtagaggcagggtttcgccatgttggccaggctggtcttgagctcctgacctcaagtgatctgcccacctctgcctctgcctcccaaagtgttgggattacaggtgtgagccaccgcacctggcaaactttcccactttcataacatggtgtccacactgattggtgtctaaaatggtctcgtccttcttctgcacttgttgaaatgtcatccatatgttgttaaggctcaaatcaagtcctgcctaatttttgaaggtttccttaatttgtttcatattgtaggtcttacctcacttatactctgctcacaatgatatttttctttctttctttccttttttttttttttttttttttttgagacagagtcttgctctgtccccaggctggagtgtactggcgcgatctcagcacactgtaacctccacctcccgggttcaagcgattctcctgcctcaacctcctgagtagctgggactacaggcatgcaccaccacacctggctaatttttgtatttttagtagagacagggtttcaccatgttggccaggatggtctagatctcttgacctcatgatccgccctcctcggcctcccaaagtgctgggattacaggtgtgagccactgcacccggcaagttatttttgttctaaaactttttcttaactttattcaactataaaggctcttgagaataggggtggtgtataactttatcctttcaaccacttgacagtgttttgcatataagtgaggggcagatgcctgtggcatgaacaaatgaaatcaggtttgggtagtatgtcttcttgatgctgaaatggaaaatagaaggaactatgttcatgatcccaaacagatttcacctgccccagcatgctaactgaagaaactaattgtttgggaaagggaagagattggtagggagcaaagaactgtggagtaaatctggcaaccatcactcatcctccagggttcacgggatgactggtagggcctcagtcctgaatggattctgcccataggtttggaggaggatgaggaatggcctcagcttttaaggtgtttaggtttgggaggtggggagcaatcccctagacttaattaagagcataaagagtccatgagaacagtgaaaggttgttttatctgcttggttctatgctcccccgactcagaactagaacttggggagggaggcacaaggaacagattgcaggttgtgacacactcctatcctgctggctggggcactgattgtgggtacacaggatcccgaggactgcacggtgtgaccaagggcttctcctaatcaggctgccaccttggcctgtcaagttggataaaggtgagcccagggtggctgtgattagttcattcaatctcaacattcctctgtgacccatgagggagggagttatcctgaggctgaggggagacaggaggagtcgaggcagcctagggtgattttttttttttttggtggagtctcgctctgtcacccaggctggagttcagtggcctgatctcagctcactgcaagctccgccttccgggttcacgccattctcctgcctcagcctcccgagtagctgggaccacaggcgcccgccaccacgcccggctaattttttgtatttttagtagagacggggtttcacggtgttagccaggatggtatcgatctcctgaccttgtgatctgcctgcctcggcctcggcctcccaaagtgctgagattacaggcgtgagccaccgcgcccggcacctagggtgatttttaagctctagttcctttgatctggtttaggtctttaggtctgctttagacctgaggtggggcctaagcatcgatttttctaaatctctacaggtgattctgaggggcagctaggattgagaatcaaacttgtaaggtgattgcgagcattaaatgagataatgtgccatagagagttttcaaatgacatgatttattattgctagcatcacctgacacggtctacagagttacacaatttcaactaaattcttctgctcactcagatgagacagctggagcctttgggcatgggtggacaactaggactgaggagatgaaggaagatcttgtcattctgctgacttcactcctcaaggagttgccatttattttccttcttcagaagaagaatttacttacccctggcccatgttttgtctggtctctagcagcttcagaattccttttcttttctttttcttgagacagagtcttgctctgtcgccaggctggagtgcagtgacgcaatcttggcttactgcaagctccacctcccgggttcaagcgattctcctgcctcacgccgccaccacacccagctaatttttttttttttgaattttaggagacaaggtttcaccatgttggccaggatggttttgatctcctgacctcgttatccgcttgccttggcctcccaaagtgctggaattacaggcgtgagccactgcgcccagtccagaattctttttctttctttcttcttcttcttttttttttttttgagacggaatctcactgttgtcgagctggagtgcactggcacgattttggctcactgcaacctctgccccccaggtccaagcgattccccttccccagcctcccgagtagttgggattacaggtgtgcaccaccatacttggctaatttttgtatttttagtagagacggggtttcaccatgtttgccaggctggtctctaactcctgacctcaggtgatccacccaccttggcatcccaaagtgctgggattacaggcgtgagccaccatgccaggcccagaattccttttcaaaataacacctggaagctcataggagttacacaaagagcactcaggaacagctcccagctcagacttccagctttctgtgcagaggagttggtgagggtggtgctgaggatctcatatatcaatcctgttgatggccgtctggggcctgagagtccttggcctgccttgggctgggaagaagtcccctaggtcccaccagctatttctttcctatggaaaatagaccagtggctttagttctttctactttgccagatccagaggtcataccaccctccttttcattaccaagccttcctaacttctaaagggtatttaatgtttcttcttgaccacggccacattattctctttcctggcagcaataatctaatcattttggaaaaaagcaaaatttaatggtataattagctttttcatcaataaaattggtgaaaaaaaaaatctcattggctctcacccccgagcggttcctgtctgccagccaacactttgttctctttcccacagataaacaactttgttgtcaactattgatttttcccccccgagctcaggaatggttatagctttctttcatctccagtttttttttctttttttgaaacagggtctcattctgttgcccaggctggagtgcagtggtgcgatctcggctcacagcaacctctctgcctccaggttcaagccatcctcccaactaagcctcccgagtagctgggactaaagatgtgtaccaccatgtattttggctgtttgaactggggaacaaagcctgctggatttaatggactccaacttcaaatgattgctgctaatgatattctagaaatccataggccttcatttcttctgtgtctatccaccagaggggtctgatctctagattttttcaggaggcagaagatgaggtggggttaaagaagtaggaaagagtatccttaaatacaaagatccttcctaattaggccctgtgttccagagtcccaggcatccttgtcatggagcaatgacagagtcttgcgaaagagacataccccagctctgaattaggggacagagtaacaccaggatgtggactagacagaacaaggcctggaggtggaccagagcccagctcccttggctcctagatgaatcatctttctgcaagatggcaaaggaaacaaatagttttaggttcccatgtaagaccaggcttttgaggtttaggtctgctttccccattggtgcagctgggggcgttaaatatttaatcagtttggcctgggtacatgcagatcgatggccatagcattaatccattaatggctgtgtggtggggagtacacagtggcagaaggcagttgggggcttgcagcagtagctgtttccccaccagtatggtagcatttcactattggtataaagtggctctaattttctggcttcaaccagacaaaaaagaaactgaccttgaatgcttgagccttcaaagccatagatgcagatctgagcgattaccatctggctgtttgaaaacttcaaacaaaaaagtcaacttgagattctgccaagaaacagtgatttgtgtttctttgtatgtcaggctcacaggtctccagtgagacataggaaaacctttgcctcttcccctctctccaaacacagggctggttctcctagtgaggaggtttcactttctatccttggcctacaaacaaagagattaagagtttgtggttgacactgcagggcgtgagattgttgagtcttgggtgtgagtgccttagaaatgagcattcatatgctgatcacaaacagcctcatctcttgatgaaaacatagtatctgttggccttattctgattataaggacatattttaaattttgtaggatttgaatgaggttctccaataattactcccaactttaagagggctttgcatgttttgtttgacattgttttattttcttcacagcaaatatcattatctgaaatgatcctattcatttatgtaattactgtctgatcctcccagtaaagtacattgagacctcgtctttcttttctgattttttttcttttggggtcttttggccctatgaaatggaaaggtgtagggatctacaggtgagcttggacatagatgtgaactcaagctgaaactgaactgatgctcgcaggttgggatcagcagaaagaggagtgaaaggtgagggagctggaatgggccacaaacaggtgcctggatgtgactcaactctggtgatgccatattttctcctttcatcccagagtggtgttttcctggcagctggtcatggcttttgataaggcagagctgcctagctctcccaaggtgctggtgttgaccactggtgagtggctttgctgttttcttgcctcaatgctcgatggggagtctatttgtttgcttctttcttcgctacttagtcactcgtgccactggtggcgtggggcttcagactttgcggagactgcaggagaggcctggtattgggcagctgggggctctctgtctgatttgtactgtacgtctctgtgggcatgaaggtcagggatggctatcttcaatcaccatgccatggcttctagggtgcctggagcactttgtggcctattcttcaccctcccccatatcctgtgtggtcatccgttcttgtccctccaggagggaagggataggtggtttattctgatttgtaggtagggaactgtgatgagaggaacttgagggcttgccttgcaggtggtgtgaagagcagactccagtgctctgttgtgagccttctgccttctgtatcagcctcttgctgttctggcccctgttcttattctcctataaaagaaaaagctttcagccagcaggtgtcggggcactggcagaagtcttacccttaataataactgtgtgccggagccctagctgtcggttttacacttgtcctgtcttcctcctatggctcaggaccttgcccctgcaatggggcaacaggaggggcaggatgaatggaaatagaagctgcttcaggccaggcatgggggctcattctgtaattccagcactttgggagcctgaagcatgaagatcacttgagcccaggagtttgagaccagcctgggcaacaaagcaagacactgtctctaaaaaaattagttagcagggcatagtgatatgtgcctgtagctccagctattcaggaggctgaggtgggaggatcgcctaagcccaggaattcgaggctgcagtgagctgcgattgcgccactgcactgcagcctgggtgacaaagcgtctgggagggagagccccaacctagccactggaatcccttttctatcgagcatctcttttctgctgtggctagagacttcaggggccagaacagccttttctagtgcatctccaacatattggaccagctctaaggcctggtgtcctttttttttgaggcagagtctcactctattgcccaggctggagtgcagcagtgtgatctcggctcactgcaatctccacctcccaggttaaagcaattatcctgcctcagcctcccgaatagctgggacaacaggtggctgccaccacgcctggctaatttttgtaattttagtagagctggggtttcaccatattggccaggctggtctcaaactcctgaccttgtgatctgcccgcctcggcctcccaaagtgctgggaatacaggggtgagccactgtgcctgccttttttaatggtttaagctcttccttgtcctgtcctacctcaccaagcttctactaatccttcagttcttggaagtgtcattccttcaggaaatgttctttgttcttcccatcccgctccctattcccaagaccctttgttattttcccccttatcactgcattcttccccagcatgacactcaccacgtgtggttataggaatgtaataatgttccccaatagaagaggcaaggtatgggtccatcttgtctacagatttaacctcgattccttgaacttgaaaagctcttcaaatgtttgaatgagagtgggcttgtcataaattttttgggtcatgtatttggacttaatttctttaggtcagaggacaaagaggagtttggttggagatactgaaatggaagcatctgtgtccagtactcagtaaaaaatacgtgggtctgaaactctagtaaaaaggttgtccttggggaaacagatttggaaatcattagcaagttctggaaggtgtcctcctgtgcccccagcattactacccaagcagtctagatttggtgattggaagaacagaattataggagatggaggatggggttctcactccaattagattctcttttccatggttttattaatttatttttttcatcacagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttagg

SEQ ID NO: 354 - DNA, 395718 bp, Homo sapiens
gtgctgcatattctagatgctgctgtcacaaaatgtgggaagttcagtcatcaatgaccccgcttaacaatgtggacaagaactcctgccagctctgagaggaggaggtagcgtgaatgaaaaacaagcttctgttctgtttggccacacggtgcattgatgagcctggggaagaaacggaaatctattcatactttgctgatgggagtataagttggtccaacatctttgggggtcaacctaaaagttacctaacaaaattctaaatgcataagccatttgatctaagaaattctatttctaggtatttgtcctatggaaaaaccccctacttgtgcacaaagatagataaatagatagaaacatacacacgcacacacacaaatcataggtactctgttaaacataacatgcagtagcaaaatagttcaacctacttagacgttctttaaaaggggaatgatttgtaaaaagataccgcatatctatggaatgtctaatatccagtatttttaaagaatagatttattcgtctagatatgaatcagtcaagatctgtaattaagtgaacaaagcaagatgctatggtgtatatgtacacttttaattttactattttattgaggtataattgatgtgcactgcactacacaatttaaaatagataacttgatggattcgagaggggtgcacactgtgacaccatcccatccccactatcacatgtccatcacctacaaaagtttctttgtgcatcttgggcatctctcccttccaccactgctcacatcctccagtgccactacctgtcaccaggcaaccagcgattttctgtcactatcaattaatttgcattttcaagaattttatataaatggaaccaatagttcattttcatagctaagtagtagtctattgtatagctataatacattctgatagctatctgggttgtttccactttttaaaatatatatatttagagggtacaagtgtaggcttcttacgtgcacacattccatagtggtgacatctgggctgtagtgctcccatcacctgaataatgaacattttacccaaaaggtggttttccagccctcaccagcctcccaccctctcatcttttggggtctccagagtctgtcactccatctgtatgaccatatgtacccactgtttagctctcacttataagtgagaacatgcagtattgcactccctccctcccaccctcccaccctcctgcccttcctctcttcctcctcctcatcttcttctttcttcttcctcttctctctctctttcttcttttctttgactgagtctcactctgtcacccagggtggagtgcagtggtgcaatctcggctcactgcaacctccgcctccctgcaacctctgcctcccggattcaagcgatcctctcgcctcagcttcctgagtagctgagattacaggtgcacaccaccacacccggatcatttttttattttttgtagggacggggttttgccatgttggccaggctggtcttgaactcctgaccttaagtgacctgcccgcctcatgactttctgtttctaaattagttcattgttcccacttttgagctattgcaaataaagcttccatgaacctctgagcacaagcgtttgtgtggatgcaagtttttgcttctcacggatagccctagacatagcatagctggtcacatattgggtatttatttaacttttaaggaaactaccaaattgtattctaaagtagtagcaacagtttatattcccatcagtagcatgcaaaattccagtggctcaacatcctcactaatacttagtatagtctgtctcttaaattctggcccttttaacgagcacatagcggcatctcgctgtggcttcacttgcatctccctgaccactaacgacgttgaacgtcttccatgcacttagtgcccatttgtgcagcttttaagtctttattcaaatattttaaaaatttaaaaaattttgcttgtcttattattgagttataagagatctttacctattctggatctacattattagatatatgatttgcaaatattttcttcccatctgtggtttgccttttcattttttaaatagtaccttttgaaaagcaagtttttcattttgatgaagtctaaccttttctttctttctttttttttttttttttctgagacagagtctcgctctgccgcccaggctggagtgcagtggtgtgatctcggttcactgcaacctccgcctcctgggttcacgccattctcctgcctcagcctcctcagtagatgggactacagacgcctgccaccacgcccagctaattttttgtatttttagtggagacggggttttgcagtgttagccaggatggtctcgatctcctgacctcatgatccgcccacctcagcctcccaaagtgctgggattacaggtgtgagccaccgcacccggccgaagtctaaccttttctttttttttgtattctacctaagaaagttttgcctaccctaaagattttctcctatgtgtttttaatggaaatttcataattttagattttacatgtaggtctatgcctttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggtctatgcctttttgagttagtttttgtggatggtatggggtaagggtcaatgtttacttttttgcccctatagatatccagttgatccagcaccatttgttacaaaaacttatctttccccattgaattgccatggcacatttgtcaaaaatcgattggccatatatgaatgggtttgtacctggactctgttatgtcaatctatatatctatttttttatttttatttttatttttgagatggagtcttgctctttcgcccaggcttgagggcagcggtgtgacctcggttcactgcaacctccacctcccagggtcaagtgattctcctgtctcagccttccgaatagctgggactacaggtgcgagccaccacgcccagctaatttttgtattttgttttgtatttttgttttaccatgttggccagactggtcttgaactcctgacctcaggtgatccacccgtcttggcctccggaagtgctgggattacaggcgtgagccaccgcacccagcctatacatctatttgtttgcctgtaccaaactgtcttggttcctgatgtaggggtgggttgcccctacacacctgtgggtgtttctcgtaaggtgggacgagagatttggaaaagaaaaagacacagagacaaagtgtagagaaagaaataaggggacccggggaaccagcgttcagcatatggaggatcccgccagcctctgagttcccttagtatttattgatcatccgtgggtgtttctcaaagagggggatgtgtcagggtcacaagacaattgtggggagagggtcagcagacaaacacgtgaacaaaggtcttggcatcatagacaatgtaaaggattaagtgctgtgcttttggatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccattcaactctgagttgacacagcacatgtttcagagagcacggggttgggggtaaggtcatagattaacagaatctcaaggcagaagaatttttcttagtacataacaaaatggagtctcctatgtctacttctttctacacagacacagtaacaatctgatctctcttgcttttccccacacctgagagtttataagctttgaaatcaggtagggtaatacctctagctttgttcttcttctttccttccttctccttcttctgctcctacttctccatctccttctccaggcaccagataccgcaacatcagattaatgagtggaatggacagaacaagctcctattctattttcttgctctagacgcccatttaatatattgtcctcagatagaggacatatcaaatactaaactaataatatagactacacttaatctttgccgaaaggctgagaaagaattgttcttctttaaaaaagaaaaaaaaaaaaaaaaaaaacacaactgtttctggccgggcacggtggctcacacctgtaatctcagcactttgggaggttcaggcgggcagatcacttgaggccaggagttcaaggccagcctagccaatgtggcaaaaccccgtctctactaaacatacaaaaattacctgagtgtggtgtcagacgcccgtaattccagctacttgggaggctgaggcaggagaatcatttgaacctgggaggcggaggttcctgtgagctgagattatgtcactgcactccagcctgggcaacagagaaagactccatctcaaaaataaataaataaacaaacaatacaaaataaaataaaataaaaaattgtaaccaagcgcagtggctcatgcctttaatcccagcactttgggaggctgaggtgggtggatcacctgatgtcaggagttcaagaacagcctggccaacatggcaaaaccctgtttctactaacaatacaaaaattagccaggcgtggtggcaggcacctgttatcccagctactggggaggctgaggtgggagaatcccttgaacccaggaggcacaggttgcagtgagctgggatcacgccactgcactccagcctgggcgacaaagcaagactccatctcaaaaaataaaagcttctctaggccctccatatttccatataactcttagtatcacgttgtcaatttatgtaaaaaagccttgaattttgtatggagttgtgttaactctatagatcaatttgggaaaatttgacatcttaacaattgctattgattgaatgtctttgcccgcctcccagatttacatgttgaaacctgatacccagtgtggtggtatttggacaaggggactttgggagatgataaggccatgaggatagatcccacataaatgggattcgtgtccttacaacagagaccttagagagctgcctccctccctctgccatgtgaggacacaataagaagacagctgtctatgaacaggaaagccagtcctcaccagataccaaatctgctgcctcaatcttacacttaccagcctccagaacatgagaaataaatgtttgctgtttaagccacctatattgctgtagcagcccaaacagattaagacaatcatactgaatcttccaattcatgagatatatttttgccaattcagaaatgtggtatattaattgaaatctttaatttctctcagcaacattttgtagttttcagcattaaaaattttaacatcttttgttaagttttttcctaagcattccatgttctttagcactattgtaaattaatttttaataattatttgatgccgttacataatacaaatgattttatttatttatttttttgtagagacagggctttgccacattgttcaggctggtcttaaacttgtgagctcaggcattcttcctgcctctgtctcccaaagttctgggattacaggcatgagccacggctcccaaccaagaatacaaatcattttaatatagcaatcttgtatcccgtgaccctgacaaattcatttattcattctagaagtttttgtaaatttcttgggctattatacaggagcaatcataaactttgcaaataaagataactgtacttatttcttttttaaaaaaattttactttaagttctgggacacatgtgcagagcgtgcaggtgtgttacataggtagacacgtgccatggtggtttgctgcacctaccaacccatcatcgaggttttaagccctgcatgcatgaggtatttgtcctaatgctctccttccccttgcccccaacccccgacaggccccagtgtgtgatgttcccctccttgtgtccatattgttcaactcccacttaggagtgagaacacgcagtgtttggttttctgctcctgtgttagtttgctgagaatgatgggttccagcttcacccatgtccctgcaaaggacatgaacccattctttttcatggctgcgtttaattaattaattaattaattattgagacagagtctccctttgtcacccaggctggagtgcagtggcacaatcttggctcactgcaacctctgcctcctgtgttccagtgattctgctgcctcagcctcctgagtagctgggattacaggtgcccaccaccaagcctggctaatttttgtaattttagtagagacggggtttcaccgtgttggccgggctagtctcaaactcctgacttcaatgatccccccgccttggcctcccaaagtgctgggattacaggcgtgagccacggcacctggtccaattctaactgtttctgatcattatagcttttctttctttttctaatcttatcacattggctagggctttcccaacaatgttgaaaaggtggtgagaggaaagtggagcaagatgctcaagtagggccctccagcaatcaccccccaccccacccaacccccggccccacccacccccaccccacccctgcccaggaccactaaaccgaaaactctcaagttgagaaaaaacctgcataagaaccgaaaatcagatgaacaactgcagtatctggttttcatatcatctcaagaaaagcactgaagaggacaggaaagacgatcttgaaatgctaacatcacccatctcctaccccatggcagcagtcccacggcatggagagagaatccgtgagctgggggaggtagagcacagtgatgatgggactttgcacggcacggagagagaatccgtgtgctgggggaggcagagcacagtgatgatgggactttgcatggcagggagagagaatccgtgtgctgggggaggtagagcacagtgatgatgggactttgcatggcagggagagagaatccgtgtgctgggggaggtagagcacagtgatgatgggactttgcacggcagggagagagaatccgtgagctgggagaggcagagcacagtgatgataggactttgcattgccactcggtgctgcccagtcacagtggaaaacaacacagggcagcactcacagacacagcatttaaaccagccctagcaaagacaaatcctcaatctcagtggtgtgaacctgaattctagcaagccacgcactgctggctaaagagctctgggatcctaaataaacttgaaaggcagcctaggccacagggactgcaattcctggaaataccctggagccagtggacttggggtgcacatgacctagtgagacaccagcgggggcagcccagggagtgcttgtgtcaaccctcacccacccccaggctgcgcagctcacagcactgggagagactccctccttctactggatgagaggagggaggaggataaagaggactttgtcttgccacttgggtaccagctcagccacagtaaaataactcaccaagcagagtcctgaagctcccctgttctaggccccagctactggacaacatttctaggcacatactgggccaaaaggaaacctgctgcctggaaggaaagggtctgtcctggcagccttcttcacctcccgactaaatagcccttgggccttaaataaatatcagcagtagccaggcaggcagcactcaccacaggccttgggggagactcagagccttactggctttaagtgtgacccagcacatctccagctgtgatggccacagaaagaggctccttctccttgagaaaaagggagagaagagtaaagaggactttgtcttgcactggaggtaccagctcagccatagtaaataaagcagcaagcagattcctgaagtcccagattcccagccttagttcctggatggcatttctgcacctgctctgggctggaagggaatctgccgccctgaaaagaaagacacaagcctggctgcatttgccacctgctgactaaagagcccctggggcttgaagaaacatcagcggtcaccaagcagttcttgccacgggcctggggtggtagcggccatggggagaagactcctgcttggggaaaggagagggaagagtgaaaacgacgctgtgtttaactcgggggtcagcacacccacagtaaaatcaagcaccaagtagattccaaaaattcccaattctgggccctagctcccggaaagcatttcgagattcaccctgatttctagacccaccctgggccagaagggaacctgccaccctgaaaggaacaagacaagcctggctgcattcacctcctgctcaccaaagagtacttgggccctaaacatcagtgggagtgaagccatagttgccgcaggctgtgggagagacccagcgctgggctggcttcaggtctgacccagcatggtcctgaggagagaggtcatttctcttactgtctcctgtctctgaagagaaggaggaagtaaaagctgaaaaacaacaggaatgaagtcagtggcaagaccagccggcgcactgatgaccaggcctgaggttaaagattaacccccgactctaaccagatgtgctctctatagatctcaatctatcacaaccctttcatgtggaccccttagagttgtaagcccttaaaagggccaggaactctttcttctaggagcttcgttcttgagatgcaagtctgccgacgctcccggccgaataaagcctcttccttctttaacccggtgtctgaggggttttgtctgtagctcatcctgctacagtcccagtgctggtggccacaggagtgcttgtgtcgcccctcccctaactccagacagctcagcatggagagaaagactccatttgtttggggtaaagtgaaggaaaagaacaagaggctctgcctggtaatccagggaattctcccagatcttacttaagaccaccaaggtggtccctctatgagtctgcaagagtcatagtgttactgggcttgaggtgcctctaatgcagatgtgactgcagtgacaaaagacttaggtcacaaccctcagttccctttgaataccgggaaagctttctcaagaaggacgggaggccgggtgcggtggctcatgcctgtaatcccagcactttgggaggctgaggtgggtggatcacctgaagtcgggagttcgagaccagcctgaccaacatggagaaaccccatctctactaaaaatacaaaataagccaggtgtggtggtgcatgcctgtaatcccagctactcaggaggctgaggcaggagaaccacttgaacccgggaggtggaggttgcagtgagctgagattgcaccactgcactccagcctgggcaacaagagtggaactccgtcaaaaaagaataagaataaggaggaggaggaagaaagaggaaggagaaggagaaggagaagaagaagaagaagaagaagaagaagaggaaaaagagaagaagaagaagcagctcagacttggtggctcatgcctataattccagcactttgggaagccgaggagggaggatcacttgaatccatgagatcaagaccagcctgagcagcacactgagaccctgtgtctacaaaaaatacaaaaatcagctggacatggtggcatgtgcctgtagtcccagctacgcgggaggctgaggtgagaggatcgcttgagcccaggaggctgaggctgcaatgagccatcatcatgccattgcactccagcctgagtggcagagtgggactctgtctcagaaaaaagaaacaaacaaagacagatgggtacacacaagcacagactgtggagattacaataaataactaattctttaatgcccaggcattgaccaacatccacaagcatcaagagcatccaggaaaacatgacctcacaagatgaactaaagaaggcaggagtgaccaatctcagagtgatggacatgtgaactttcagagaaaacgctcaaaatggctgtttagaggaagctcagggaaactcaagacaacacagagaaggaattcagaatcgtatcaaatatatttcacaaagagattgaaataattttttaaaaccgagcagaaattctcgacctgaaaaatatcattgacatactgaagaatgcatgagatctcttaccagcagaacagatcaagcagaagaaagaattagtgaggttgaagacaggctatttgaaaacacacagtcagagaagacaaaagaaaaaagaataaaaaactataaagcaagaaataaaataaaaacaatgaagcacacctacaagatctagaaaatagcctcaaaagaacaaatctaagcattagaggaggtagagagagagatcagcatagaaaatctgttcaaagagatagtaacagcttcccaaacctagagaactatatcaatattcaaatgcaagaagattgtagaacaccaagtagatttaaaccaaaggtatttaataatcaaactcccaaaagtcaaggatgaagaaaaaattctgaaggcagaaggagaaaagaaacaaataacatataaggagctcccgtatatcttggagcagacttttcagtggaaacattataagccaggagagaggggcatggcatatttaaagaactgaaggaaaaaaaactttcatcccagaatagtatatccagggaaaatattctgaggtcaggagtttcagaccagcctggccaacatggtgaaaacccatcactagtaaaaatacaaaaattagtcgggtgtggtggcacccatctgtaatcccagctactcaggaggctgaggcaggagaatcacttgacccagaaggtggaggttgcagtgagctgagatcacgccactgcactccagcctgggtgacagagtgagactctgtctcaaaaacataataataggaataataaaggaaaagtgcaaaaattcaaacaacttaacagaaactgggcaaaagagctgaaccggccctccacagaagaggaaatgtggaggaacggctaatgaaaacatgaagaggggctcagcctaacgggggagatatcacgtgacactcaccagacgggcaaaaatctcacaacccaatccatgccagcgttggggagaatggtgagaagcaggaacaccaggcactgctaacgcttgtgaagtatatttctgctatgcttgtatatgaaagagtgtgtgttgtgggttatgaggaaaattacatttcttacctgggatgaaattttaaaacttgaaagctactgaccagaagaaacttgcgcttgtgtacaaaagaaatgcccaagaacgttcccaacaaaacacagtcctaagggccccaacctggccaaacactcatccacgggaagatgaagacatttcccatgctcccctcagacgacgggagaccatgcagcaatgaaaatgagccatgtcagtgtgggtgggtctcagggagagaatggaggacaaaaatagacacagagcaggtgctcagagccatgcagtgtaggagcagccatgcaggagaattccctcacgtcaaagttcaaaactacagccgaggcaacagagcaagaccctgcctcagaaagaaaacagaaagttcaaaaactaaatggcttattttttagggatgtacacacacggtgaaagaaatgtactatgaaggaaagtgtgcaaataataaagactaaagcaagaagtgattccctccgtaggagaagggaagggactgggactcaggcagggcctccagggagcatccaaagttatgtctcttcagattctactccctaaacttggtggaggtcctctgtgtccaatgtgtcaatattctttataccttacccatactgtaaaaacgctttatttctattcaatatttagaagacagttataaacaggatgcattcaatagcaaggtggcagatgaacatcaggaaggaacatccatgagcttccatccacggaacctcaccatggatacgcttgtgatcaagggcctggtctcccctcaagacacggtcacagatcagagggcacaccatcctagcagtggagcaggaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcactctgtcggtctcactctctcacacgcttccccggctcccttcgttcccccccaccccacttggcctgcgtgctggagggtgtgcgagggagtgggaggacgtcggggggtggggggaggcgttccggtccccaagagacccgcggagggaggcggaggctgtgagggactccgggaagccatggacgtcgacaggctccaggaggcgctggaagattttgagaagaggcaaaaaagaaagtctgtcctgtcctggatcagttccttttgtcatgtagccaagactggagaaacagattcagtggtcccaatttaaaggctattttattttcaaactggagaaagtgatggatgatttcagaacttcagctcctgcgccaagaggtcctcccaaccctaaagtcgaatatattccctttgatgaaacaaagggaagaatactgaaaactgtcactggatttaaccgtatcccttttactattcagcgattatgtgaattgttaacagatccaaggagaaactatacaggaacagacaaatttctcagaggagtagaaaagaacgtgatggttgttagctgtgtttatccttcttcagagaaaaacaattccaatagtttaaatcgaatgaatggtgtgatgtttcctggaaatgcaccaagctatactgagaggtctaatataaatgggcctgggacacccaggccacgtaatcgaccaaaggtttctctgtcagccccatgacaacaaatgggtggcctgagagcacagacagcaaagaggcaaatttgcagcaaaatgaagagaaaactcacagtgactcttcgacatctgaatcagaagtttcctcagtgagccctttgagaaataaacatccagatgaagatgctgtggaagctgaggggtatgaggtaaaaagactcaggtttgacaaaaaggcgaagtcggagaaacagccagtcaagagacttgcagcgaaatttcttcagttatggtagaagaaacagaagcatcaccttcatctcatgataaagacaaagaaagctgtggtacccggcagcgtgttcagaagaggatgaagaagatgaagaggaagaagaagggactgagagaccatctgtaaaagggaggagtaaggagatcctcaaattcttgcattcattgttttcgtgaaagaactgtacgtcatggaactccttgtaatgccgacgctgggcttttctcccacctgtatgcagttgctgctgaatttcaggggatgtgatttgaactacagagcatcagaattcatgaaacttaactgtggaggtattttgaaaacaaaatttaagtacaacaacatttgcttagttttagagtcttttatgacatcaagagaaatgatcccagaaagaaataaacaagaaaaagaatctgatgatgcctcaactgtgaatgaagagacttctgaggaaaataatgaaatggaggaatctgatgtgtctcaagctgagaaagatttactacattctgaaggtagtgaaaacgaaggccctgaaagtagtggttcttctgactgccgtgaaacagaagaattagtaggatccaattccagtaaaactggagagattctttcagaatcatccatggaaaatgatgacgaagccacagaagtcaccgatgaaccactggaacaagactatttagaaacatatacatgcagtattttacacacagttctggttttaacactgtgtaaaacttttatgtaaaaacgtgcacctttagttttacaagaaaagcaggttgtaaaataaagtactttatggataattcctgaaagagttgtccatgtaagaactgtgaatatcagctcctctgggtcctgcttaccttaccgctgatttctctttctttctttctttctttttttggtctgggcaaatcagtggtttgtatatagaagttttttttttaatttaggactgaagtctttaaactggaaagtaattataattttgaacagttttttgagattatcacatttagtttatacatatgcaagaagctttttgtcttgtgtctttctgatagctctagcagttttcatattttggtcatagtttcaacattttaacatgtgaataatagagtttcatgctggtttccagattgtattgttcggctacatacaatagaaccttaagttttatatatatgtatatattattctaagggggaaaatgttatatttttctgttggtataagagataaatacagtggatactttttctattggtaatgattgaattcacctctttcagaagacattttctttctcttctgagtaactgaaataaaatctggcctttgtgaaaccctggaaataccacaaccctcaactagaaacaccaataccagctcctccgcgagtttccagctccacaacctaagacatcagaggcagcattggttcctcacgtagagtccagctccgggaccctcatatttgaaccgcagggccatctcatccctggatctccagctgcaccacactcaaattagaacaacatcagttcctccccaggtctccacctgcacagccctcgaaagggaacatcagctcctccccgggtctccagctgtaggtccctaaaactagaacatcagctcccgcctgggtcgccagcagcaccaccctcaaactggaacatcagatccccatgggtctccagctgcagggccctcaaactggaacatcagctcccccaccagatctccagctgcacggacctcaaactggaacatcagctccccgccgggtctccaggtgcactgcctgcaaactggaacatgagctccctgccgggtccccagctgcatggccctcaaactggaacatcagctccccaccagatcgccagctgcacgaccctcaaactggaatatcagctccaccccggggctccaggtgcacagccctcaacttgcaacatcagctccccaccgggtctccagctgcacggctctcaaacaggaacatctgctccccacagggtctccagctgcacggctctcaaacaggaacatcagctccccacagggtctccagctgcacggtcctcaacctgcaacactggctccccaccaggtctccagatgcacggccctcaaactgcaacatcagttccccccgggtctccagctacaccgcgtcaacctggaacatcagctccccgccgggtctccagctccacggccctcaaactgcaacactggctcctcaccgggtctccagatgcacggccctcaaactggaacatcaactccccaccgggtatacagctgcatggccttaaactggaacattagctccccgcccaggtctccagatgcacggccctcaaactggaacatcagttccccgccaggtctccagctgcacggccctcaaactggaacatcagcttcccgccgggtctccaggtgcacggccctcaaactgcaacatcagctccctgctgggtatccagctgcacagccctcaaactggaacatcagctccccgccaggtctccaggtgcacggccctcaaattggaacatcagctccccgctaggtctccaggagcacgggcctcaaactggaacatcagctccctgccaggtcaccagctgcatggccctcaaactggaacatcacctccccgccaggtctccagctgcatggccctcaaattgcaacatcagctcccatcagagtctccagctgcatggccatcaaactggaacatcagctcccccgcgggtctccagctgcacagacctcaaacttggacatcagctccccgccgggtcatcaactgcacggccctcaaactggaacatcagctccacccttgggtctccagcagcacggccctacaactggaccatcagcttccccccgggtctccagctgcacagccctacaaccggaacatcagctccctgccgggtctccagctgcacagccctcaaactggaacatcagatccccactgggttcaaactattccagtttgagggccgtgcagctggagacccggcggggagctgatgttccagtctgagggccgtgcagctggagacctggtggggagctgaagttccagtctgagggccatgcagctggatacccggtggggagctgaagttccagtttgagggccgtgaagctggagacccggtggggagctgaagttccagtttgagggccgtgcagctggagacccggcggggagctgatgttccagtctgagggccgtgccgctggatacccggtggggagctgaagttccagtctgagggccgtgcagctggatacccggtggggagctgaagttccagtttgagggccgtgaagctggagacccggtggggagctgaagttccagtttgagggccgtgaagctggagacccggtggggagctgatgttccagtttgagggccgcgcagctggagactcgggggtagccgatgttgcagtttgagggccgtgcagctggagacccgggtgggaaccaatgttccagtttgggagccatgcagctggaggcactgcggggagcagatgttccagtttgatgttcctccctgggtctccaggtgcacggccatcaaactggaacatcagctccccggccctcaaaccagaacatcagctccccgccggatctccacctgcacagccgtcaacatcagctcctccccgagtcctcagctgcacgaccctcaagttagaacatcagcttctccccaagtcttcagctgcgtgaccctcaatctagaacatcagttcctctccgggtctgcagctgcaagaccctcaatctagaacgtcagctcctccctgagtctccagctgaaagaccctcaaaacaaacaacatcagctcctccccgagtcttcagctgcacgacgctcaatctacaacatcagctcctgtctggttctccagctgcacgaccctcaaactacaacctcagctcttccccgagtcttctgctgtatgaccctcatctagaacataagctcctctctgggtgtccacctgtagggaactcaaattagaacgtcagctcctcccagagtcttcagctgcatgaccctcaatctttaacatcagctcctctccgggtctgcagctccatgaccctaaaaatacatcagcagctcctccctgaatcttcagctgtacgaccctcaaactacaacatcagctcctgtctgcatctctagctgcacggccctcaaactagaatatcagctcctccccgagtcttcacctgcacgaccctcaaactagaacatcagctcctgtacagatttccaactgtagggccctcaaactagaacatcagctcctccccaagtcagcagctgcaagaccctcaaattaccaccttagctcctcctggagtcttcagctgcacgaccctcaatctcgaagatcagatactctccgggtcttcagctgtagggccctcaaactataacatcagctcctctctgagtattcagctgcacgaccctcaatctcgaacatcaactcctcttcaggtgtgcagctgtagggccctcaatctagaacatcagctcctccctgagccttctgctgcatgaccctcaaactagaatctcagctcctcccgagtcttcagctgcatgaccctcaaactagaacctcagctcctccctgagtcttcagctgcatgacccttaatctagaacatcagctcctccccgagtcttcagctgcatgaccctcaatctagaacatcagctcctctccaggtttgcagctgcaagaccctcaaactagaacatcagctcctctccaggtctgcagctgcaagaccctcaaactagaacatcagttctcctacagttctgcagctgcaagaccctccatgtagaacatcagctcctcaccgagtcttcacctgcatgaccctcaaactagaacatcagctcctctccacgtctccagctgcatgaccctcaaagtagaacatcagctcctctccggctctgcagctccaagatcctcaaactagaacatcagctcctctccaggtctgcagctgcaagaccatcaatctagaacatcagctcctctccaagtgtgcagctgcacgagtctcaatctagaacattggctcctctccaggtgtacagctgcacgactctcaatctagaacatcagctcctctccaggtctgcagctacaagaacctcaaactagaacatcagctcctctccaggtctccagctgcatgaccctcaaactagaacatcagctcctctccgggtctgcagctccacgaccctcaatctagaacatcagctcctccccgggtcttcagctgcacgaccctcaaactagaacatcagctcctccctgggtctgcagctggaagatccactaactagaacatcaaatcctgtctgggtctccagctccatgaccctcaatcaagattatcagctcctccctgagtccccagctgaaagaccctcaacgcgaacaacatcagctcctcctgaagtcctcaactgcatgaccctcaaactacaacatcagctcctccccgagtcttcagctgcatgaccctctatctagaacatcagctcctctccaggtctgcagctgcaagaacctaaaattagaacatcagctcctctctgggtctgcagctggaagatccactagctagaacatcagctcctgtccgggtctccagctccgtgaacctcaatcaagattgtcagctcctccctgagtctccagctgaaagaccctcaacgcgaacaacatcagctcctcccgaagtcctcaactgcatgaccctccaactacaacatcagctccaccccgagtcttcagctgcaggaccctcaatctagaacatcagctcctctacaggtctgcagctgcacgaccctcaatctagaacatcagctcctctacaggtctgcagttgcaagaccctcaaatgagaacatcagctcctctccggatctgcagctgctagacactcaaactagaacatcaacttctgtccaggtctccagttccgtgaccctaaatctagaacatcagctcctccctgagtctccaactgaaagaccctcaatgcgaacaactaaagctcctccccaagtcttcagctgcacgaccctcaatctagaacatcagctcctctacaggtctgcagctgcaagatcctcaaactagaacatcagctcctccccgagtcttcagctgcatgaccctcaatctagaacatcagctcctctccgggtctgcagctgcaagaacctaaaactagaacattaccttctctccagggctccagttctatgaccctaattctagaacatcagctcctccctgagtctccaactgaaagaccctcaacgcgaacaacatcagctcctccccaagtcttcagctgcaagaccctcaaactagaacatcagctcctctacaggtcttcagctgcacgaccctcaaactagaacatcagctcctccccgggtctgcaggtgcaagaccctcaatctagaacatcagctcctctccgggtctgcagctgggagaccctcaatctagaacatcagctcctctccgggtctgcagctgcatgaccctcaatctagaacatcagctcctctccaggtctgcacctgggagaccctcaaactagaacatcagctcctccccgggtctgcaggtgcacgaacctcaatctagaacatcagctcctctccgggtctgcagctgcatgacactcaatctagaacatcagctcctccccgagtctgcaggtgcacgaccctcaatctagaacatcagctcctctccgggtctgcagctgcatgaccctcaatctagaacatcagcacctctccgggtctgcagctgcatgaccctcaatctagaacatcagctcctctccgggtctgcagctgcatgaccctcaatctagaacatcagctcctctccaggtctgcagctgggagaccctcaaactagaacatcagctcctccccgggtctgcaggtgcacgaccctcaatctagaacatcagctcctctccaggtctgcagctgcacgaccctcaatctagaacatcagctcctctccaggtctgcagctgcatgacactcaaactacaacatcagctcctctccgggtctgcagctgcatgacactcaaactagaacatcagctcctccccggatctgcagctgcaggaccctcaaggtagaatatcagctcttccccgagctaaaacacctctcccacctggatctccagctccacgagtctcacagaacagccacactggctccttcattgtcttcagctccacaacctaagacatcagtgggagcaccggctcctccctggacctccagctcaacgaatctcatagacttaaaaggcagcacctgctcctccccaaggctccatctccaccaccctcagatttgaacagcggtagcaccacctcctctccaggtcttcagccccacgtccctccctgaacaatcccttctcatgaaattcagcagtcaagaaatctgcagcggaagtaaatgaataaatgttttgttttcaaatcgatacctcttttatgttcatgagttaacttttctactttccattagccttgcaatctacttatgtccaatgtgaaacagaaacacaccatttgaaatcacgtttaaaaacttagtagtttttcaataaaatcatcacacagctgtagacacgatcttatttctctctgcctgtgcagaagtcttatgaaaattcaaactatgaatttactttgttgagattcccagaatacacattaatcccaactgttactcccctccttaaaatcttttaacacattcccatcacctgagcataaatgccagctcccatccacagcccaaagtgcccagcacggccctgccctctgccctggtctatggtctcccctcttaaatgccagcaccatccacagcccacagtgcccagcacggccctgccctctgccctgccctctgctgtggcctaaggtctctcccctgtgccattcccttcctgacggacaggcctctgtccgttcctcaaaccacacaggctcaggcctgactccaggcctttgcacttctgtgccctctgcctagggtgcctttcccgggctctgcatcctcctctcaacccgctgagctccagcctgctggtcgcccctcaggtggatgaacacacggtgtcctctcgccccaccagcttttgcacaggctcttctctgtgccagacacacaccctctctatcggggtttactctctaaataccattcatccttggagtctccactgaaatatcgctccctgcccacccccctcacttggacttaaccttggttaggttgccaacccccgtctcctgactccgggaagctagatgctctcctagcactcggaacttgcccatcgccacatttgcacacccctggttactgggttaggttggcgcacaagtcatcgcgggttttgccattactattaatgaacggcagcaatggctcctccccgtttcttttttttttttttttttgccattacttttaatgactgctgcaccaacctattagaatcatttatatttatccatccatcatgtgtcttcccctctagaaaggaagctccatgagaatagaggccaaatctactcaaatcactccaccttcccagcacattgtttgtcaataatcatttaccaactgactgatagagaaatgccttccctgttgctgggatgaggcacatgacacgcccctttgaaagtcaattccatggacagttagcatttgctcttcactactgcacctgtggcatggctgggcttaggctgatctagtctggccttgactccaggctaaggatgggaaccatgcctgctccacacgcctctcatcccacagccagagccgccgttccctggagcacgcacatctcgtggggaaaatcaagagccttagagggcaggcctggcagtgcccacagattccaggcttctgcttgtaccgtgtctgtgaaaatctcattggcagaagcaagtcacccagccacgagcaacacctatgggatggataagtccatccaccctccctcgggccctggcaaggttgtggctatgtcatactcttacggggggagtgaaaaattgatgcgcaacattaaatcacccaggcaagaaatgtcagcctctgtcctcgcgctggaatcattcttcaccaccgggtttgcctgaattccctttgcaatggtgtctgcaggtttagcccaatgctggtccccgtggaggacagagaagcctcaatgggcctccgtctgttgggaagaacaagatattagcttggcgcaaaaccaccgcaagccccagggggcccttgcgccatgagacaggagaggggcagagaactgtgggagctcaggaaagctcacatccccagcccctcccgtgcatccccagcccctccactgtgaccccagcaccaaccctctcccctgcttgccccatctctgctttctttttttcattttctttctttccttgtttttgagacagggtctggctgtgtcactcaggctggagtgcaatggcacgatctcagcttactgcaaccttcacctcctgggctgaagcaattctccctcctcagcctccccagtggctgggactacaggtgcacgccaccatacccagctaattttttttttttttggtagagacaggatttgccatgttgcccaggctggtctcaaattcctgagctcaagtaatcctcccacctcagcctcgcaaagtgctgggattacaggcatgagccaccgagtccaacctactttatttttctctacagtacttggaaccttctaatgtactaaggacacgtgtattttctttcttttttgtcttccctagaacaggagcttaatgtgggcaggtatttttgttgatctcatttatcaccctctccccagttcctggaacagggtctggcacatgaatggtgtgttctaaataaatatttttaatagataaaaaaatgaaatatcctacaagagaaagctatatctggaactcacccatcaacagaacctaaaggacaaagacctttagcctgtctctgcctctgaacacacccaaccccggaggagccagcagaggaaaaagaggacaaaggcggggaagggagcaggtggtgcccaccaagtaaggaaccctgaggcttaggcggaacctgagctggagaagggactcatctaggaactgggtatgagattaaagtttagattggtctggcctggattttgtaacacctaaacaagagttattctattctttttttgtgtttttttttttgagatggagtctcactgtcccccaggctggagtgcagtggcgctatctcagctcactgcaacctctgcctcccaggttcaagtgattctcacgcctcagcctcccgagtagctgggattacaggcgcacaacaccattcccggctaattttgtatttttagtagagatagagtttcaccatgttggccccctggctcacgcctgtaatcccagcactttgggaggccgaggtgggcggatcatgaggtcaggagattgagaccatcctggctaacacagtgaaaccccatctctattaaaaatacaaaaaattagctgggcgtggtggcaggtgcctgtagtgccagctactcaggaggctgaggcaggagaatcgcttgaactccagatgcagaggttgcagtgagccaagatcaatgccattgcactccagcctgggtgacagggcgagcctccatctcaaaaacaaacaaacaaacaaacaaaaaaccttcaaacgaatctaagaattattattttttaaagtacaactttaaaaatgccccttacaaatacaacagtgttatattaaggcaaacccacttcagaagcacaaagttaatttcttataattccaataaatatgtgaatgttaaaaaaacccaaacacccgaaaagggatcaaactcaagatagtttgtaacattttattgcaaaaagaagggcagagaacagtcttcttcatacctgttcaccacagtaatttttagcggctctcctgtgcaaagaagtctcatcaatgaaccagcgtacgggccacaaataccttctcagtgcggtttcacctacaatacaagcactcagaagcacaaatttaactgaagtgagaaaccaggccattttgtagcttcagtttttctaccagtaatatattaatttcttgaaatagcctaataatttagttctactatcaaaacagaagcccaatctgggagaacaattattatacaagtcaaactaatttcaatcatattagtataggaattcatattagtataggctaataattcatattagtagaggcgggaggatcgcttgagcctaggagtttgagaccagcctgggcaagacagtgagactccatctctaattcttttttttaaataaagaaattcagagaggagaaggaagcggactgatatgtgtctatccaaggacaaattttgtgtgcctgtacatacaacacaactatgaaccttccttcacgcagctcacaatctagtagcgagaagaaactacgaaaacatgagcccccacggtgaggaaaaaggcgcatatcagagaaaagaaaaatgctgcgatgatccaatggcaggagcagcgcgcatccactttctttgtttttttgagatggggtttcgctctgtctcccaggctggagtgccgtggcttgatctcagctcaatgcagcctcaacctcccaggctgaagtgatcttcccatctcagcctcccaagtagctggaactacaggcgtgcaccactacacgtttactttttgtagaaacagggtctcacaatgttgccaaggctggcatcctgaagggcgggtggggcttcatcctacagagatgaaaggcagaagctcagagcccaaagcaaaggggtggaggacaagggcatcttcagaacagagtggctcggctgagacatccagtaggatgccaccaggcagaggtgtggtggaaaaacacagggccacagggtgaatggtcacatgtcaggagcaaaccaccacagaacatgacagaaacacggtgtactaaatcaggcttcaaatcgcagccctgcaacttcagagctaccacaggtaacccagaaagggagcatggacagcaccacccactgcctgaggctatgagatggaccagaaacctgtgcttactaccagcctgccttattccagaaggaattcaggaaacacaaagacactcacagtacagcaaaataaagtaaatgtgaatcatgttggctgaggagaaacggaagagtctaagactatgtcataaagtttacctctactctaaactctcattactggcgagccaccaatctgactttaagttctctagcagctaaactgaagaggaaaatgtaatcaggtaaaggtttataagatgcaaacaaaacaggacagccaccacagttgctgagaacacgcgcagctccagctccaggagaaacagggtggccatctcctggggctgccccgcagcaggtgtgtcagccccaaagccagcgtctctcagggtaaacggtgactacgggcttcatggggccacatgcctccaacacaagctgaggaaatctcccagggcaattcaaggaacagggtctcacaatgttgcccaggctggtctcaaacgatccccctgcctcggcctcccaaggtgttgggaggtcagacgtgagccactgcatctggccccgcatgcactttatagaggagggctttgcatcctgtacggcgggtggggcttcatcctgcagagatgaaaggcagaggaagctcagagcccaaggtaaaggggggcgcctaacaaaagcgactccattgggaccacggtgagagggtccccatacacagcttgggttaagccagacactgatttcaaagtatctcaggaatggtggactcagcacctgtcaggcaattctctctctcaagcaggctcctggtagatatttagtagcagctgaaatcaagattatgttctgactgacacttgctgagggttaaagagctatatacgctttgaggaccagctgaacttgggcaggactaacaccctctggtgaaaatacgggaacccaaacacacgagtcagagcaggaggtgtctcccccacccccaaacaataacgctgaccttggatttgggttaagtgcctagcccaggggtgtgagtgttcaggaagtggaaaccatcatcaccatcatcaggtaatggaaaaccatcaaagctttgagctggcttgttagccaagaatagtagtagtgtattagctactactaatactcacagctgacaattactgagcacttgctccgtgccaggaatcacgggaagcacctcacatgcatttcctcaattctccctcccagtaatggcgaggacacaaaactggtagagccaggactggaatccaggcaggccccaaagcactccagtggagcctgccaaggtgtgcaggctaccatgctaatgaggtccagtatttgaccaccactcctagttgagcaagtttaacagaaaacctaaaactaaacttaaaatctaaaaatttgagcaaatgcataaaaagcaggctcttaaaatggatcataaatcttgcatcacttgctggaaaaccactcaaaatacacatctctgagacatggcctctgaggagggcactccatgtggctcgtatcaccctggtgacaaaccacgtgaacctgggtggtcacctgaccatattgaacagacgatgcacagagccatttgcatccactgtggtcaacatttaggaagttttaagctaagatttgccaaattgtagcctactggattccggttctcttgacatctctttctagtagccatgtcttgcacttcccgagtataaacgaactgagatgcaaataaaaaaaaggaggatttaagaataatgaaaagagaaaaatcaagaaagcacaatcactagtgtagagataacagaatttctgaattccctgaaaacaatctatataaatgcatgtgaaataatacaccagcatctgtggcccatacgtcacatattaggaactgataacataaggtaaacatgttactctgaaaacacaaatcctcacaaatcattaggcagtaagactgaatccagcacctcccccacccacagcgcagtgaggcagtgtctagcagccgtagtgctccccgcgccccagttcagtctctggcaacatcagatacttcccactaataacgaggagcctttcaacattttcacatctcaaaactgaccccttttctagcttaaatggcacggatctggaaaggcaaactatactcagaatcagaaaagatgactgcccctgagggattacagaaaaagcagcagtcaggtgttcaatgaagtaaaatgtatccaatgatagctcaggggagggggatcaattgagctgaaactggcaagaacgtaactccagggagctcacaacacgcaaggacccggatttcccgctgcctgaacgcccactattcgcacactgataagaacgcctccccataactcccctgccagcgcctccaacacccccaatcctttccccaggaacccagtcccagtttctgcagttcctgtaacagccacgttcccacacaagtgctgcctgagctccccaagccctccaacaatcaccccccagtgccctcgaaggtctattcagagaagtcaccaagatgcagtcacccaggaaattcaaggacccccaacttaccaaaaggctttcggctggacagagctaaccttcctattcccctcctaaacctacaacctagttttcatttctcaagaagcctttccctgtgctcacgcacgccgttgttagctggctcggtgaggcactccaagcagtaacagcggtagccacagaataaaccagaagcatctccaccatgaagcagtaataataatttgccctaatgattcctttgtccttggaaaatcaacttcagaaagaaagttatccactgtgagcagggcaggctcgcggcttcttggtccggagacccaggtcccactggcccactcacccttggagagagcttgccgaagctgggtgtccgatatcactccactcctctctatcaaccctataacatcaagaagaccaaacaagctggcgatcgaaagttcaggaaaagcaaaacaaacgtctcctgtcaaccctgcaccgactctggaaggctccctcctggaacctccgcctctccggtcccgctgacgagtacagcggaatcaaggaagtgccccaggagccacgtccaagtgtgttcttcccctaagaggccaatcatctttctctctcttttcccacctcaatccttcccttccttcccctcctgacctgtctgaattcccatttgcaccagtttccctttttcacagacaagacaagattccctcagataactaagccattccctggccatgagttactacagtttcggtcattcattcagtggaaaagcgaccagggacagaaggcgccgccataaaggtcacctggcccgagcagacgccaggtcgctgcttcttccttggctgctgacattttaacagcggcccagacagtctgtttccgctttccccaaacaagcaccctggagaccctcccccgacggctcgaggcgagaaacggggcctggcccaggagccggtggccgcgacctcgggtatgcagtggcgccctctgcaccttgggaagcgcccgacgcacaggacagggaccgggcaggaggcaggggcggccccaggagaccgggcagcggacgggggagaccgcgggggacccggaaggggatgggggcggccgcgggggtcggggcaggggatgggggcggccgcgtcggtcggggtagggttcgggggcgcccgcgggggtccgggcaggggcggtggagacggcggaggtcggggcaggggacgggggaggccgctggggacccggcaggtgacgggggaggccgcggggcaaccggcagggaacggggttggccgcgggggtcgggacacgggtccggggcagctgcgggggaggcgggaggtgccggggcggtgccaggtggcagctctggaagacgttccacaggaagctctggtcgggcagcgccgcgcccgcagcaggcccagggccgcccaaggccggggcggtaggagtaggcggccaagggccaaggcgcgcggctgggctgaggcgcgtgcggcgactggcgacctcagagcgacaccacttccgcctctgccggggcagggccaggcgttaccgccgcttccgggggcgcaggaaatgcgcgttgtccgagatcctccggcgcaggccacctgcgcgcggggccgggaaggcgcttggaggaaatgtcccgcgccgcgacccgggacaggcagtgatggagcagggatttcgtttgccttttagttcttgtataaaaagaagttttgacgtgaatgtgattcacgctaacagtcggaaactctgggcggggcgcggtagctcacacctgggatccctgcgctttggggggcggaggcgggcggagctcttgagcccagcagtgcggaccagcctgggcagcggggctagaccccatccctacaaaaattacagcaagtagtcgggcgtggtgggctcctgtggtcccatgtactccgtgggctgaggcgggaggatcgcctgagcccgggaggtcgaggccgcagggagccgagatcactgcagctccagcccggtggacagcgagactctgcaaaaaaaaaaaaaaaaaaaaaaaaaagcaagcaggccgggtgcggtggctgacgcgtgtaatcccagcactttgggaggccgaggccggtggatcacctgaagtcaggagttcgagaccaacctggccaatatggagaaacccagtatctactaaaaatacaaaattagccgggcgtggtggcgcacgcctgtaatcccagctactcgggacgctgaggcaggagaattgcttgaacccgggaggcggaggttgcggtgagccgagatcaggccattgcactccaggcctgggcaacaagagcaaaactccgtctcaaaaaaaaaaaaaagggcaaaacacaattcgggtgggaagggcagtgtgcagcgttctccgttgtctgttctgccccgaaaagcttcccccctttaggtttaacctgcgcccccgcgctctgcatcagcgccgcccccgaccccgtgcagttggaaacactgggcgcctccctgccgggccccttcccgcccctgtggtggtgcagccctgcctcccgcaagacagcactgccttcgtgctggacacagttctaccgtggagcctggagtgcctgtagcacaaatccccagaattgggaagtgcccagctttgggccactgtgatccctgggtctttcctgtgcgcgtagtctcatgccgccttccaccctagtcctgtgtcctgtgccccggttcaggatactacaattattctcattatttcatggggttattccagcttttcaggttcttcagtgcctcattccatgaatgctaacttttttcatcctcatagttcctagggttgtctctgaattttcacccagttgcctaccaagatgttgtctgtgtctactgcaggggacggtgcaggtctgaatatcttacagctcacctttttggtgcctttgatccgtgttagaaattatccacatcttctctctgggcaatattctactttttatattgacccaattattttacttctttggtgtgtcttttctcctaacacatatgggttcactttgaaaccttgaaacccacatttacaaaaacattttcaatatgaagcattgttccatgactctttactggagtaccatcaacatttacatttccagaccacccactgcccagtggttttcttggtctcagtactcatgaaaacggtctgaaggtttgttttgggttcctaagtagtagacacacgcacaacattgcctgtcagttatttcttggaaactaaatcagcccttctgttgccatcctatcatgcttcaggggtgcctgtgctagtttttaattatttgtcctaacacttaaatgtttgctcaaacgcccatattaatacttcctctgagtttacaaaaggatttactttcttactggttgggatgaagctgcctgaggttgccacctgttatttttccttcatttattggaccatgtcatcccattacatgtcagccgtggaggttttcaaactgtggtccctggacatgttagaaatgcaaattctcaggccgaaccaggactgaataggaagatctggggtagggtccctccaggactgaatcggaagatctggggtggggtcccccaggactgaatcagaatatcatgggtggggtcccccccaggactgaatcagaagatcggggatggggtcccctccaggactgaatcggaaggtatggggtggggtccccccaggactgaatcggaagatctggggtggggttcccccaggactgaattgcaagatcatgggtggggtcccccagcactgaatcaggaaatctggggtagggtccccccaggactgaatcggaaggtcatgggtggggaccctcaggactgaatcagaagatctggggtagcgtccccccaggactgaatcggaagatctggggtggggtccccccaggactcaattgcaagatcatgggtggggtcccccaggactgaatcaggaaatctggggtagggtccccccaggactgaatcggaaggtcatgggtggggaccctcaggactgaatcggaagatctggggtagcatccccccaggactgaatcggaagatctggggtagggtccccccaggactgaatcggaagatctggggtagggtccccccaggactgaatcggaagatctggggtagcgtccacccaggactgaatagaaagatctggggtggggtcccccaggactgaatcggaagatctggggtagggtccctacaggacaaaatcggaagatctggggtagggtccccccaggactgaatcggaagatctggggtggggtcccccaggactgaatcagatcacgggtggggtcccgccaggactgaatcggaagatctagggtagggtccccccaggactgaatcggaaggtctggggtagggtccctccaggtgatcctgttacacaggttagagaaccacggcattaggggtgggaatttgacaattcttttttttttttttttttttttgagacagagtctcgctcttgttgcccaggctacagtgcagtggcgcactcttggctcactgcaacctccatctcccaggttcaagcaactctcctgcctcagcctctcgagtaactgggattacaggcacccaccatcatgcctggttaattttttgtatttttagagatggggtttcactatgttggtcaggctgagacaattcttaaactgtcattctttactcacttatttgcaggaattcttatgtaaagaactttccctaatcaacaaggtttccctgaattgcaatttgtagagaaaagacaggataattgctgatcttccttcaagtgtccattcccagtgttaggagttagtgccctaggtacctccaagagtgaccaattacatgtgtttggttggttttggctttgaaaccaccactatgaattcatggttttcatgtattagagaccactttctaggtgcttgatgtgtctactgctactggggcagaggtagaaaatgtgtatacggtaaaagaacaacaaatgagttcacgcttatatttctatttcaaatttagtatacggttttacacctttttctcagaaaaatcttgttttattttttgagatagagttttgttcctgttgcccaggctggagtgcagtggcacaatctcggctcactgcaatctctgcctcctgtttcaagcgattctcctgcttcagcctccccaacagctgggattacaggcacctgccaccatgcccagctaatttttcaattttagtagagatggcgtttcaccatgttggccaggctggtctcaaactcctgacctcaggtcatctgcccacctcggcctcccaaagtgctgggacttgggaggattttcccttgccagaaaaatcttagttttagcattaacataattagttattagctttaactcccaccccacataatttcaaaggattaataccaataagacgagtaatggagatgattgattgaaatttaggattcagtggctctatttgtctttagactatggctcactaaatctgcacacttgaagtgctgtgttctagcgatcctctgatgacacatgaggtaataggctgcgtgactgtcaccagcctgatgtgcagttgggctgcagaaccccgtgatgctgcctagcccagccagccccaggtcactcctcagactcaaactcgattctgacaccaccagcacctgggacgctgcctaggggctttctctggtggcaggagcacgtcctggagcaggccaggggtgcccggaattgaccatcctaaacctgtggagtgtgggctggtgaaggaacacaccagctcccacagtgagcacgggcccagctgcccacatgggacccagctcccggacgccgcatgccaccgcctctttcctgtctcacctcccacttcccttcagctgctgctcagggccaccttccaaattttggtctcacggttggagcctgtagaatgcaatccaaggaatttagattcattcatttcagataccattctttcaattttagggactatcttaaaaacttagtttggtaatatgtaaaacacttaacaatttcaaagtccagatattacttcagagtctatttcggtctcacttccaccactgacccctatcctccacagcaaccactttagacttttatctttgtactgttttaagaaaaagcaatatatatttgcatcatatgatatgtactctgccccttatcaataggcgttcctcattcctccttctggtacggagttccccactgcacgaattaatgttcccaatcccctactgatggacattttgattgtttccagttttacaaatgccacagtgaagaactttgtggcaaacacattcaggctgtgaaaagaactctgtgggtaaagtcctttcatttctttgccagagttttttttgaggcagattctagaattgctgagtctaagggcaaatgccatgtcattttgttagatgctgccaaatcctcttccatgaggctgcaacgttctgcattccacagtgactatgagagtccttgtaccccacagcttcataaacaaagcatgacagcaaacctgcacgtttacccatcacacagttgagaaattttatctactttcacctttttttttggttagcatttttattcccagcttttttgtggtataatgcgcagaaggtaatgaacacattctacctgcaagcttcttcctgtgcctttggaatctgctcctgccagtctgcagggaaccacggatctgctttccgtcacgtaggaggcattctcgacaccctctgtacacagcatgcgctttatttggcttctcttacgcagcgtagtgactttcagatttattcaagctgctgcgtgcgccaacagtccactccttcctagtgctgaggcccccatcacatgagcacaactgtttcttgtgtgtgatgtgttgttctctggctgtgcactgccaaaaaagacatcattaaaaaaaatttaaatataatgtaagacctgccttgtcttaggaaacgtttttctggcagtggctcacacctataatcccaatactctgggaggctgaggcaggaggactgcttgagcccaggagtttgggaccagcctgggcaagagggtgaaaccctgtctctaaaaattagccaggcatggtggctcacacctgtagtctcagctcttagggaggttgaggtgggaggactgctggagcccaggaggtggaggctgcagtgagccgagatcacaccactgcactccagcctgggcagcatggcaaaactctgtctctaccaagaaaaaaacaaaaaattaacagaaggaaaaacaaaagggctttcttatcaaaaatacactttaaggaacaaatttatcatattaagttggtgcaaaagtaatcgtggcttttaccattgaaagcaatagcaaaaaccgcaattacttttgcaccaacctaatattattttctaatgacaaacttggaaataactgtcattgttctctaaaaagaacagcctaaaaataaagcagcagcccatttacttctatgccagttcttttagcatttggttatttaaaccggcagtccctaacctttttggcaccagggactggtttcacggaagacactttttccactgacaagtgtggggatggtttggagacgaaacggttccatctcagatcatcagtattagattctcataagcggggcataacctagatccttcgcatgcgcagttcacgacaggattccactcctatgagaatctaatgccaccactgatctgacaggaggcgaggctcacacagcaatgatatgacagggggcggagctcacacagcaatgatatgacagggggcggagctcacacagtaatgatatgacagggggcggagctcacacagtaatgatatgacgggggcggagctcacacagtaatgctctggcagggggcagagctcacagtaatgctctgacgggggcggagctcacacagtaatgatgacgggggcggagctcacacagtattgatgacagggggcagagctcacagtaatgctctggcaggggggcggagctcacacagtaatgctctggcagggggcggagctcacagtaatgctctgacgggggcggagctcacacagtaatgatgatgggggcggagctcacacagtaatgatgacagggggcagagctcacagtaatgctctggcagggggcggagctcacagtaatgctctggcagggggcggagctcagtaatgatctgatgggggcagggctcacacagtaatgctgacaatgggtggagctcacacagtaatgctctggcagggggcggagctcacagtaatgctctggcagggggcggagctcacacagtaatgctccggccgggggaggagctcacacagtaatgatatgacagggggcggagctcacacagtaatgatatgacagggggtggagctcacacagtaatgatatgacggggcggagctcacatagtaatgatcacagggggcggagctcacacagtaatgctctgccagggggcggagctcacacagtaatgctctggcaggggacggagctcacacagtaatactctggcaggggacggagctcacacagtaatgctctggcagggggcggagctcagtaatgttctggcagggggcggagctcacacagtaatgctctgacagggggcggagctcacacagtaatgctctgacagggggcggagctcacagtaatgctctgacagggggcggagctcacacagtaatgctctgacagggggcggagctcacacagtaatgctctgacagggggcggagctcacacagtaatgctctggcagggggtggagctcacagtaatgctctggcagggggcggagcgcacacagtaatgctctgacagggggcggagctcacacagtaatgctctgacggggcggagctcacacagtaatgctctggcagggggtgcagctcacagtaatgctctggcagggggcggagctcacacagtaatgctctgacatggggtggagctcacacagtaatctctggcagggggtggagctcacagtaatgctctgacagggggcggagctcacacagtaatgctctgacggggcggagctcacacagtaatgctctggcagggggcggagctcacacagtaatgctctggcagggggcggagctcacacagtaatgctctggcagggggcggagctcacagtaatgctctggcagggggcggagctcacacagtaatgctctggcagggggcggagctcacagtaatgctctggcagggggccgagctcacacagtaatgctcactggctggctgctcacctcctactgtgtggcctggttcctaacaggccatggactggtaacgatctgtggcctggggactggggaccctgatttaaagaatcgaggacacactcacctagcaaaccatctgccaagaaaaaggaggaaaagcaccaacattaatttgaacttagaaataaactacaataaggccagacatggtggttcacacctataattccagcacttcgggaggccaaggaggaacgatcacttgagcccagcagtttgagaccagcctaggcaacacagtgagaccctgtccctacaattacaaaataaatgagctgggcgtggtggtgcacacctgtagccccaactgctcagaaggctgagtcgggaagatcacctgagctgcccaggagtttgaggctgcagtgagctgagactgcaccactgcactgatcctgtctcaaaaaaaaaaaaaaaaaagaaactacaacaaaatatctggattttgatgtaacagaatacaaagataattacatttgatttttaggtcaacaaatatgactaaagtcacaacagtaaaatattttaaatggatttggaaataaaagaaagtttgttcatttatattttatttaagagctgtgcccagttttatcttgtcacaagaatgaagcaagggacaaagtgccacgctccccggccactgggtgccaatcccccttcaatgtactccttcttccccagagtgcagaagcgtataaagacagttatgacattgacacatgcatgagctattatacataattacaaaagctgattctgtcatcaccgcatcttgtctcatcagtaggagtgaatggctggggggacagtggcacagtcagcctcattcaaagttttgtcgattatgggtctatattccacagtgaccttgaaaagaagtcagtggtaagttaagcacaaaaatgtacaaaaagccatctcttgtgttccttttgaaaaattttaactataaaagtagatttacggcatgtaaactttaaggtatttgctgcagtattttccaataacaaattcaaaaatgatctacatgcgcaacaggggactgtaaatgacggcagatcggtagagtggaacagagcaacgaaaatgacactgtaccagattctcagtgctttgctttacaaaaatgctcccatcatgaaaagtgggagaacccttgtctataccaagacacttcatgtttaaactatctacttccagtttttctacttcaaagtaaatatttatataggtagaacatccctaatccaaacatctgaaattctcccaaatctgaaactttctgagcaccagcatgacattcaaaagaaatgtgctatggagtcagatcttcccattagggatgctcagacagtaagtgtaatgcaaatattccaaagtctgaacaagcctgaaatccaaaacacttctggtcccaacgatttcagagaaggaatactcaagccgtgtattaaatatgcacacacaggaaaaggtaggcacatatacaaagaaatttaaaccataatgggtcatctctggttagtgagctcttatttcaatctctttgtactttctaaaatgagtacgtatttcttgaaaaatcactgaaactggctgggcgtgttggttcatgcctgttggggaggccaagacaggtggatcacttgagctcaggagctcaagactagcctgggcaacgtggcaaaaccccgtctctacaaaacatacaaaaattagccaggcatggtggcatgtgcccgggaggctgaggtgggaggatcacctgagccgaggggaggttgaggctgcagtgagacgagatcgagccaccacatttcagcctgggcaaaagagatgagactctatctcagaacaacaaaaacaaaacaaaaaacctgaacccggaaacattaaaaatagacttgtgctaagcaagtgtgacctctctatactatcaggaaatggccttcatgataaattctgaaaatgacctactgcctgaatcacagacacactagatgatagtgagagtccaaaggtaacttccacagacacagctaagtgattatacgactctcccttacaagttatgaaaagcttaagggtaaaagctttctatcttcatgatttctgaatctcaatgcccagcggaaatgccacacgggtgaactgtgcttgtgtggaacaagctgcaacccccctaccacaccctcggctggctgttcccaagacgctgtgcttgtgtggaacaagctgcaaccccctaccacatcctcggctggctgttcccaggacgctgtgcttgtgtggaacaagctgcaacccccctaccacaccctcggctagctgttcccaggacgctgctcaccccaaccccgcctccatttctgcccttctctgcttgctcagtgcccaggggatgctaagggctgcacctcatcccctctgctcccctgcagatgcttccagttggcccagcccatgggaggagaggggagggatctcttctgggctcccttggctcgggactggtttctggtagtggctgtgtccccactacacagatgctttctcgctaggtccataatcatcatctcttcccctgccaccaggccttggacacttgctcctgcccagtgacgtccatctggcccacaccacagagcaacccttccttaaggctcctctgaaccacctgcaggcactggattctgtttccagcccgaagcccaactgctgtcagagtgcctttttcagcggtgcctcaaatctgtcgggaggtgatttaaatctggcctgctcctctgcgttcaccatcagcaaggccagcccgcagacctgggcggggccgtgtgggtgctgggctgtggtgagaacgagctccacactgaccttcccagtgctgacgtccacataggacagggtgtgcttcctccagtgctcctcaaagggcttcttctgttgcccctggatgggcttggagtgatcgtactcatcaatccgcacctgagcccagaaacaccatcacatttctcattactctaacagagcaatacagaaaaaacacagcaaacgttaaaatgatctaagagacagatgccctagaacccattccatttccacttcagcccaggaggttggcaccatcaacacgttcagaacgcacagaggccacatggctggccagcaatgtgcagccagcagtgagtccagagtaatccatgtccgcatgttcccttagacatcctttatgtacctaagagtttatcaaatactttgtctttttgctccaagcgctgggagactacctcaatcctttctttcagcctgtttttattaaaaacactttttttttcttttgagacagggtctcgctatgtcacctgggctggagcgtaatggtgtgatcacagctcgccagagccttgacttcccgggctcaatcaatcatcctgcctcagcctcctgagcagctggtacctcaggtgtgtaccaccacgcctggctaattttttaatttttgtagagacaggtttcgccatgttgcccaggctggtctagaactccggggctcaagtgatctgcctgcctcagcctcccaaatgctgggattacaggtgggagccactgcatctggcttctattctaattaaaactcgttgtcaccaactaaatttatgctcctggacaggcacagtggctcatgcctgtaatcctagcactttggaaggccaaggtgggtggttcacttgaggtcgggagttcgagaccagcccggccaacatggtgaaaccccatctccactgaaaatacaaaattagccaggcacggtggcatgcgcctgtaaccccagctgcttgggaggctgaggcaggagaatcacttgaacctgggaggcagaggttgcagtgagctgagatcgcaacactgcactctagcctgggggacagtcagactccatctcaaaaaattaaaaatcataaatttattattattctgtattctggcaaacacggattcatatactttgcaggaaagactcttaatatgtatgaggagacgagcaaattctgagcagtgatcacagccatcagcatattctagtggagggtaaatcagtaaaatttcatggtgaataaaaatgattttcccattcactgtgttcagctgactggaaaggctgccaccagccgcccacacatggccctgaaccagcctgtgcgcctgccttgtggagcctttgtccttttgctgatgtggtttatgctgaacttgcatttgcaccccaagcttccctttccgtcgttttttgctatcatatgtgaaaaactcttaccaggcagaatccaacacgtgtgctctgcacaaaaatcagttcatctgaagaacaagtgaccacagggcaggctccgtaatcaaaccacaggacaggctctataataccttttccaaaccacaggacaggttggaaacagtggcttactcgttatttagtaaactggcatttcctccacagggcaggtctgaaacggtgacttacttgttatttaataaactggcatttcctccacagggcaggcttgaaatggtggcttactcgttatttaataaactggcatttcctccacagggcaggcttgaaacggtggcttactcgttatttaataaactggcatttatttcctggtcatgccacgctggctgcacttctaaccttggccttctaacagcaaagcacattggcttggagatgccactgctggcatcagtggatgccgacccaaagcaaggaacaggtcacagtgatccagaaaatggcgagaacccagggatcaaagttaccagagggaaaaaggcattttttggatatacttttggggaaacgacataaaatgcagagaaaatgcaggggtggggctgagtcccaccaggcgggaggaaaaggcaggtgcaggtgggcgtggcgagaaggcgcaccttgtagtcttccccggcgtgcgcgccccgtgactccttccccgcctctgctccattgacggtctgcagcgcacatagcatcaggttctgcagctccagggtctccaccaggtccgtgttccagaccattcctggggacacaaaaagttccatcaggggcaggtgggacccagtcacacgggccctccgagctgtcagcctgggcctgctagtccatggagtcactggttgtggctttacagctgggggccagcacccatccagacagcaagcatggaactaagtcagcactgacgggacagacaccagcccaccctgcagaaggcagggcccaacagtgtgcacagagcccactgtctgctcaccccggtcaaacgtcttcagatgcttcaggtctccatagagcttgctgattttcccacaaccttcttgcaacaagcttcccacacggaacacggcagcatgattttgcgttgactgtggcacaaaatattatttgtaaacttttaattcatagaagcagccataccaagaactgcttaacttttagacctgttgttttgcatttcattttatttatgtaaattaaacagaaaaattaggaaatttagactatgagtttattactctgaacttaaaaatgaagtcttgactaaagcttctgaataaatgtttctattatatacatatcttagacccacacacatcctttccagcgggatacagccaggatccaggacgccaagcagactgcctgtgaggcaccatgttccatacggctccacggccaaccaggcagcgctgcctccccacacccctggcgggactcctgatgtggggtctggtggtgaacgtgacacgagccagcagccctgtggtgatacacacaaggaggaactgagcagagccctgctgatggtggggttggaaccgaaggtcttcaaggagagggaggggcgtgggtggctggggcccttggcccatctggctactgtcttctgcctattttgtagaagctccttgtacactgagttccttcatagttttactatcacgagaaacgtgctgggagtggacctgaagtttacttaggtatgctgggaactgggcatcagcttttgcttcctgtgggacacacaggcaccacctccgtgatccctcctcctccttgcttctccctctaactgtgctttgctccactgaccctaattgtctcttcctctaccaatgcaccttcatggttcaatttggacatttcatctgattttccttagactcatacataatcgtaacactgtaatgcacatcaacctaacggtttttcaggaagaacaaatgaaaaaaattgcatctcagaatctagtattacattctttcatgtccttcagcagcgacgttttcgtatcatcttttcgtatttctggttacattatttcaaggcattttaaattttttgtttgaaatgcgaatgagatatttactgatgtctgagcagattactgctggcacattgcaaagctactgatttttacatacaaatctcttatccacataccttactacattcttgttttgtttctgttagtttttccatttattctctggaaattttttggaaattatatctgtaaataatggaaactgtatctattccttttcaatatttactgccaagaccagctgggtcatggaaaccctaacccagtggcactagaggaagtaaagacacacacacagaaatatagagtgtggagtgggaaatcaggggtctcacagccttcagagccaaaagcctcaaacagagatttacccatgtatttattgacagcaagccagtgataagacttactgaaagtattccttacaggaaataaagggatgggtctggctagttatctgcagcaggagcatgtccttaaggcacagagcgctcatgctattgtttgtggtttaagaacgtcttaagaggttttccgctctgggtgggctaggtgttccttgccctcattacggtaaacccataaccttccagcgtgggcgtcctggccatcacgagcatgtcacatgctgcagagattttgtttatggccagtttatggccacatttgggggcctgtttctaacaatttacctcatttctttttttgattgttactattaatagccagagtcagcagaaaaatcccttcccccaacgaaatgcatttccgcaagcataggaagctctgtttgttcagtgctgactccggcacctcacggagcctgggatacagcaggcaccaagacacaccttgtttggtgggaacacttctagtattctcacttcaaactatctcagatttgccatttctatatcctaaggcatgttcccattctctaacgcaagggttccttctttcccagctggcctccaaccctacaaaagcactgcagggcatcactcagccttctgtgccttagtcacgctgttcttctcaccgttccacaaagcctccctcaagcccagcctcacctgaagaccgaagggcacgggcctctgaaaatgtcagcagggaacctgttctcttgtgtctaacaccaaatgcctttcagaataggactaaagcagtggacttcttcctagaaaatacgcagcaattcttgcaaatagtagacaagagattctcattcatggacaagaatccttgttattagaggaattcagtttcttagactgactatatatcaggttctccacggccccatggctaatggctgccatactggacggcagtcaacatttccatcatcacagacggtcctactggaccgactcccagcagcacaggccacacagatcactgtccaccggccgcccactctccctctctgctgagtatatttaggggcagcaacaggtccagcttaaagacgtttccgagctgctggaagccaggcatgaagacatgatcaatatctgggcctgagatgtaagcaccagtcttgtgttgaactccaggaaacctctaagagaaagctgccctgctggggacggagcttctccggtggtcctgcggctccctctcctccacgctgtgactcatccatgacagccagcgacggtcagggcacggcggtcatgcccaagcacacacaagtgaaccacagaaggctgtcctggatgctaagcagtcactaattctgccctggcctgctgaccttctatgtggagaagaagtgcacttctggtctctttcatattcttgatacagtgaggagtatgtcctactgctgtttacctccagatactggtgcagcctcgtatgtttattgcagcactagtcacaatagcaaagtcatggaatcaacctaagtgcccatcaacggacgaccagataaagaaaatgtggtacatatataccatgaaatactacttggccataaaaaaagaatgcaatcatgtcttccgcagccagacggatggaacgggaggtcactatcctaagtgaagtgactcagaaggtcaagtgtcacacattctcccttggaagtgggagctgaacagtgagtacacatggacacacggagtggactaacagagactgggggctccaaaaagcgggaggggtggggatgagcaattacctgctgagtacaacacacacgacttgggtgacgggtacatgaaaagcccagactccaccacctcccagtacatccacacaaagctgcacctgcatccccctagatctgtttttaaaaaaacaaaaccagtgcagggccaggtatgcagccagcctgctcactccagagcgagtccaggctcttaccttctgcatgctgagtcgcagttccgatgttcttatgcttcttccatcagcaaatctcaatttgtcaacattcgtgacagattcttccccagcatttggtttaattggagggactttatctcctaaaacaacaacaaaaagagctagaatttaacttttgaaaaccgttttaaaaaaacaaatggatttagtacgacacacaaaaatgtagcatagccgctcaaggagcctggaaactgtgtaagtctcctgagctaacacactgccaacccaccctacatctgaggccatctgttgagttggggccaattttaaagaacagacataaaaggcaaaactgttggcacacagtagatatccattaagtgatcttagagtgaataaactagaaatcatctctaaaattaaaaaattaaaatgtaggccgggtgcagtggctcacgcctgtaatcccagcactttaggaggctgaggtaggtgaagcacttgaaatcaggagttcaagagcagcctggccaacgtggcaaaacctcatttctactaaaaacacaaaaattatctggcatgagaactgcttcaacccgaaagatggaggttgcagtgagccgagatcgcgccactgcactccagcctgggcaacagagcgagaccctgtcttacaaaaaaaaaaaaattaaatgtatacagatttatatacattaagtgtatataaatgtcactccactaacgggaaaaaatgacaccttccagatggtggtcccaaggggccggccgccccactgtccttcacattagggggaggaaggtggctgctgtgtgcttgcaagtcacctgctgatttggactattgtgtgctctcatctatacttcaagatttgcaattttttttttttttgagatggaattttgctctgtagcccaggctggagtgcggtggcaccatctcggctcactgcaacctccacctcctggttcaagcaatcctcctgcctcagactctggagtagatgggactacaggagtttgcaaccatacccggctaatttttgtattttcagtagcgatagggtttcaccatgttggccaggctggtctcgaactcctgacctcaggtgagccacctgcctcagcctcccaaagtgctgggatcacatgtgtgagctgctgcacaaggccaagatttgcaactcttgtgtttccaagatgtcttgaaaaaagttttaaaggtttttttttttttataaaattatatatattttttcttcaataagtaacacatgcaggagataggaggtatgaaatgcaggagtccaacaggccctgtcccgcctaccgcctctcctcgggaccaggctgtgggtctcttgacggtctgctcaaatgcttctaggcttgctggtgtctcttttccttttgtttataacgctttaaaaattgatcatccattaaaattgacttttttctttcggtggacagttctacagtttcttttttcttttttttttctttttttgagacagtgtctcctccctctgttgcccaggctggagtgcagtggtgcgatctcggctcacagcaacctccgccttctaggctccaacaatcctcccacctcagcctcccaagtagctgggactacccaagtgtgagccaccatgcccagctaatttttgtatttttggtagagacggggtttcaccaccttgcccaagctggtctcgaactcctgagctcaagcaatcggcctgccttggcctcccaaagtggtgggattataggtgtgagccactgcacccggcctcagttctaccgattttaacacatggatagatgcatgtaaccactttgggaggctgagacaggaggatcacttgaggtcaggagttcaagaccaccctgggcaacacagggagaccctgtccctagaatacatttttaaaaattagccagatgtggtggcgtgcacctgatcgtaccactgcactcaagcctgggtgacagagggagactatgtctaaaaatacacatatatatattttttgggggggtcgggggttgggggagaagtagggatgctacaagcattttttctttccttttcatttttaaaaattaaagcgtaaagatacagtaaaataaactcatcatttttaatgcaggtttttcaaactttgacacacacagagctgtgtctgtaagcctcagcacaatcaggaaacagcctctggcaaccaccaatcccttttcttccctagatgtgccttgtccagaatgtcctatcaataggaccacaggcgtgcagccttttgagtccgactccacagcattctgcgtgagatgctgcatgtgtgagcggtttctcagatgtcaagtatagggtattctcacaaaatgttcttttctgcattttcaaagaaagagaagctcaaaatttctacactgctctgagagaagtggtatcagacctcactgcgacaaagtgcagggctatggagtgagacaagcacaacctgtggcgtcaggaacgaggcacctgaaccccgccttcgccgatgatcagcaacggctggggatgagacgccggctctgcatgtgctggcctcctgagctgtcgtcagatccacagagacacagtgtctgaagtagctacccttttaatactgcctgtacctttctaactacagatagaaaagggcgcacgtttataaggtacggcggtgctagtttttatttcacttgagtccatacaaaaagcaaaaagcgcctgttctataaaaacagcagaaatgatgctaaacagttaacaccagagaaagctaacgggaagaacatgggcctggggtcccaccatccttgccacgcaaacatccaccagtgcctcatccacctcacactgttctgagcacacgaggctgcataacaaccgtgaggatctctggaggtgggaacgatgctaactgtcctgttcttcgcgccctaagaacagggcactaagaccctgtctcaaaaaaaaagaaaaaagactaacctcctgcgccttctcaaatagtctgggtcctgaagaaaacacttaccaggcctgcacgactctgcgatgctcagggcacatgcctgaccagacaaccaggtccaatagcgagtttgccccgaggcggttgacaccatgtgcagaggcacaggcggcctccccacaggcgtacaggccgggcacaatctgatcctggccattcccgtgcctcaggacctgtggaaaggaagatttcaggtgaaatgtcaagatgcccattcctccacaagcccacctccctcaacagggtgtctgtgctgcaggtcagagaaagagagggaagtaggtcgggcatgcagtggctcacgcttgtaatcccagcactttgggaggctgaggcgggtggatcacctgagttcaggggttcgagaactgtctggctaacatggtgaaaccccgtctcaactaaaaatacaaaaattagccaggcatgatggcgggtgcctgtaatcccagctactcgggaggctgaggcagaagaatcgcttgaacctgggaggcggaggttgcagtgaggcgagatcgcgccattgcactccagcctaagtgacagagcgagtctccatctccaagaaacaaagagacggaagtaaagaccgtatctaagaaggaagtaaggaccatagctactcttcttcagagggaaacttccgaatgtataccccagtttcccctctgcccctgagcacctgctgttacaagcaggtcagaggacctccaatgtcagcatctgcgactgtcccccgtgtcccatgttcccgaggccctcaccacctgtgctccagctcagacccaggagcacggcaggtggaggaacatcagcaggggagactgatgttccagactcttctaccccctgttcacctcttcatctatgcggggaaagtaacagcttccacccacctcgcccaacaaggaggctaagtgactgacaagctctgtgtgaaccgcaaaccactcaaaggtatgaattataaagatccctcgatgtacaagatcattagaaatagcaattataaagatcccttgatgtataagctcattagaaataacacaagatcatataggaaagtaattataaaatgggaaaagctgcaaatgatgtatctatgacagtttacttaggaggaataaattattaagcctccttccatcctccactgatagaaatttcaagtgcaatttagaaaacaatacagtactttctttaaggaaacatctgtctcttcctctaagatctaaagagacaactgcaagatgggccccgttgtcccagccttctttccagctgtgggagagaagccagcaccatcacctgcccctcgtagctggtgggaatgccgtccatgttataatgcacggtggggaggacagggatcggctccttcgtgacgtccacaccagcgaagatcatggctgtctctgaaatgccgggcaagggcatggccagctgctctggaggtaggtggtgcagctgcaggtagacgtgatctttctcagggccacagcctctggtaagacagaacaccatcacataaggcagagaatggcaacggcagcagacctgagaatacgtcatcttggaagcgtgtgagttgcaacatgttttgatactgaggaaaatttcccctcatgtacggccaccctcccatcaaatcttttctaagcatctactgtgtgccagggacaatcctaggtgctgggacacagctgagaaccagaacaaatactctgcccttactgaactcacactcgtctcagggatcacagcctgcagcggctgtccttggtaaaagcattaggcctctatgccaaatagtcgtccctgcgtatccgtggcaggttgggtccaggacccccacggacaccaaaatccgtggatgctcaagtccctaatataaaatggcagagtatttgcatataacctatgcacatcctcctccatattttaaatcatcctcatttcaagttttacatttaagttgtacagcaactccaggattactcatagtacctaatacaatgtaaatgcaggtaaatagctgctacactgtgttgcttagcgaacaatgacaaggaaaaaaaaaagtctgcgtgtttgtaaggatgcaattttattttcagtacatagttggttgaaaccacacatgtggaaccgatggatacggagggccaccatattccaaaaaaccatccgacttcttttttttttaatataaaaatgtaaaacctctaaaggccacaccagataccagcagatatttagcaagtgttatcacattaaagaacagggtcaggcaatgaaagagctgcaaactgttcttctgaaaggcaaatgacccacacactttgaaagctgtcgaaaaacatctgtgggtatcagacaccacacccaaggctcacacgccgacttcaggttgggtgcgtgtctctctcttccatactccgtcacatactcacacacactaagagaaactctgttccacagatttgagaaagaaactggctaaaattttcaaaatgtaggtctttaggaaaatatcgcagactaacagatgcctgccggcagctgagagaggtggctgtgcacatgtgcctgcacacgaaggtgagggcgagtggtgctgaaactcacagaagcaaccccggcccgtgtgcccgctcagacagtgctggtggtaaaccacacgcaccttccttcgcggatctccagagtcatccaccgagacaccacatctctagacgccaggtccttcgcgatgggggcgtatcgctccataaacctttcgccttgactgttaatgagaatgcctccctctccacgacatccttccgtaatgagacaaccagcaccatatgtgcctgcaaaaaaccacacatttataacctaacaattgctgggtctctatttcaaatgcattacttttttttacaagatattttttgggggagagacaaaaaagatatgcagaaggcattatatgcaaaactgaacagaaagaacagttaagatacagtagaaagtctggataacaaaaagcactgacaaggctgacagctgcagcagaggctggggcagagtggcgtccccagagaggagaaaggccggcccacagacctctggccaatactctgattacagcccggtgtacgttggatgcctcaaattttgttttaatttttgaacattcttttgcgctacgatactgtggtgactagttaagaatactagcttggagaattcatatctaagttacccaaacagtggcaaggacagtaataatgattattttagttcatctttacactgcacttgctatgggcagttctagctgctttccacatattaaactcatttaagtcttacaacaactctgggtagtacgaccccctttctcagtgacaagcaaattaacgcttggtaacatccagtcatgcagctgaggacagagctcaaacccaaacctgggcagtccggcggtctgtgccccaaacagcggctctgtgactcctcagtgcgatgagaaacagggcgtgccaagctctcgaattttaacaaaggagatcaaaaaccctaaactaaatgtatttcaaaagctacaatttttattagtatacaaaaagggcaatcttgctttcaaaacaagaatgtgattcttgcatctcacctgccttttgattttctaagtttccatgctctcttttctgtggttacttctcacatattgaagacaaagcatgagaagtggagctctaagcaaattacagagggaattcaggggctcactgacattttactgattaaaaacagtaataaaaaatacaacaggccgggtgcagtggctcatggctataatgccagcaccctgaggggccgaggcaggaggatcgcctaagccctggcgtttgagaccagcctgggcttaaaatggtgacaccctgtctctaccaaaaacaaaaaaaccctcaaaaattagctgggcatgctaacacatgcctgtagtcccagctatttgggaggctgaggtggaaggatcgtttgagcctgggagacaaaggctgcagtgagtcgagattgctccactgcactccagcctgggcaacagagcaagaccccatctctaaacaaattaaaaaaaaaaacctacaacaaatccatttcttattttcatcccttccagggatcagaaagctgacactgacagagaaagaaaagacacaggtctggttctttggcaccacttcaggggtctccatcgtccacaggtcagaaaagcaacccagaaaagtccaggacgagtcacctcaaacaagaggcagacgtgtgtgtgtctgtctctgactcattttgaagaacctcctccaaactcaagacttcaactgtcatttctgagttaatgtctccaaattgcacattcgtaacctcaaccgtcagacgtccccaagacaagctcatcttccccacgacaagctccctcagtggtcacgggggctgagcccagcgcccaacgtcacatggggttctctcatggctgtgtcttaactttacatcccattgtcacggaagctctgtgttgtcctacaaagctgaaatctgcctgtgctgcttcttggttccacagcattcacccagctctcagaatgctcactcagtaaaccccgatggagaccctaccatgtgctgggcgtggagcaccccagttaatgagaagacctgcctgcccgaattgctgacgacctcactgcaaagagggacactgaacaattcctgctttacttttttttttttttttttttcagacgaagtcttactctgttgcccaggctggagcgcagtggtgcgatctcggctcactgcaacctctgcctcccaggttcaagcattcctcccgcctcagcctcccaagtagctgggatcacaggtgcatgccaccatgcccagctgatttttttatgtttagtagagatgaggtttcaccatgttgcgcaggctggtcttgaactcctgacctcaggtgatccacctgccttggcctcccaaagtgctgggattacaggcgtgagccaccatgcccggcctcaatccctgctttactgctggcataagtatcaccaaggcagggtttagggctcttgagaaatgcataagatggtggcccaaactgccttagaggaaggggagtgtgggaaaagtctccttaaggaaatgacattgaagttaggacctgagagctaaggaagctgatcttcaaaaccatgttattacataaaactatggaagagcaatgagtaggcaccacacgcttacaagacacacgagccgaacgctttccgggcaaggcgtcctgccctacctgtggggtggaactgaacaaactcgaggtcctggcaaggaaggcctgccctggtgatcatggccgtgccgtcgctggtgctggtgtgggcagacgtgcagctcaagtagttgcgccagtagcctatggaaacaacagagagcagtgactgcacacagtggcccacgtccggacctcctgtctaatgagatcacagaacggacagggcagcccccgggcaccatcttctcagtgctgtgtgcacacaacccccaactcacgcacaccccacacacatcactgggggccatgccagtggtgctgctaccctgcgcaggtaggatagaagcctgggatcagagaagagacttccatttatattttatttatttattttgagatagggtctaactcttgtcgcccaggctggagtacggtggcacaatctcggctcacggcaacctcaggctcccaagttcaagtgattcttctgcctcagcctcccaagtacctgggattacaggtgtgcaccaccacatccaattgatttttgtatttttagtagagactgggtttcgccatgttggccacgctggtctcgaactcctgacctcaggtgatccacccacttcggcctcccaaagtgctgggattacaggcatgagccactatgcgtctggccctgtttgtattttagatttgtgctgttcaaaaggtttccccagtaagcatatactacttttataatgaaaattttaaaatttttatggattttgtttttttcccccagatttactgaggtatgattgatgaattaaacaaaaaacaatactgtatatatttaaggtgtacaacgtgatgatttattttgtgaactgatgacacaatcaacttaatacacatctatcacctcatacaattatcctttttttttggagatacagacacctaaggtctactctcttcgcaaatttcaagttatattaatgatagccaccgtactgtatgattttaactgtagccaccatgctgtataatgttaactctggccaccatgctctataacattaactctagccaccatgctgtttatcagaccttcagaacttcaccttgtgacgggaagttacacctttaatcagcatcgccacagtctgcattcccccagcccctggcaaccactgtcctactctgtttctgtgagttgtgacagttttagatccacatatgagtgacatgcagtatctgtctttctgtgcctgggtcgtttcacttaacataatgactttgggttcatccacgttgtcacacatgacaggatttccttcgttttcatagctgaataatattcagttgtgtacacacaccacattgtcattaaacaccaaaaatttttaggttgtttccatatctcgggtattgtgaataacgctgcaatgaacatgggggtccaggtgtctctttgagcttctgatttcatgccctttggatatacacccagaaatgaggttgctggagcacatggtagtcctgtgacttttgaggaacctccagagttttccacaatagttgtactaatttacattcccaccaacagcacacagggttcccttttctccacatcctcaccaacactatcttttgtcctcttggtaacagccactctaactggagcgagatgagatgatactcattggggttttaatttgcatttctctggtgcttggtgatgttgagcattttttcatacatcaactggccatttgtatgtcttctctggaaaaatatctattcaagtcctttgcccatttttagtagggttgttttttagtagggtttagtaggttggttttagtagggcttttttttattttttattttttttgctattttagatactaagatatcattagatatatggtttggaaaatatttttttcccaacctgtagttttgctgattttttttcttggctgtactgacacttcttaacttttaaagtggctaaagtaactgccactgtataaaattaaagttttttattttcattatgtggagaagacagacttatctatcccaggaatcagtataaacatagaacccactaaaacaagagggattttgccagaaaaccccatgtgactcttcgggccacagtttcctcatctaaaatcgggagaggtacgctgtgaacctgacggcagccactaccgactactgagggccatgctttctcaccccctgaggcaggtgctgctgtcctcaccctttacaggtgaggaaccacggctgggaaaggccatcaccctcacacggttatatcaaggcctgtgtctgaactgctattctacaatgcctctattttccttaaaataaagacactctaaatggaatttattcatttttacaaaggaaataaagtagaaattagattcctaccctgtggcaacaatagtattctttgctcttatgcgatggatggacccgtcctgtatgcacagtgcgaagacaccacggcactccccattctccatcaggagatccaaggcaaaatactccacaaaacagctggtatcatatcgcagagactaaaagaaagaaaaaaaaagggcaagaagtgttaagccaacctttaaggttttaaggtggtatctgctcatgtgaataggtgaaagaacttgatccaaatggaccaggtaaatccaaggagatcagcaagagtgtcaatgacactgtcagagcccgagaggcattccacgcccagcagtaccaacaaggcaggtgtgctagagaacgcagcagcaacagctcctatgttggtgacacatttcctacttctacacaacccgaagaggcactccacactgtccagtggcagcatgcagctccactcggagtctggtgccagagtgaggtccgcagaccatggggtcacagcccagatgggagctactggcaacacataaccacttaattaattaaaataagtcaaaacattcagctcttcagctacacctgccacattagcaacagccccatgtggctggcagctaccaaagcggacggtcgcagacaagcagattccggcaccgcagaaagggaggcgccagacagcgctgcccgcctggacctgccgttccctcagccagcgcaagttgctctcatgagcctgggccagctccccacatgacagctcctgctccggacggagccgccgtctcctcccaccacacacttgtcgatgcactcagccacagagaagtcactggtgttctaacaacctgcacattactgatccgtccccacgcatcagaaaacaacaaagctcagaacatggattactctgaatcaatactgttcaggatattatttggtcatgccaaagttgaccctgattacccagtcactattgtcacctcaagtctttgtccagtgataacagttaatattaaaacaatccatggccgggtgtggtagctcacgcctgtaatcccagcactttgggaggccgaggtgggtggactgcctgagctcaggagttcgggagcagcctgggcaacatgggaaaccctgtctctactaaaatacaaaaaatcagcaaggcgtggcggcgtgcacctgtagtcccagctactctggaggctgaggcaggagaatcgcttgaacccgggaggcagaggttgcagtgagcagagatcgcgccactgcactccagcctgggtgagagtgagactccgtctcaaaaacaaagcaaaacaaaacaaacaaaccaaaccaatccattcaggaactcagaggtggtaaaagagccttaaaatacttcttctttgtctttttttgagacaggtctcctgttgctcaggctggagtgcagtggtatgaacatggctcactgtctcaagtgatcctcctgcctcagcctcctgagtaactgggattacaagcatgtaccaccatgctcagctactttttaaactttctgtagagacagggtctcgctatgttctccagactggtctcaagtgatcctcctgccttggcctcctaaagtgctgggattacagacgtgggccactgtgcctggcctgcttgctctgttcttacatgctgagtgtcacatatcccaagtgaaaacctggtatataagattatcaattcaacttcccaacatagaggcaacaactcacacattgccttaggggcagcttctcaaggcacacgcctgctcctgtcacatccacagtcgctgcatgtgccccacaccgctgttctctgttgctttttacgcaatctctggctgactcactgggcacgctaacccattccccgctgtcaccacaagccccagcactacgtgtcctgtctcaggtggacggggggcggccttaccctcccgtataaggtgtgcaatattgagtggccggtccgatcagccacacagcagcacccatgggcctgcccgccctttccaaacttgaggctgtgtccgccaaatgcacgctgataaatcttcccatcttcagttctgctaaacggcatgccataattttctacctgtgaaagataaaaacaaacaaaagccttattaacctaaaggagtcaagatattcacagctaatctacactaaacaactttaatacaaatctgcaaacccaaattaacctattttatgaaaatgtcaacacttcatcaaagagaagtttttcttattacatgtaatacatagttcatgacggacaaagacttctctgtgagctttgctaatcaccattctttcggctgccacatctgcctcaactgcttacattttttccaggactcttgtactagaaacagaccaccagagcacccagagcctcccgcccatcaccgcgaccatggcagtgggggcctgctccgtcacgtagtggatggcatcctggtcccccagccagtcggagcccttcacggtgtcatagaaatgccacctccagttgtcctcctccatgttccccagagcagcattgattccaacctggaaacaccaaccactccttacaagccacaaacaggaaccccagctttgtcttccaggcccaaatccacccgctgggggattcagagaaagccaactactcacgcggtgactcccagtgagggctgacctcagcagaggagcagccaggcctgacagattccagatcacaacccctcccagactcacccagtgattccatcccttagcctcagtctcctcatctgtgtggtggagacagagggaactccaggaagggctgactggagcagtgagtgaaaggctacctgtaatatgcttattacctaacgtatctggcacagaaaaggtactccatgaatctctccgcataattttattaacaaatcttcccaacggcatttacgggcatgtgttaaagatcagaagtgcttcctgccaagtaataaactccatactcagagtcgcactcccctgtacccctacttcctttggctgtgtgtgcccaccaccgtcttacccctcagagagtcccagaagacagcagcacagggacaaatgaaacccttgcccttttcttccccaacctaaattctgaatcctcctctttagatgatctccttttcttaaggtgttggggtggcaggggtgggtggggagggtagatggtcagagaaaacccaagtgtgactggagtctgaattaagagtgacaacaaggctcccgcccttcaaagtccccagggaagaggctccagggagagacccctgaatgggtgagctgagtaaggcacagcaagaggccaagtggctggagcacggggaggaggcaggaggctgcccaggtagaaagtgcgaggctgcgcgggacctgcacggagtgggagcacagtggggcacctttctcttacctgcgctgcaacagtgtgtgacctggtaggaaacagcttggtaacacatgctgtatcaaactctgcctcggaaaggccaaatgcagctcgcaaagccggcccctccagcgcctaccaccactgcatcaaattcatgatccactactggatactgagcagaaatctggaaaagaaaaattcacctgtcaatcacaggttccactatgccaaacatgaagactcttgtgccagtgaaagagcttgacaaagataaaaggagcaactgctgggcacacagggcctccatcctgtcctggggctgagccctgaacagtgcggggagaagtaggcacattcgcacctggagaagggactgataatcagattctatgaatggtagagggtctattccatgggatcagactgaggaccacaactctacttcagggccgtgcctatgcttatgcctgagaaggtgccaaggagcattcagtcgctattgtgagcttatgagaaaagaacttctcagcacgtttcagttttccaacagagagagaacaggcacactcaataccaaggaacccacaccggaagggccccacggtcctcttttcagtaggattttatcatctatcacagcagatactgttcattttaatttattgctttacttgacctaaatttaaatctaatttatagatacataacagatacaagtaaaaatgttaacatctatgtttatatttgtacttgcaattaagtattattacactgaaaataatttcagcatgcattggatacctatgagaaatttttcccttatgtctatgactcatatgaaaacaaactggtatagatccttacccccaagccaaaaaaatcatttataatggaacaaaaagcatgaacttacggaatctgaaactttagcagatgccctctcgttccttcaacagtgaagtgaacacctcgggttcctgtttgcaacactgttggccactggagacacagaagacacagatccagagggttagtgtcctgaaggaacaaatgctgtgggggatagtaattcaaacttccccttgcaaactgttcaccttcttatgtacccaggtgctcctgtgcatccagagagctcagctgggaccctctacttaaccctgaagggcagcccaaggggcaaggaaggactgagcccccaggtcctcctttccaccctggcttggcactctagaaaaccaggatgaagcttgtttccaaaaaggatactcactgactcagatacgagatgaaaaagacgcacttcctctgggaagtcttcacttatgctacttagtggaggaggggaaagacatccagatcgtattactgtatgtggtattttgcaaataatgaagcattttaaccggctccatcagagccctttccacattacagttccaatcgtccaggagggcttgcggtcagttcaaaaggcactggacacctgaatcaggagatctgtatcctgcaacagtaaaggctgacagcccagagggaagaggtgtcatcccttcatcacacaggaggatgtcggatgcacactctcccctgcctggttgctgctggctttttcctggccaacgtctacaacttgacatatctcgctgcttaaattttccatcttagaaacctttactcaagaaaactggttttagtgtttagtttttagtggctctgtgtgagagaggtcacactgtcccatatgctaaggttggccagccatttaggggatacgttttccattctgctggcggcattttagaagaccactgaatagtctcagaaatatcatcaagaatagttttaggggctgggcgcggtggctcatgcctgtaatcccagcattttgggaggccaaggtgggcagatcacctgaagtcaggagttcgagaccagtctggccaacatggcaaaaccccctctctactaaaaattagctggtcgtggtggcgggcacctgtaatcccagctacttgggaagctgaggcaggagaatcgcttgaacccaggaggcagaggttgcagtgagccgagactgtgccactgtactccggcctgggcgacagagcgagacaatgtctccaaaaaacaaaagaaaaaaaaaagctttaggaaattatgcactcagcaatcagaagaggggatgtgagggatgtcttcaagtatttagaaatacttgcaattcacaaattacttattatgtgggataaaaaattattcttcatttctccaatttctagtctgtttttattgacataagctaatttagttttttcttttttcagaaaatgagaaagaacgaatattcttctaccttagtataattttttacatggtaaaatcatattttaagaaagaagtctttgaaataattttaataaaaacgttcttgaaaattttgtaaagtgccccattaacataggtaatagcaccaataaaaacagtacattataccaaatgtaagtagaaacagtgagatcactaaatgtttattcgttctttctaggatgttgatgtggaatacacactgcccaccccccaccacacacacacagctggcttaaaaggggcagctactataacacaatcttgaacaaatcatcacgccatccccctggggaaaaggacactaaccctctgcatctaaatctcatctggggcagatatttgaatctggaaagcccaacttcaagtcaatgtcagtctttagataaaactcaaaactacttttgacacaaaactagtcttttgtgccaattattaattttttaggagaaactatcaaacatttcctctaagaaaaaaaatggggaacatataactaaaaggaatacttagaccttgcttaacaatacagaatttcagatgactgaatcaggaggtggagggggaaaagtaacaagtgcagagacattcatatccgaaatctagcaaagtaaggggtcctcatcgaataaaatgcacctataaatcatgagcaagaaacgaatctgcatgtacaacctacacaatcacaaaagcagccaacgaagaacccaaaaacgcacgactttctgtaggaaaagctaccttcatcaagataaaaagacttttacaaaacccaagactaaattttggttccattttgctatcttgccatctggtctgaggtgcctggggccttagtctgcagaaggaacactgggcaccatctgggttggggacaaaggcactggctctatctagcttctctccaaccacaagctaccagtgcccctaaaaagtcccactgaccatgggcttcacctcctgcttgtggacgccctcccagcagctcctaagagcccaagatgcggcgggggtctctgcttggtcagcaccaaccacagcaacacgctagaacggtttacacgctttccgatgttgacaggatggctgtatgactaatcctcacatttaattcaaagagattttcaataactatttcaaaaaggagaaaattgcacaatcacaggcataattcaaatcactattgctgaatgccttggttcctattgagatttttactctgcaatttaaaattactttgtaattaagaggtgggtggctaagttcatttaaaagaaccaaacaactaaacctatccaatttcgcttgattaaataaaatcctagaaggccgattctgaagatgcaatcgtagagggcacactcagacactcagagagcaagggctcagggaagtataaccctgaccatcatcctggactaagccgagcccggccctcgaggtactcagcgcacaggcaagcacaggtcctggagtcctcgctcggtcagtgccctgagctctccgtctgatttttaaaaactggcacagctgcttttaaacaccggcacatttttgtggcacaagggccaccaaacgggacccaaagtacaggtccttaacttccaagatcccgaagtggacatgcacagatttgcgctctctggaaaggggaactgcaagcccaagctcgggcgcgccgcgcttcccaccggacacccacccggccgagcccggccactcctcgcacccacccgggcggtttcacccgccccgccggccccacccacgggctgcgggcggccccgcaggacaaccctcacagacggcggcagaggcccggcccagccaggactccaccccggtgaccctgggcagacacgactcctccccgagtccacccgccaggcagaggcgaggggctacctcagcccgcgaggtcgccggaccccaggcccggaccaaagcggcggaggggacgcccagcaagcccgcggggtcgcgaccttcaccgggacgcggcctacctgctaaggaccgagctccccaggcccccgagtacactccgcggctccccctcgcaccggcccagggctctcccagccccttcccgatccccgggcagggggcgcggggacccggcgcccgctccgctcggacccgctggggaccgtcccgctcctaccgccgcctcgccccccgcctgccctgccccggtccgcggcagggactcaccgccttggccagcgccagcgccaggcgccgagcgcttggcaaccgcgacaggccccggacccccgacacgtctgtagtcgccgccgcgcagtcccgccagtccctgcgcagactgcgcctgcgcaccacggccgggtcaaggcggggcgctagtgggggacattgcgcctgcgcaccacgcgacgcccgggccggggtctaatgggcggggacgccgcgcctgcgcaaagcggacccgcggaccgtggcgctgggtggccacggaggtcccgcgctccccgaccgagatagggcgggccctatttcggggagatgttgggcaccaactttttttaaagccccgtgggtggttctccgggatctcccagaccgagagggcctgaacgtccagacctcagggaatggggtcgaaggggcggcgctcgtccgcggaggtgggcgggagcggcccggggcctccggcctctagggagcgggagtgaccctcggtttctggcctccgaggggcgggagcgatcctcagccatgtccctagcctctggcttccggctgatttttaaatttttggtagaggcgggaatcttgctctgttgcccaggctggtctcgaacttgtggcctcaagcgatcctccctcctcggtctcccgaagtgcggggattacagacagagccactgcgcacggccgtggtcagctttgaaagctgggtagatccctttggctcatacgcctttctgctagcttaccctgattctgcttctggttcagatagtattttaatatttctagtgtgtctttttgtaagatacctgaaatctttttgtggaatgaagtggcatgaaaaataaaccaataatcattagtaattatgtttcctgccttttcactttattaaaatcttcgtcttgtgcatcatgtttaacaattttgagttattttagtaaatttgcaagggttcggtcccattttattgatatttgggttgtttcctatttttgctcttaataacaccgtacagaacatatttgtgaccataactttctctttaggattattttttttagatgtatgccccagacgtggcctttattggcttgcagggaatgaacatcatacctcctagacttatttttttaaagttatgctgttttagtcctgggttagttacctaattttgtttggtttgagacggagtttcgctcttgttgcccaggctggagtggaatggcgggatctcggctcaccgcaacgtctgcctccagggttcaagagattctcccgcggagcttacagtgagcggagatggcgccacttcactccagcctgggcaacagagcaagactatattgctttaatttactctgccggctatctggagagatgcaacctcatcagcagaaattatttccacctgctgctttttaaatgttatttcctatagccaggtactgagcccttcaattgaggtctaaaccctccaccctctccctccgggattgccaagcctgtggtttcagttccatgctcccaggtagattatgtcaactcaaagtcaatgcgcttatgaaatactttttgtggtttttttcttaattttaagaggttttttttttaaatatgtttttgtttcatggaggcgacaccctctgtctctgagttgtgggagccttcctccttcagtctgcatgtactgaagccactgtttgccgtacagcccctcagccgcagcagcccacagtgaggtgcaggtgctcacgccatcgccccagagagctcctccattcgcccctccacccgtagcccctcgaaaccactgccctgctccccgacacggtacactgtcttctccaagatgtcatgtgttggcatccttcggcctgtggccaccgaaactagcttccttcaccgggcatgtagcctgggagacctggggcatttgggtgcatctttccactgctggttggtgtcccctatgtggaagcatccgcgttggttcacgccttctcctgctcctgccgatggacattttgttttcttccagttattggcaatgaggaatgaggcctaaacacttgtgtgcaggtttgtgtgtgcacgtttaagttttcccttgggggacatttcagcagtggggttgctggatgacatggtaaggatgtgcttaacttcttaagaaactcccggaccactttccagcatggcgggacccctcccattcccactgcagcttatgagggtcccagttcctctgcatcatcactagaacctgggttggcccatgggttttgtctgtttttagccattttaatggatttgcagaggtactgctgactggcatttctccagcatctctatgatgttgagcctctttctcgggcaatatgccctccttataccttctttcatgaggcctccattccaatattggccctctctttaatactggggtttttactttcttatggttaagttttgatggttcttcatatatcctgcgtgccagtaggttgtgagacgtgtgattcacaaatgtttatttctagaccatagtttgtgtttcattctctttggatttttatattgctttatagaattataattttaaatttatgactacatttaatttgtcaatcttatgaatcatgcttttggtgtcatgtctaagaacttttcgcctaaccccaggccatacgaattttcccctgtgtttttacctaagggtttgatagcgttaggttctccatttaggcctttaataaatgttgtgtaacattttgtgaccgccatggccatacctttctccatctctcacggtatcgtgggcatttgcagctcccagtgcgccgtgctgttcccgtcttcttggtctgctcctcctgtcatacctttctccgtctctcacagtatcgtgggcgtttgcagctcccagtgccccgtgctgttcctggcttcttggtccgctcttcctgtgagttccagggcacgtcttagtgctggcactgtcctggtccatcgggggtcccatgagcttctccatgtgggaaggttgggactgtgatgttgacgggatgccctgtgagtcaggaggaggtgctgacgggggtttccatgtaggagagagaggtgtttggtattccggatggggcagacttgagaggggacaaacttgagaaatgccaccaatgagaagtgcaggcacagcaggtctcggggctgcccagccgtgtgggagccaaacgtggatgtgtcagtggccacaccaggaggtaaaccctcaaccaagggcctctgggtgtccaagaccaagtcttgctcaagaggtgtgttcagctgagccaaccatggcagaaatgcataagggagatcccacggttcctctgtttaaatcccctgctaatcccaccagactcagagaagcagccaagtcctcacagcagcctgcaacccccgcctgactcggcctcctcttggctctgattctctgtacccttctatccctgtctcttcttccatcagagaggagatccggcacgtttatcctggtggattcaaacccatctttgccccatatatagtcaccggaatgaataggtataatctagaaagagtccttttgaaaaagaaaaaagcaggccgggcatggtggctcatgcctataaccctgcagggaccagccccacagggtcggtgggtctctccctgtgtgcggcgatgagagagtgtagaaataaagacacaagacaaagagataagagaaagggcagctgggcccgggggaccactaccaccaatgcacggagaacagtagtgccccgaatgtctggctgcgctgttatttattggatacaaggcagaaggggcagggtaaagaatgtgagtcacctccaatgataggtaaggtcacgtgggtcacgtgtccactggacagggggcccttccctgcctggcagccgaggcagagagggagaggagacagagagaaagacagcttatgccattatttccgcatatcagggactattagtatttttactaatttactactgctatctagaaggcagagccaggtgtacaggatgaaacatgaaggcggactaggagcgtgaccactgaagcacagcatcacagggagacggttaggcctccggataactgcaggcgagcctgcctgatgtcaggccctccacaagaggaggaggagcagagtcttctctaaactcccctggggaaagggagaccgccccccccttctttcccggtctgctaagtatcgggtgttgttccttgacaccttttgctaccgctggaccacgatccacctggtaacgggcgtcttcacagacgctggcatcaccgctagaccaaggagccctctggtggcccggtccgggcataacagaaggttcgcactcttgtcttctggtcacacctcactatgtcccctcagctcctatctctgtatggcctggtttttcctaggctacgattatagagcaaggattatcataatattggaataaaaagtaattgctacaaactaatgattaatgatattcatatataatcatatctaagatctatatctggtataactattcttgttttatattttattatactggaacagctcgtgtcctctgtctcttgcctcggtgcctgggtggcttgccacccacataatcccagcactttgggaggctgaggtgggagaatcacctgaggtcagaagtttcagaccagcctggacaacatggtgaaaccccatctgtagtaaacatataaaaattagctgggcgtggtggtgcgtgcctgtaatcccagccacttgggaggctgaggcaggagaatcatttgaacccagaagatggaggttgcagtgagctgagatcgcgccactgcactccagcctgggtggcagagtgatattctgtctcaaaaacatagtaataggaataataaaggaaaagtgcaaaaattcaaacaacttaacagaaactgggcaaaagagctgaaccggccctccacagaagaggaaatgtggaggaatggctaatgaaaacatgaagaggggctcagcctaacagggggagatatcatgtgacacccaccagacgggcaaaaatcccaccacccaatccatgcaggtgttggggagaatggagagaagcaggaacaccaggcactgctaagaacgcttgtgaagtatatttctgctatgcttgtatatgaaagagtgtgtgttgtgggttatgaggaaaattacatttcttacctgggatgaaattttaaaacttgaaagctactgaccagaagaaacttgcacttgtgtacaaaagaaacgcccaagaacgttcccaacaaaacacagtcctaagggccccaacctggccaaaccctcatccacgggaagatgaagacatttcccatgctcccctcagacgacgggagaccatgcagcaatgaaaatgagccatgtcagtgtgggtgggtctcagggagagaatggaggacaaaaatagacacagagcaggtgctcagagccatgcagtgcaggagcagccacgcaggagaattccctcacgtcaaagttcaaaactacagccgaggcaacagagcaagaccctgcctcaaaaagaaaacagaaagttcaaaaactaaatggcttattttttagggatgtacacacacggtgaaagaaatgtactatgaaggaaagtgtgcaaataataaagactaaggcaagaagtgattccctccgtaggagaagggaagggactgggactcaggcagggcctccagggagcatccaaagctatgtctcttcagattctcctccctaaacttggtggaggtcctctgtgtccaatgtgtcaatattctttataccttacccatactgtacaaatgctttatttctattcaatatttagaagacagttataaacaggatgcattcaatagcaaggtggcagatgaacatcaggaaggaacatccatgagcttccatccacggaacctcaccatggatacgcttgtgatcaagggcctggtctcccctcaagacacggtcacagatcagaggccacaccatcctagcagtggagcaggaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgacgtgccaggcgccatgttggagggctggtggtagcggcttggggaggtgctcactctgtcggtctcactctctcacacgcttcccctggctcccttcgttcccccccaccccacttggcctgcgtgctggagggtgtgcgagggagtgggaggacgtcggggggtggggggaggcgttccggtccccaagagacccgcggagggaggcggaggctgtgagggactccgggaagccatggacgtcgacaggctccaggaggcactggaagattttgagaagaggcgaaaaagaaagtctgtcctgtcctggatcagctcctttgtcatgtagccaagactggagaaacagattccgtggtcccaatttaaaggctattttattttcaaactggagaaagtgatggatgatttcagaacttcagctcctgtgccaagaggtcctcccaaccctaatgtcgaatatattccctttgatgcaacaaagggaagaatactgaaaactgtcactggatttaaccgtatcccttttactattcagcgactattgaattgttaacagatccaaggagaaactatacaggaacagacaaatttctcagaggagtagaaaagaacgtgatggttgttagctgtgtttatccttcttcagagaaaaacaattccaatagtttaaatcgaatgaatggtgtgatgtttcctggaaatgcaccaagctatactgagaggtctaatataaatgggcctgggacacccaggccacgtaatcgaccaaaggtttctctgtcagcccccatgacaacaaatgggtggcctgatagcacagacagcaaagaggcaaatttgcagcaaaatgaagagaaaactcacagtgactcttcgacatctgaatcagaagtttcctcagtgagccctttgagaaataaacatccagatgaagatgctgtggaagctgaggggcatgaggtaaaaagactcaggtttgacaaaaaggcgaagtcggagaaatagccagtcaagcgacttgcagcgaaatttcttcagttgtggtagaagaaacagaagcatcaccttcatcccatgataaagacaaagaaagccgtggtacccggcagcgcgttcagaagaggatgaagaagatgaagaggaagaagaagggattgagagaccatctgtaaaagggaggagtaaggagatcctcaaattcttgcattcattgttttcgtgaaagaactgtacatcatggaactccttgtaatgccgacgctgggcttttctcccacctgtatgcagttgctgctgaatttcaggggatgtgatttgaactacagaacatcagaattcatgaaacttaactgtggaggtattttgaaaataaaatttaagtacaacaacatttgcttagttttagagtcttttatgacatcaagagaaatgatcccagaaagaaataaacaagaaaaagaatctgatgatgcctcaactgtgaatgaagagacttctgaggaaaataatgaaatggaggaatctgatgtgtctcaagctgagaaagatttactacattctgaaggtagtgaaaacgaaggccctgaaagtagtggttcttctgactgccgtgaaacagaagaattagtaggatccaattccagtaaaactggagagattctttcagaatcatccatggaaaatgatgacgaagccacagaagtcaccgatgaaccaatggaacaagactatttagaaacatttacatgcagtattttacacacagttctggttttaacaccgtataaaacttttatgttaaaacgcgcacctttagttttacaagaaaagcaggttgtaaaataaagtactttatggataattcctgaaagagttgtccatgtaagaactgtgaatatcagctcctctgggtcctgcttacgttaccactgatttctttctttctttctttctttctttctttttttggtctgggcaaatcagtggtttgtatatagattttttttaaaaatttaggattaaagtttttaaactggaaagtaattataattttgaacagttttttgagattatcacatttagtttatacatatgcaagaagctttttgtcttgtgtctttctgatagctctagcagttttcatattttggtcatagtttcaacattttaacatgtgaataatagggtttcatgctggtttccagattgtattgttcggctacatacaatggaaccttaagttgtgtatatatatatatattattctaagggggaaaatgttatatttttctgtttgtataagagatgaatacagtggatactttttctattggtaatgactgagttcacctctttcagaagacattttctttctcttctgagtaactgaaataaaatctggcctttgtgaaaccctggaaataccacgaccctcaactagaaacaccaataccagctcctccgtgagttcccagctccacaacctaagacatcagaggcagcattggttcctcacgtagattccagctccgggacccccatatttgaaccgcaagaccatctcatccctggatctccagctgcaccacactcaaattagaacaacatcagctcctccccaggtctccacctgcacagccctcaaacgggaacgtcagctcctccccgggtctccagctgcagggccctaaaactagaacatcagctcccgcctgggtcgctagctgcaccaccctcaaactggaacatcagatccccatgggtctccagctgcagggccctcaaactggaacatcagctccccaccagatctccagctgcatggacctcaaactggaacatcagcaacccgccgggtctccagctgcactgcctgcaaactggaacatgagctccctgccgggtctccagctgcttggccctcaaactggagcatcagctccccaccagatctccaggtgcatggccctcaaactggaatatcagttccaccctggggctccaggtgcacagccctcaacctgcaacatcagctctccactgggactccagatgcacggccctcaaactggaacatcagctccctgccgggtctccagatgcacggcctgcaaactggaacatcagctcccgtcaggtctccagctgcacggccctcaaactggaatatcagctccaccccggggctccaggtgcacagccctcaaactgcaacatcagctctcagccaggtacccagctgcatggccctcaaactgcaacatcagttcccccccgggtctccagcttcacggccctcaaactggaacatcagctccccaaccaggtctccagctccacggccctcaacctgcaacatcagctccccaccagatctccagatgcacggccctcaaactggaacatcggctccccacagggtctccagctgcatggacttaaactggaacatcagctcccaggccctcaaacaggaacatcagctcccaggccctcaaacaggaacatcagctccccacagggtctccagctgcatggccctcaaattgcaacatcagttccccgctgggtctccagctgcaccgcttcaaactgcaacatcagttcccccctgggtctccagctgcaccacttcaaactgcaacatcagctccccgctgggtctccagcagcatggccctcaacctggaacatcagctcccccgaacccgggtctccagctccacagccctcaacctggaacatcagctccccccaacccgggtctccagctccacggccctcaaactggaacatcagctccctgccgggtatccagttgcacggccctcaaactggaacatcagctccccaccaggtctccagctgcacggccctcacactggaacatcagctccccaccagatctccagctgcacggctctcaaacaggaacatcagctccccacagggtctccagctgcacggccctcaaactgcaacatcggttcccccctgggtctccagctacaccgcgtcaacctggaacttcagctcccccccgggtctccagctccatggccctcaacctgcaacactggctccccaccgggtctccagatgcacagccctcaaactggaacatcaactccccaccgggtatacagctgcatggccttaaactggaacatcagctccctgcccaggtctccacatgcacagccctcaaactggaacatcagctccccgccaggtctccaggagcacggacctcaaactggaacatcagctccctgccaggtcaccagctgcatggccctcaaactgggacatcacctccccacgaggtctccagctgcatggccctcaaattgcaacatcagctcccatcagagtctccagctgcatggccatcaaactggaacatcagctccccggccctcaaaccggaacatcagctccccgccggatctccagctgcacagccgtcaacatcagctcctccccgagtcctcagctgcacgaccctcaagttagaacatcagcttctccccaagtcttcagctgcgtgaccctcaatctagaacatcagttcttctctgggtctgcagctgcaagaccctgaaactacatcagcttctctccagttctgcagctgcaagaccctcaaactacaacatcagcttccctccaggtctccagttccatgaccctaaatctagaacatcagctccttcctgagtctccaactgaaagaccctcaaagcgaacaacatcagttcctccccgagtcttcagctgcacgacactcaatctacaacatcagctcctgtctggttctccagctgcacgaccctcaaactacaacctcagctcttccccgagtcttctgctgcatgaccctcaatctagaacataagctcctctctgggtgtccacctgtagggacctcaaattagaacgtcagctcctcccagagtcttcagctgcatgaccctcaatctttaacatcagctcctctccaggtctgcagctccatgaccctaaaaatacatgagcagctcctccctgaatcttcagctgtacgaccctcaaactacaacatcagctcctgtctgcacctccagctgcagagccctcaaactagaatatcagctcctccccgagtcttcagctgcacgaccctcaaactagaacatcagctcctgtacagatttccaactgtagggccctcaaactagaacatcagctcctccccgagtcggcagctgcaagaccctcaaattaccaactcagctcctcccggagtcttcagctgcatgaccctcaatctcgaacatcagatactctctgggtctgcagctgtagggccctcaatctagaacatcagctcctcccgagtcttcagctgcatgactctcaaactagaacctcagctcctccccgagtcttcagctgcacgacccttaatctagaacctcagctcctcccgagtcttcagctgcacgaccctcaatctagaacatcagctcctctccaggtttgcagaagaccctcaaactagaacatcagcttctccctgagtcttcacctgcatgaccctcaatctagaacatcagctcctctgcaggtttgcagctgcaagaccctcaaactacaacatcagctcctctccaggtctgcagctgcaagaccctcaaactggaacatcagctcctctccaggtctgcagctgcaagaccctcaaactagaacatcagctcctccctgagtcttcacctgcatgaccctcaatctagaacatcagctcctctccaggtctgcagctgcaagaccttcaaactagaacatcagctcctctccaggtctgcagctgcaagaccctcaaactagaacatcagctcctgcccgagtcttcagcagcatgaccctcaatctagaacatcagctcctctctggatctgcagctgcaagaccctgaaactagaacatcatcttctctccaggtctccagttccgtgactctaaatctagaacatcagctcctccctgagtctccaactgaaagaccctcaacgcgaaaaacatcatctcctccccaagtctgcagctgcaagaccctcaaactagaacatcagctcctccccaggtctgcagctgcacgaccctcaatctagaacatcagctccaccccaggtcttcagctgcacgaccctcaaactagaacatcagctcctccctgggtctgcagctggaagatccactaactagaacatcaactcctgtctgggtctccagctccatgaccctcaatcaagattatcagctcctccctgaatcaccagctgaaagaccctcaatgtgaacaacatcagctcctccccgagtcctcaactgcaccaccctcaaactacaacaccagctcctccccgagtcttcagctgcaggaccctcaatctagaacatcagctcctccccgagtcttcagctgcacgaccctcaatctagaacatcagctcctctccgcgtctgcagctagaagatccactaactagaacattagctcctgtccaggtctccagctccatgaccctcaatcaagattatcagctcctccctgagtctctagctgaaaggctctcaatgcaaacaacattagctcctccccaagtcctcaacagtgcgaccctcaaactagaccatcagctcctccccgagtcttcagctgcacgaccctcaatctagaacatcagctcctctccaggtctgcagctgcaagaacctaaaagtagaacatcacctactccctgggtctgcagctggaagatccactaactagaacatcagctcctgtccgggtctccagctccatgaccctcaatcaagattatcagctcctccctgaatctccacctgaaagaccctcaacgagaacaacatcagctcctccctgagtcctcaactgcatgaccctcaaactacaatatgagctcctcgccgagtcttcagctgcacgaccctcaatctagaacatcagctcctctccgtgtctgcagctagaagatccactaactagcacattagctcctgtccgggtctccagctccatgacccacagtcaagattatcagctcctccctgagtctccagctgaaagactctcaacgcaaacaacattagctcctccccgagtcttcaacagcgcgaccctcaaactacaacttcagctcctccccgagttcagctgcacgaccctcaatctagaacatcagctcctctccgcgtctgcagctgcaagaacctaagagtagaacatcagctcctccccgagtctccacctgaaagaccctcaatgagaacaacatcagctcctccccgagtcctccactgcatgaccctaaaactacaacatcagctcctcgccgagtcttcagctacatgaccctcaatctagaacatcagctcctctccaggtctgcagctgcaagaacataaaagtagaacatcatctcctccctgggtctgcaactggaagatccactaactagaatatcagctcctgtccgggactccagctccatgaccctcagtcaagattatcagctcctccctgagtctccacctgaaagaccctcaatgcgaacaacatcagctcctccctgagtcttcagctgcacgaccctcaatctagaacatcagctcctccctgagtcttcagctgcaacaatctaaaactagaacatgagctcctccctgagtctccagctgaaagaccctcaacgtgaacatcagctcctccccgagtcctcaacagcgcgaccctcaaactacaacatcagctcctccccgagtcttcagctgcatgaccctcaatctagaacatcagctcctctccgggtctgcagctgcaagaacctaaaactagaacatcagctcctccctgggtctgcagctggaagatccactaactagaacatcagctcctgtccgggtctccagctccatgaccctcattcaagattatcagctcctccaagtctccagtgaaagaccctcaacgcgaacaacatcagctccaccccgagtcctcaactgcacgaccctcaaactacaacatcagctcctccccgagtcttcagctgcatgaccctcaatctagaacatcagctcctctccggatctgcagctgcaagaccctcaaactagaacatcagctcctctccgggtctgcagctgcagggccctgaaggtagagcatcagctgctccccgagctagaacacctgtcccacctggatctccagctccacgaccctcacagaagaacagccacactggctccttcattgtcttcagctccacaacctaagacatcagtggcagcaccggctcctccctggacgtccagctcaacgactctcatagacttaaaaggcagcacctgctcctccccaaggctccaactccaccaccctcggatttgaacagcggtagcaccacctcctctccaggtcttcagccccacgtccctccctgaacaatcccttcttgtgaaattcagcagtcaagaaatctgcagcgaaagtaaatgaataaatgttttgttttcaagtctatgtctcttttatgttcaggcaagtcagttaactattctactttccattaatcttgcaatctacttatgtccaatgtgagatagaaacacaccatttgaaaacacgtttaaaaacttagtaatttttaaagtatgatcacacagctgtagatacgatcttatttctctctgcctgtgcagaagtcttatgaaaattcaaactgaatttaccatgttgagattcccagaatacacattaatcccaaatgttactcccctccttaaaatcttttaacatattcccatcacccgagcataaatgccagctcccatccacagcccaaagtgcccagcacggccctgccctctgccctcgcctatggtctcctctctggtgcccggcccggccctctccacccctctgccctggcctatgttctcccctcttaaatgccagctcccatccacagcccaaagtgcccagcacggccctgccctctgccctggcctatggtctcccctcttaaatgccagcaccatccacagcccacagtgcccagcacggccctgccctctgccctgccctctgctctggcctaaggtctctcccctgtgccgttcccttcctgacggacaggcctctgtccgttcctcaaaccacacaggctcaggcctgactccaggcctttgcacttctgtaccctctgcctagggtgcctttcccgggctctgcatcctcctctcaacccgctgagctccagcctgctggtcgcccctcaggtggatgaacacacggtgtcctctcgccccaccagcttttgcacaggctcttctctgtgccagacacacaccctctctatcggggtttactctctaaataccattcatccttggagtctccactgaaatatcgctccctgcccacccccctcacttggacttaaccttggttaggttgccaacccccgtctcctgactccgggaagctagatgctctcctagcactcggaacttgcccatcgccacatttgcacacccgtggttactgggttaggttggggcacaagtcatcgcgggttttgccattactattcatgaactgcagcaccggctcctccccgtttcttttgtgtttttttgtcattacttttaatgactgctgcaccaacctgttagaatcatttatatttatccatccatcatctgccttcccctctagaaaggaagctccatgagaatagaggccaaatctactcaaatcactccaccttcccagcacattgtttgtcaataatcatttacaaactgactgatagagaaatgccttccctgttgctgggatgaggcacatgacatgcccctttgaaagtcaattccatggacagttagcatttgctcttcactcctgcacccatggcgtggctgggcttaggctgatctagtctggccttgactccaggctaaggatgggaaccatgcctgctccacacgcctctcatcccacagccagagccgccgttccctggggcacgtgcatctcgtggggaaaatcaagagccttagagggcaggcctggcagtgcccacacattccaggcttctgtttgtgccgtgtctgtgaaaatctcgttggcagaagcaagtcacccagccacgagcaacacctatgggatggataagtccatccaccctccctcaggccctggcaaggttgtggctatgtcatactcttacggggggagtgaaaaattgaggcccaacattaaatcacccaggcaagaaatgtcagcctctgtccccacgctggaatcatttttcaccagcgggtttgcctgaattccctttgcaatggtgtctgcaggtttaggccaatgctggtccccgtggaggacacagaagcctcaatgggcctccgtctgttgggaagaacaagataccagcttggtgcaaaaccaccgcaagccccagggggcccttgcgccatgaaacaggagaggggcagagaactgtgggagctcaggaaagcttgcgtccccagcccctcccctgcgtccccagccccctccccagcatgcccccatctctgcttcctttctttctttccttctctttctttctttccttctctctttctttctccctttctttctctctttctttctttctttttcttttccttccttccttccttccttccttccttccttccttccttctttctctttctttttcagggtcgggctctgtcatccaggctggaatgcaatggcgtgatctcggcttactgcaaccttcacctcctgggctcaatcaatcccccttcctcagcctccccagtggctgggactacaggtgcacgtcaccacacccagctaattttttttttttagagacaggattttgctatgttgcccaggctggtctcgaactcctgagctcgagcaatcctcccacctcagcctctcaaagtgttggaattacaggcgtgagccactgagtccagcctgctttatttttctttacagtacttggaaccttcttttttttttttttttttttttgagacggagtctcactctgtctcccaagctggagtgcagtggcgcgatctcggctcactgcaacctctgcctccctggttcaagcaattctcctgccttagcctcccgagtacctgggactacaggcatgtgccaccacctccagctgcaccttgatctcagagacttctggcctccagaaccatgagacaataggtttctgttgttgaagccccagtctctggaacgctgttaagtagccccaggaagctggcacagaacccggccggccctcctgggcgagctgctttctgccaggctctgggggtggcgggtggcctttcagtgatctcctccagcacttgaccctgttctgacttgtattttgggagtgtcttttgtcttcctaatgttgatagcctcacacacgtggcattgtactggcacccgagaaccagcactcatgtatgtagcactttcagaaattagttatatttatgcatggtcatggtcatactcataaatctaattggacttcttttttaagaaagtgaaacaaagcctgaattctccattgtcgtgtcggcctcagttcccggagctgtcctgtaagttccttgaaaacaggtgcacccaacctgtacgtgggacctctcaacagctgcctcatagcctgggccctggacagctctgaagtcagaggagtggggcttcagtaggttgcgctggggttaaatcctggccattacccacaaggaaagaccaatgcagcagaaccgtccctgaagcagcgaaacgtggtcaggagccgtccgtcagtgagagccatccctttggaagttcttcacaggacgatacgtcttagaatttttaacacatagtgatgtgccacgaggtggctttcccgcctcattcctactgacatacgtttatattcaaagtagaaacagaaatcgtcttctacataacaaagtcctgaaaatcgtcacagctcttaagccacgtggttcctcagcaccacctgagctgacccgtcccagctcgtgatcacacagacaaagacataactgtagaagcgtcggtatttcatatgtatcaaatttcatttttaaaagacatttttaggggacagaaatgttatagaacaacttttaacgttccacaaaagtataaatagtagaaaaggaaactagtgcgtgtgaactaggactccatgaaaagtacccagtagttgaagctccacgactccatggacagaagtttgcataaatatttaagcgatgttagttcctgaacatataagcaagccgtggcaggtctgtggccagagccctctggagtccttgctgggaaggcgcagctcagggggctcctgttactggttgaggaggggagacatgccactcacctctcccagggagcccccggccacggactctggcaagaacaatggggcagaacataaggagcagtggccaggcagcaggtgcacctgcgtcccctcccgcatcccccctgcatcccctgcccgcatcgaggcagcagggtccacaagctctcaggggccacgtgcaggacactccaggaaggaccacacagcctgagctgggggccacagagagaggacttaaggggaagggcagacaccccacccctccccacaccctgccccctgccctctgccccctgcccccggcaatcacctgggtctgtggcagcagctgtggggacaatggcagagggcaggacccagccccgtgggggaacttcctctccatgtggggctccagcaggatggggccagacccactgcttctttctcccacgtcttcccagcccttggcccaggcctgccacagccatgggagtgcacagctcagcaggtaactaaatccccggctttctagctagagaatgaaaatgagggttcccagggagaaaggacattttagggagattcgggagagggagagtcttggtaagtggcgtgtggcctcctgggctgccctgagctgttcacatgtggatttgagctcatgggcagacctcagcctagaccctggcggtgcacacactgggcacatgcaaacagcattgaaggctttgagaaaggaactggctggggaaacccagaccacaaaatgttagttgaaacttacagcctgaatttaatcgggttaatgctcactaaaacaaaccaatacaaaatcaacattcttcattggagtgaaataagatgcagagtctcctaacgtaatattcatggtgtccagaatgcaattcaaccttactaggatatgaagaaccaggaaaatggcaactcacgcaggaaccagccagcccatgcccgtaccaagatgactgagatgttgtgatccgctggcaaaaaacatgaaaatagctgtgataaaaccactgcagccctagtcacaaacactcttgaaacaaatgagaaaggagaaaatctcaggaaggaactagaagatgtaaatataaaccaaatggacatcttagaatggaggggcaataagttctttttgaaaaaaacctcactggatgggattatagaagacagtaaagaaatatcagaatggaacaaagagtctgtggatttgaatataggttaatggaaattatccaatcttaacaacagagaaaaacatgagaaaggaatgttttaaatgagaatatcttctcgtggagactcagtgcgcagacctagcttgtaactctcctgccactggaggggcaggtgaaggagacctacatgaagatggattcacaaattccaactagcaaatatgggttccaggcaaagtgtgaaaagttaactatgtacattttatttcctagacagtgatgcactgtgtaaaattaaatcaccccaaatataatgatagagatagaatgaaaatcaaaaggcaaaaagtgaagcaaacaccatgcaaaccctcatcgaagacagtgggataagccacgttagtatcaggcaaagtaggctttgaagcaaacaaaatcaccagggataaagagaagaaaaaaataatgacaaaagggtcaagaaaacaacaatcctaaatgtgaattcaccaaatgccagaactctaaaatacttgaaacaaaaatttaaaaacccaaaaagagaaatagacgaagtccacagtgaggtggtaacactgctctattaataaagattatactaaaaagatagaaagttctcaataatgtaggtttcgactttttaaaaggtagaaaaaggaaaccaaaatgaatcaaaaccaagcaggaggagggaaataataaaggtaagatcaaaaaacaacaaaattattttaaaatacaatagaaaaatgaatgacaccaaacctaattctttgattaaatttgaataaaattggtgaacttctaacaataccattgaataaaaaaggaaaggagggagacacagtttaccaacattgaaaaagaaaaatgggtcatcattatagacactgcagacactaagggataaacagggaataatatgacaactccatacacatgaactcaacactcaggtaaaatggacggattcttcagaaaacacaaactcaccccatgtgaaagcaataccctcagagggttatttgtattcccaaaccttttaacaaagaaatctccaggcccatttttttggctaagaaattctaataaatatttcacaaagaaatgccatcagttctacataatgtcttcaaaaaacagaagaggaggactccccaaattatttaatgagggcaagtcatcaggataccaaatgcagacaaagagcattcaaataaagaaagctacagatcaatactcttcatgaatatagacataacagtcctcattaaaatgttaccaaattaaatctggcaataaacaaaaagagtaaagaataccatgctagagtccaaatggtgctatttactccaggaatacaagggtggtttgatagcttaaaaagtaaaatcaactaatgcaatacatcatattaacagtttaaagaataaaaatgacatgataatatcaattgatgccaaaaggcagttgacaaagcaatatcaatttatgataaaaactcagccacaaagataagaggagaacttctccaacctgaacagggcatcagcagaaggtctatggctggcatcacactcaacagtgagggactcatgctttctcagtgagatcaggcagaagataggaatgcccagattttctaatcctattggacatcacacttaaaatcccagtcagtacaaggcaagaaaaagaaataaaatgcatattgattggagagaaaacagcagtgtccttagttgtagatgacatgattttacacacagaaaatcccaagaaacacaaaaacaaaataaataaataactctcagaaataatgaatgaatttagcaaagtagaatttatgatcaacaaatcatatttctacatttacatagaaagccaatcatatttttccataatagcaatgtataattggagactcaattttttaaaaaatgcctttgtataacaggtccaaacaatgaaacatttaggtatgaatctttccaaacatgtacaggatctccaagttactacaaaagacctatgaagacaatttttgcatatatgtatgtatgtataaataaatggagaaacaacatgttcatagattgaaagacccaacatggtaaatacatcagctctccccaaattgatctgtagtttaatgcaattccaattaaaatcccacaaaaatgtttaaaccgagctgattctaaactttatatggaaaggcaaaagacagagaatatgcaacttgatactgaagaagaacaaagttggagaaaacataaaattaaaactactttattttaagacttactataaatctgcagtcatcaagacggtggcatttgcagagtagcaaacgtatagatccttgaaacagaatacagtgtccagaacacaaacatgccaaatatgcaaaaggagtcatggagggaaggagtctttccaacaaacggttatgaatcatgttgacgggcatgtgcaaatatctgcaatctaaacctcacatcttatgaatacttaactgaaattaatcacagatctaaaatgaaaactacaaaagtgtaaacattttagaagaaaacataaggagaactcttcatgacctattattaggcaaagagtttactataatcaggttaaaaaattgatgtactccacaaaatgtttaaaattaaactttgtactaaacgatatctcaattcaattgcaccctggtaaaaagccaagtctacctggacatctcagaatcctctgcaccaatgtggaaggatgctggcttcccacacctgctgtagtcagttaccagaaacccaggggcttaaagcaatcgaagtttcttctctcacagctctggaggcatgaagtccaaaaccaaggtatgggcagggcctgctccagtcaaggcctctcaggtctgtggggtgtggcgggcggaggaggcacctctgggacggttgccacatcagtcacagcagaagcacccgtgcttcccccagcatcttgaagaaagctgaggaggagcagtcagcagctgtgccctgtctgttttagcaggagcctgaataaaggcacaggtggctgcagctgcgtccaatgccaccaaatggggcctttgtgagccatggacataccgaaggacctcagcatcttcaaagccctcagacgtggcagaaaaccagttgggaggaatatttgctcccgcaccgacgcgcaaacagcctgacgtgtgtgaatacagagaccggggggttccttccgaaggctgtttaaattcccatcgtgttttcaatgggcattcatttagcagtcttggctttatgaatcataaaaataaatgctctgtttgtttttgtccctcaaacgcactcagttaacctgctcctgtccccagaaggcgattaacaaacacttaaactgctggtcagcttggtcattactccaaccctgcatgacgatggaaccatcaacacaacttactttgatattttttcctccccaagcaccagctcagaggaggccagcaggcccgggccccaggagcttcacctcctcctgatgcgatgtgtgactctgggaccccctcacactcctggccctgcagccccttcccctgcatgccccctcctgtgagagtctcagtgactgtccaagagcacacctggccttgtctctccatgaccttctcctgggctcagaccaacacaaggagagccaggatggagagttcaggcctcagcttcccctcagtgtggccccagggcctcgggtggtgattgcccaagcctcctcaagtgtggtgggcgggtattgctgctggtgttgaggtggggggggtgttggagtggatgggtgttgatgggtgttgtggtgggggagtgttgacttgagtgttgtggtgggcaggtgttgtggtgggcgggtgtggactcaggtgttgtggtgggcaggtgttgtggtgggcgggtgtggactcaggtgttgtggtgggcgggtgttgtggtgggcgggtgtggactcaggtattctggtgggtgggtgttgacttgggtgttgtggtgggcgggtgttgtggtgggcaggtgtgcactcaggtgttgtggagggcgggtattgccacgggtttgtcacctcttcctgtcccaggaaagtgctggttcccaagagcactcccaggtaatgggttgaggttttccactatgggccccagcaccagttctgggccccaggaaattctctgtggacgctgtgctcttaccccgtgcatggacattgagctattggtaggtctttacaaacaatcctgggtccactattctgagaggagctgaactcctgtgtgagacaccacatcggaaacaccagggccaaaagcacagatggagtcttcctttgcttccccaaaggaagaatgcacaggagcctggcactcctggacctgaggaaaccctgaaatgttggcatctgcagatcctctccaaaaagaggtcaccagtctcctaactgcaagtctgaccccagcattctgggagccaagagggagaaagagtctgtggatctccctgctcagtaaattggctttcactaaatcctctctgtgcataagcagcattacccagtgtcctggagcttagaaaagtcctgtttcaatgtctgaagaaaataaattgtttctttttccaaagtcagggaggagtatttgactgccagtgtggactgaggggtcttgggatcacactcttcccaatcagctttgaaccgaccctctgtgtctgcctcaccatctcctctgcttatctagacacttgggaaccctaacacaagcccttctaggagtctgtggtgtggctcagctgcctctgtaggcatgtctcttcccaatgtgctttgaaccgacctttctgtgtctgcctcaccatctcctctccttacctagacacttgagaaccctaacacaaatccttctaggagtctgtggtgtggctcagctgcctctgtaggcatctcttggggttaaacattttccactctgctaaggcagtgccatctattcttctgcttcatcttcagaagacactgagcccttccccaccctcccttccccaccccccacaccaagtccgtggcacccttgaggccacagggttgctgccataagatttttgtactgagtgttctctctccaagcaactgtgagagatttctatgggcaaggcctccgggttcctgttaaatcaaattgtagttgagtgttgggtgctattcaagaagcatccacctttctccttcctaacagagccctgagttattcagtcacatggtttgaaacatggggtgagtgctggttgacttaacctaaccagcaccgtctcaccctgtgtcacagttactggttccaaggtgggtgcataactgaggctcatgctaggtgccacacagcactcccttggtccccctaatggacttggggatgggcaagggcctgcgttgttccaattagagtcaaatacacattgtgctaagagtgtgcttgttcatgctccctctctgatgaagaatgcagcctcagaaattgttcctggagattttgccacactcagaatgattctgacttcactgaaggcagagcagaaaattgggaagagactgagtcctgggtagcatccatgagcttctgtgctcagattcaccctgaagcctggcctgcttctgaactacccacctgagtcaataaattgccttcccattaaagtcaaattgagctggatttttagttacttgcacctgcaggtgttctgtgaagctggtactgtgagtttgtatctgagaatatttacagtttctctcatggttgagtcaatcatttcaaggatgctttgagggtaaaaagaatgatcaattgtgaagcagtgaattgtgctgccaggcacaattcattgggcaatagaaagcctcatttcctgggcagtagaaagtttcattgtacattagttacatatcttgtttctgtctcaacctcctattttttcatatgcaaaggaggtaaggaagtccacataagtccagcagctaatatgcctctcaggcatgatccaaaacagaattgaattatgcaagccttgttaaaattcattgtcgtcattcatatttctgaatatttaaattagaaattctgaaaaagtagtttgtttcagaggtagtttgtgtgtatgtaggtattttttcaggatcaaaagtttattttttattgtctgattgagtttaatttacatataataaaatttagtaattttaagtgtacaaatgaatgcattttgacaaatatatatagtcatgtacacaacactaccattgaaatacatttcattaccccgaaaattcccttgcatgctgctgtagtcagtgccccctccaccacagctcctggcagttgctttctttcactctggttttgtctgagaatttgatacaggccacgtgtggtgactcatggctgtaatcctagcactagactgagaagggaggatcacttgaacaaggagtttgggtaacatagcaaaaccctgtctcaaaaaaaaatacacacacacaaaaacttagccaggtgtggtggcacacacctgtggtcccagctactcaggaggctgaagaatcacctgagcctgggaggtcaaggctgcagtgatctgtgatcacatcactgcactccggacagagtgagatgttgtcaaaaaaaaaaagaaagaaagaaagaaagaaagaaagaaagaaagaaagaaagaaagaaagaaagaaagaaagaaagaaagaaaagcatttgatataaatggaatcatacagtaaattatcttatacctggtttctttcatatattttaatgcctttgagctatgtccatgtggtttccagtgtgtatgtcattcttcttacgttgggcagtaaccactgcaggaatatattacagcttgtttatctattctgcagtgatagactattttaaaaatatttggctattaagaagaaagttgttaagaatacttatattcaggcctttgtgtaaacagattttcacttctcttggttgaaaacataggaggaattattattttttaagtcatggatttttaaatgattgtcagttactttaaaaaatgtaaattcttaaattaaaaagtttaggatgtctgacaaccctgacaaaagcaagcaatgggaaaaggattccatatttaataaatggtgttgggaaacctggctagccacatgcagaaaactgaaactggaccccttccctacaccttacacaaaaattaactcaagatggattacagacttaaatgttagacctaaaaccataaaaaccctagaagaaaacctaggcaataccattcaggacataggcatgggcaaggacttcacaactaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctatccatctgacaaagggctaatatccagaatctacaatgaacttaaacaaatttacaagaaaaaaacaaccccatcaaaaagtgggcaaaggacatgaacagacacttctcagaagaagacatttatgtggctgaaaaatacatgaacaaaagctcatcatcactggtcactagagaaatgcaaatcaaaccctcagtgagataccatctcacaccagttagaatgacaatcattaaaaagtcaggaaacaacagatgctggagaggatgtggagacataggaacgattttacactgttggtgggagtgtaaatcagttcaaccattgtggaagacagtgtggcgattcctcaaggatctagaaccagaaataccatttgacccagccatcccattactgggtatatacccaaaggattataaatcattctactataaagacacacgcacacgtatgtttattgcagcactagtcacaatagcaaagaattgcaaccaacccaaatgcccatcagtgatagactagataaagaaatgtggcacatataaaccacggaatactatgcagccataaaaaaggatgagttcatgtcctttgcagggacatggatgaaaatggaaaccatcattctcagcaaactaacacaggaacagaaaaccaaacaccacacgttctcactcataagtgggaattgaacaatgagaatgtatggacacagggaggagaacatcacacactgggacctgtcagggcgggtgggggcctaggagagggatagcattaggagaaacacctaatgtagatgatgcgttgatgggtgcagcaaactaccatggcacgtgtatacctgtgtaacaaacctgcacgttctgctcatgtatcagaacttaaagtacaaaaaaaatataaaagtcacaggatgtttgtgatagtatctattacactgatgttaacatcacatggttgactatgtggagactccaagtgaaatttcttgcagttgtcagtgccaggaaaatctgtatttctggataaaactcaaagagtttagaaaaacattcaagtttcatagtctagaggtctaacactggaatcttttccaaatttaaggtttaatgattttcttaaatctaaaaatagtaggttgcagatgtatttaaacagtgtgcctaggtagtatgtttatatattaggattaaaatgctcttctaaagtttactaattctaacacagcctttattgtttcatggagacatatctttccgattcccaggttaatttaaacaattaattcaaagcaactattgacttagttctacattgggatacctatttatgcatttgaagccttagatatgtatttcaaattagaaacgtgtactggtcatggaaagttgtgactgagagtctcaggtaagttttgtttccatgtgaacacactgcttccaattaatgttatgcccagagcagacaattaataaacaccctttgaagtgaatgagtgattaactgcaaatattacaatacatcttcttagtgggcatgataattggacatatttagtccttgctgtgacctaagaaaggaattgttttcattaaatgtttaatgtttcaccctgttcatacagctggagttactgattcagtttgatgtgaattcagtcttataaaaaacccatcattataacctgcacttatgcttcctacagtatcggaacttccaacttgtaggcaaaatagatatgcttcatattcttaaaaaccacaagaaatctccctttattcagaataaacatagaattagatattctattaaactgaacaataggactcactgggagtgaccacatacactataccacgcattgcccgagtgtctgaaaaggtcactggaccatttcgctccatgctgtgccacgggccaaccacgagggctgtcagtgactcactgcgtgggccacccagggcatgtggtgctgaggctgtcgaagagcaagacgaggctgtatttaaactcaggcctctgctaagtgtcagaacttgggcaagatgccatacactttagagccagtttccttttctatgactgggttataacactcaccctgtcaggttctcgtgtgcgttgacaaggccggcatgtgacacaccaggggcagagctggacgggaaccttcttcctcagacatcagggtcctcatgagcatcaacaaaataaggagagctgtgtcaggactgcagcagggactcagcaacaatcagtctctttctcttgtttcatccaaatcatacatttaaaaaaataggtggggttatcattgatgtttatattgattactgggatcagacaaatacacctttccttgtcatgctgttttctcttcccagatggtttgaagagcttcattttggacttgatactcctggaatgcacatgagaaacagtagccaatgatttgcacatttcacagcagtgtagctcttcattcacaaactcagatagaaaaaaaaaacaaaaaaacttcttgtattttctaatgagttcagtcttgaccctgagccatctcccctccagaatggcaggacactccactccaccattgttgtggggccacaatttcactaatcaagggctccttggcttctgaaaaatgggagatgcacctctaataaccagtctagattgtcactgctcacttccttattttccaattccacaggggcccccaaagcccagaagatctcatttccaggcgtcttatagaccatgggaacctggtaacactgggaaccccggggccagcacccacctcatgttcaccctgtttccatcaccttctaggcattgctacagagcagtgttgggacccactggagatctgactgctcccagcctggaaaactgccttctctctctccactgagctcatgatatttctgctttccgccccacagaaatccttgaatgaagcacaaaagggactggtagttacctggtgtgaagcagagctgagcctatgggaggaagcaatattgcaatggactctgtcattgatgtcactagtgcacaaatctgttaccactatggtcaaatttttatattcactttaagattataactcattctgctcattgtattcaatgcaacatctaccccaaaagatactcaggctttaatttatgcttttctgtttacaaatgagaattcatcagcaaattgaggtagcaagtagatatttagatattttttaaattgaaggcaaaacagaagacacatacacatacatcagtgaaacagaacagagaacccagaaacagaatgaaatgcagccaactgatttctgacaaaggagcaaaagcaattcaatggagaaaggagagtctttttaacaaatggttctggaacaagtgggcatccacatgcaaaaaaaaaaagaatatgtaacagaccttatactttttacaaaagttaatgcaaagtagatattagaccaatatatgaaatgtaaaattttcaaacttctagaagataacataaggaaaaaaaatctagataactttggatttggtgttttttttttcagatacaacaccaaaagcatgatccacaaagaaaaaaattgggaagtttaatttcattaacatgaaaaacttttgttttcaaaagatactgttaagagaataaaaagataaatcacagactgcgagaaaatatttgcaaaatatatctaaggattcatatctgaaatacacaaagaactcttaaaactcaacaatgagaaaacaaacaaaactgggcaaaagctgaacaaatctgcagatggaaactaagtatatgaaaagatgctgtgtataatatgttattaggaattgccaattaagacgcaataagataccactacacacctgttagaatggccacaatccacaagaatgaaagcaccaaatgctggtgaggatgtggagcaatgagaactctcattcattgctgtgggaatgcaaaatggcacagccactttggaagacagtttggcagtttttacaaagctcacatagtcttgtcataagatttaacaattgtgctcctcattatttacccaatggagttgaagagttatatccacacacaaacttgcacacaaatgtttatagaaatgtgggcagcaagccacccaggtgccgatgtaagagaccgagggcacgagctgttccagtgtaataaaatatgtaaaataacaagagttatactagatctagatcatagacatgattatctacgaatatcattcatcattagtttgtagcaattactctttattccaatattataataaccctcgctctataatcataacccaggaaaagccaggccatacagagataggagctgaggggacatagtgaggagtgaccagaagacaagggtgcgagccttctgttatggccggaccgggccaccagagggctccttggtctagcggtaacgccagtgcctgggaagacgcccgttgccaagcggactgtggtctagtggtagcgtcagtgtcaaggaaaaacacccgctacctagcagaccgggaaagggagtctccctttccccgggggagtttagagaagactctactcctccaccttttgtggagggcctgacatgagtcaggcccgcctgcagttatccggaggcctaaccgtctccctgtgatgctgtgcctcagtggtcacgctcctggtccgctctcatgttccactctgcacacctggctctgccttctagatagcagtagcaaattagtgaaagtattaaagtctttgatctttctgaaaagagcatagaaaaaataatggcataagctgtcctctctgtctctctgactcggctgccaaacagggaagggccccctgtctggtggacacgtgactccgtgaccttatcaatcagttggatgactcacagtctttaccctgccccttttgctttgtatccaataaataacagcgcagcctggcattcggggccactactggtctctgcgtcttggtggtagtggtcccccggtcccagctgtcttttcttttatctctttgtcttgtgtctctttttctacaatctctcatctctgcacatggggagaaaaaacccacaaaccctgtagggctggcacctacatagaagctttattcagaattaccagaaacgaggtgaccaacatgtccttcagtaggtgaattgagaaataaattctggtacctacagacaatggaatatcattcagtgagaaaagaaatgagctatcaagtcatgaaaaggcatacagggacccaaaatgcacattactaagtgaaagaagccaaaaaggctacatactgtatgattccaattatgtgacattttggaaaaggaaaaactacatagagagtaaaatatctatgtaattacgtgacattttggaaaagggaaaattacatagatagtaaaataatcagtggtcgacaggggttggggagaggaaaggatggatgggcagagagccccggatgtttagggcagtgagatcactgtgtgcgatttcaccacaacagtggacccacgacagtgtgcagatgccaacacccactgaacgcagaccacaaaaaggtattaattacataaactatgaactttcataatgaagtaaatcacgttttaaaaaagtagacagttttttttcagttattgtctactttctgaaatggagatggcggagtgcttccatggttgtgaggataaaaatagcttagagaatgtaataactaaaataggtgtgtaaacattgttaaactattttatcctcattaaatatatttgtaactttttacaactgagcgagtagtgcaaacacattaacataattctcctgtagctccactcagaagtcaggactgcagggcttcagtgcagggccacacagctccacacgcacctgccaaacgcaacagcctctttcagcgtcattaaaatatttcaacaggaggactgagtttagactcaacctgtgttttctcccctggaaaacgaaggtttcatgaagcaaggaaggtctttactgtcctcatccgaaacgctgaggcatctgtgatgtctgctgtaagtgccaccaggctctccgctgaaatctcgcaacgggaaaatagagaccgtagattctgcttttagaaaggggagaatcagaagtaatgtggaaatgccatgtcctcgttcataaacatcttcttttacaaattccacaagtttagttactttgggattaatatgggcttatcttaaagtgcgtttattaacttagcgtgagttgttcaaatgcattctggatcctgagccgacatccagcaatgctgagtgtgcgcctgtgtgagtcaccagccctgatgagcctcaggttattgtgttcgtaaaatgaaggggcttaggcttgctgcgattttttaaaaaccatttttaacagtaaaaatttttttcttgctacataaaaatgtacaagaaaaactcagacattaccaatgataaattataattttattaatataaatatttttgtgagctcaatttatatgacttagttattataaaagaaataagcaatatgaggtggccattaccatcctgtcccgttttattttgttcatatgctattgataaatcttgatgtatacagaaaagtagtttcaaagaataataatttttaaaaaggacttgtaatttcaagagacttttaaaaaaatctgcaattgctttttaaaggttctaaaacagttgtctatgccttaaagctaaataactacaaagagctcactcttctcacattctgtattataaatatgtaagtcagagaaacaacagacaaaatcataaaaacacatgcatgaacaaatgggccttggtttacatttaattggatcttgcaatacacatgggttatagtagtatttctgtgtgtaattttacatgagtggattgctatcaaaataaaaattgtctacaatctcttttcagtggtaaatttgcacaaatggtaaacatacacatagagatagtgggagaaatttatttcgtggcttgcaagaagacaggttaagttgggacatttaattgtttcattaatgctacattttaaatgcacttgtatgggcatggtattttaatgtattattatgacttttaaatgctcaatgttacagatggaatattagagcaagtactaacttatatcttctttgtgtgtgctttggaggcatcaggaaataaagcagcccttttcccttttcccagaagctgtgcttctgcagattagatctctctgtaacacacacacacccatgcacgcatgagcgcacacacacgcgcacacacacgagcacacgcacgcgcaggcacacacatgcacacacacgcacacgcacacacacgtgcacacatacacccaatatagcctttagggttaaaaggaggaaaagagaatttgcctggataactcttacccaggtattttctggggagatctagaataatctaagggggtaagctggactagccaatgggaaatcaaaacgaagatactggagagatgttcccagaaaaggagcattcctaatgggcttggccctagtcacatgcaattccccagatgtggttggtgtggccaaggttccagcatttgtcagctgctttcttgccacttcttgtgctgtgaggagtatcccctccccaatgccagaggcagtcgtcctctaacccccttcagagtaaagggccagcaattggcagtcacaggaaaagtagtgagacaggaaggtgcggagcatgaagtcccaccataccggcctccagtgtctggcacagaatatgacgaggaacctccgtgaattggaatcttccacatcttgatatatgggagtttctgctagatataatttgacttaaaaaagaaagaaatatgaccttcttcacctaaatattgtagaagaggtaatgattgcaacctggatgttttacattctgagatgctattaaaccaatattcatcacaaatgtattgataattttttagaagaacagaagagatcccatcatattaaatgaagtgtatcaattataagatgcatgctaactccagaaaaagcaaagcatgaaaaaaatctgtcttagaatggaaaaatacagtagttaaactatttttaactggaatttaaatgcaacattttaggatatgaagctgtcaactcattttgaaaactgctggctcagatgacctcagcgataggaaacctctaaaagatcatgaatctaatcaggtaattttctgtgcctttgcctgagagtctagctgaaagtggtgcagtttttacagaagaggaataacgtgtcccgaactgggaacccttcaccggccaccactccaggcggcgcttcactgtggagttttggtcgccagagggctccaggggactgctggggaaggccaggacatggaagagggcctagagccagggttacccgggagggggtggacccattttgccaagcacctgaggaccataccgtacaggatcctctcaaaaccacccgcacactaggtgggaataaaggataagagaaattaatgtgtgcttagcatgtgagagctgacattcagagtcagcctgagcaaagagattcatacggaaggacgaagcgcatgttgtgagacaaagaacacccaattataagatagaaaaccttggttctgggaaattcctgaacctgtttgcccatccatgaaagagtaagagtgatactaccttctccaccttattcttgtaacagaactgcccgtttctttcgtgcccacagctaagtgtttaataggaacaatgtgacaaatataaggtcattgctcttacacaaaaggttcaagaaaactgagaaagatctaaaaattcccaaaggaatgatttttcaaagtacaacatcttaatttacatagagagaaataatacattttgtctcaaataaagatttggccacatcctaagtatagcattgaagagcagttaagctatttcttcaaagaaaatatatcaaaattaaacctgtactttttgagtgtgaattctaacacacaaacctggtgcaatatatttaaaacaaagcagagattaattaattaattaatgattccccatcaccattttcagaaaacccagtaacttagtgccttaagatgttcaaatcatcccaaaaacttgagttactaaatattttcaaaaccctttctcaagctttgctattctagctttagttggaagaagaagcttccaagttaaagatggtagacgaaatactgacccagttgtgtcctttccctcctgagaaaccatggtggctatccacgatggagagagagcagcggagacaaaaagtgatttgatggcctcgcatccgtgagaaggagcatcatctgtggaccttcctgggggtgaggggcagagaagtgaggcaggcatcagaaaacaggagggtcgattaaaatctgtacattgacagtcaaccctcattatcctccctcaccgatgccagcaccccacccctcgggtaaccagtgagtagaacaccaacaaccaacaagcaagcagctgccttccagagaggagaggagaaggttttctccagaggaaggaaaccatccagaccaaaggcatcacttactaacatgcggaaaccccatcgactccccgaagcaaaacctctagacgagcctttcactaatgataacacactcattctccttcacgtgttactattaaatgtgaacagtgaagaatcaccacctagacgagcctttcactaatgataacacactcattctccttcatgtgttactattaaatgtgaacagtgaagaatcaccacctagacgagcctttcactaatgataacacagactcattctccttcttcacgtgtcactattaaatgtgaacagtgaagaatcaccatctagacgagcctttcactaatgataacacagactcattctccttcttcacgtgtcactattaaatgtgaacagtgaagaatcaccatctagacgagcctttcactaatgataacacagactcattctccttcatgtgttactattaaatgtgaacagtgaagaatcaccacctagacgagcctttcactaatgataacacagactcattctccttcatgtgttactattaaatgtgaacaatgaagaatcaccatctagacaagcctttcactaatgataacacagactcattctccttcttcacgtgtcactattaaatgtgaacagtgaagaatcaccatctagacgagcctttcactaatgataacacagactcattctccttcttcacgtgtcactattaaatgtgaacaatgaagaatcaccagacattgaagggaaacccatctcaatgggaaaaaagaccaaggtaaaccagcaggcggaatgattgttgagaacctaacatcatagcaaaataagaaataagagttttatattatcattcacttagtggcactgtctgaggtttcactatacaaatatattgctttgatatgtgtgtgtatatatacatacatatatatatatatatatatatatatatttttttttttttctgagtctcgctttgttgcccagactggagtacagtggtgtaatcttggttcactgcaaccaaggtctcccgggttcaagcgattctcctgccaattttcatcttttaagtggagacagggttttgccatgttggccaggctggtctcaaacttctgacctcaggtgatctgcccgccttgacctcccaaagtgctgggattataggcatgatagagttttaactattagaagaaaccagaggaagctaccattggaatagatgaaacatcagcaatacattaaaatatcagcaatttcacatgttcgagattacttttaaaaaataaaaagagaacagaattgatttagtttctaggccagcaaccaaggaaaaagcaaggaatggaagattttataatcgcataacaatagcaagatcttacatttctattgagctttaaagattacaggccaggcacggtggctcacgcctgtaatcccagcactttgggaggctgaggtgggcggatcacaaggtcaggagttcaagaccagcgaccagcctggtcaatatggtgaaaccctgtctctactaaaaatacaaaaattagctgggcgtggtggcgggtgcctgtagtcccagctagtcggggggctgaggtgggagaatcgcttgaacccaggaggcagaggttgcagtgagctgagattgtgccattgcactccagcctgggtgacagagcaagactctgtctcctaaataaatacataaataaaaatacaaaaattagcagggcggggtggcacacgcctctaatcccagctactcgggaggccgagacatgagaatctcttgaacctaggaggcagaggttgcagtgagccaagattgtaccactgcactccatcctgggcaacagattgagacgctgtctcaaaaaaaaaaaaaagaaagaaagaaagtagaaaaacttcaaataaaccacctaacaatgcatcttaaagaactagaagagcgagccaggcgcggtggctcatgcctgtaatcccagcactttgggaggctgagacgggtggattgcttgaggtcaggagttcaagaccagcctggccaacatattgaaaccctgtctctaccaaaaatacaaaaaattagctgggtgtggtgccaggcacctgtaatcccagctactcaggaggctgaggcaggagaattgctcgaacccaggaggcagaggttgcagtgagcggagatggcaccactgcactccagcctgggtgacagagtgagaatcagtctcaaaaaaaaaaaaaaaagaaaagaaaagaaagaacgagaaaagcaagagcaagtcaaacccaaaatcagaagaaaacaaataataaagatcagagcagaaataaatgaaattgaaataaaaaaaaatcaaaaaaacaaaaaagtttgttttttgaaaagataaacaaaattgacaaacctttagccagactaagaaaaaaagaaaaaagactcaaatagataaaatcagaaatgtaaaaggaggcattacaacggatactgcagagattcaaaggctcactagagacttctatgaaaactatatgttgctaataaattggaaaacctagaagtggataaattcctagacatattcaacctactgtgattgaaccacgaagaaatccaaaacctgaacagaccaataactaataatgaaatcaaagccataatcaaaagtctcccagtaaagaaaagcccaggacctgaaggcttcactgctgaattttaccaaatatttaaataactaataccaatcctgttcaaactattccaaaaaatagaggaggaggggatacttccaaactcatcctacaaggttaatattaccttgataccaaaccagacaaaggcacattttaaaaaagaacaaaagaaaaaaaacttcaggccaatatctttgatgaacatttatgcaaaaatccacaacaaaatactagcaaacctaattcagcaacatattaataatatcattcatcacgaccaagtgggattgataccagggatgcaaggtaggttccacatatgcaaatcaatcaatgtgatacatcatatcaacagaatgaaggacagaaatcatatgatgattttaattgatgccgaaaaagtatttgataaagttcaacatcccttcatgataaaaaccctcaaaaaactgtgtataggaggaacataccacaacacaataaaagccatacacaacagacccacagctagtctcatactgaagaggaaaaactgaaagtctttcctctaagctctggaacaccacaaggatgcccactttgaccactgctattcaacatagtgctggaagtcctagccagagcaatcaaacaagacaaagaaataaagacatgcaaattggaaagaaggaagtcaaactatcttatttccagattatatgatcttttattcgtaaaaacctaaagattccaccaaaaaactgttagaactgataaacaaattcagtaaagttgcaggatcaacaactgcaactttgttgatcaatgccaatcaacaaaatcaacatacaaaaatcagtagcatttctatatgccaacagagcaagctgaaaaagaaataaagaaattaatcccacttaacaataactacaaataaaataaaatacctagaaataaacttaaccaaagatgtgaaagatttctgcaatgaaaactgtaaaacattgatacaagaaatcaaagaggacacacacaaaatggaaagatattccatattcatggattggaagaatcaatattgttaaaatttccatattacccaaagcaatctacagattcactatcaaaataacaatgacatccttcacagaaatagaaaaaataatcctaaaattcatatggaaccacaaatgacacagaataaccaaactcatcctgagcaaaaagaacaaaactaaaggaatcacattacctgactttaaattatattacaaagctatagtaaagaaaacatcatggtacccacataaaacagatacatagattaatggaacagaatagagaacccaaaaataaagccatacatctacagtgaactcatttttaacaaaggtgccaagaacatacattggggaaacggcaagtcttaataactggtgctgggaaaactggatatccatgtaaagaagaatgaaactagacccctgtctcttgccatatatgaaaatcaaatcaaaatgtattaagttaaatctaagacctgaaactggaagactactaaaaaacaaaacaaaacaaaacaaaaacactggggaagttctccaggacgttggtctgggcacagatttctgtattattattattattactgagacagagtcttgctctctcacccaggctgaagtgcagtggtgtgatctcagctaactgcaacctccacctcccaagttaaagtgattctcctgcctcagcctcctgagtagttgggattacaggcacccgccaccacacctggctaatttttgtatttttagtagagatggggtttcaccatgttggccaggctggtctcagtctactggcctcaagtgatctgcccaccttggcctcccaaagtgctggggttacagatagggcacagatttattgagtaataccccacaaacacaggcaaacaaagcaaaaatgaccaaatggactcacattaagttaaaaagtttctgtacagcagaaaacaatcaacaaaatgcacataaaacccacagaatgggagaaaatatttgcaaacgatccatctatcaagggattaatagtcagaatacacaaggagcttaaacaactcaacatgaaaaatctaattatctgatattaatatgggcaaaagatctgaatagacttttctcagaagaagaccttcagatggcaaacaggttatgtaaaggtgctcaacatcattgatcatcagaggaattaaaattaaaactacagtgagagattatctcgccccagttaaaatgtcttttgtgcaaaagacaagcaataacaaatgctggcaaagacatagagaaaggggaaccctcatacactgttggtgggaatgtaagttagtacaacctctatggagaagagtattgagttgcctcaaaaaactaaaaatagaactaccatatgattcagtagtcatctgcatatacccaaaagaaaggaaataccaaaaagaaaagaaatcagtatatcgaagagatatcactatgcccatgtttattgtagcactattcacaatagctgagatttagaatcaatctaagtgtccctcaacaaatgaataacgaaaatgtggtgcatatacacaatggagcactattagggcataaaaaagtggccaggcacagtggctcatgcctgtaatcccagcactagggaggctgaggcaggtggatcacctgaggtcaggagttcaagaccagcctggccaacatggtgaaaccccgtctctactaaaaatacaaaaattagccgggcatggtggtgtgctcctgtaatcccaagctattcaggaggctgaggtaggagaattgcttgaacccggaaggcagaggttgcagtgagccgggatcatgccactgcactccagcctgggcaacaagagtgagactccatctcaaaaataaataaataaataaataaaataaaatgagatccagtcatttgcaacaatatggatgaaactgaaggacattatattgagtgaaataagtgagacacaagaagacaaacttcacatatgctgtcacttatctgtgggagctaaaaattaaaacaattgaacccatggagatagagagcagaatcacagttaccaaaggctgggaagaacagtgggggaagcggggaagagaatgggtaaaaaatataattagatgaataagatctagtatttgatagcacagtagggtgactatagtcaacaataatttattatacattaaaaaaactaaaagattataactggaatggttataacacaaagaaatgaaaaattattgaggtgataaattttttaaaaagtggtggggctggagccgtggctcatgcttgtagtccctgcactttgggaggctgaggcaggaggatcgcttgagttcaagagctggagaccagcctgggcaacatggcgagacctcgtctctctccacaaaaaaattaaaaaattagccaggcatgatggcacgtgcctgtagttccaactactcagaaggctgaggtgggaggactgcttgagcccaggaggttgaagttacagtgattgtgccactgcactccagcctgggggacagagggagacaccagtctcaaacaaaacaaaacaaacaaacaaacaaaaaatgtagtaaaaatggccattgtttccttgttcttgattttatagatgaacaattcagttttttatcataaattttggatgctagctgtaagttttattaggtgccattttattagtttgagaaagcttcctattatccctagttttataatgaaacggtgtaaatctgcacaagatgctatttctgcatctatggcatgatcatgcattttctcctttattctgtcaatatggtgaattaccctgattgatttttcatgactttattgatatataatttacatacaataaaaatcatcctttaaggcggggcacggtgcctcatgcctgtaatttcagcactttggaaggccaagatgggcggatcgcttgagcccaggaattggagaccagcctggcaacatggcgaaaccctgtctctacaaaaaaatacaaaaattagccagacacggtggcatgcacctctaatcccagctacttgggatgctgaggcaggaggatcgcttcagcctgggtgatgaaggctgccgtgaatggtgattgcactactgcactccagcctgggcaacagagtgagatcttgtctcgaaaaaaaattgttaaagacattaaattaaaaatatttaaacaaaggctgggtgcagtggctcacgcctgtaatcccagcactttgggaggccaaggcgggcagatcacaaggtcaggagttcaagaccagcctggccaacatagtgaaaacccgtctctactaaaaatacaaaaattagccgggcgtggtggcacgtgcctgtagtcccagctactcgggaggctgaggcaggagaatcgcttgaacctggaggcggagcttgcagtgagccgagatcgtgccactgcacaccagcctgggagacagagcgagacttcttctcaaaaaaaataaataaataaaaaattaaacaaagtaatggttggttggatgcagaaaatagtttaaaacattttttaaattaaaaaaatcactcttaaaaagtgaattcactctttaaaagtgtacaattcggtggtttttaagacatgcacagagctgtataaccagcacccctacctaattttagaacattctgtcactgcaaaaagaaaccccatacccattagctgtcactccccgcttcctcctcatccagcccatggcaatcattcatctactttctgtctgcgtagatgtgcctgttccgggcatttcacagaaatcaaatcatacctatgtggtctttggtgaagggcctctttcactcagcatagtgggttcaaagtacacccgtgttgtagtactttattcctattttttagaatgttttattgtggtaaaacacacataacataaaatacactattttagccacttttaagtatacaactcagtggcactaagtacattcacaatgttgtgtaactcaccactatttccagagctttctcttcatcctaaacagaaactctgtgcccatcaagcagtaacttcccgtttcctctgtaccccagcccctggcaacctctattttactttccatccctgtgaatctgcctaatctgggtacctcatataactggaatcatacagtatttgtccttttatgtctgacttatttcacttaacataacgttttcaaggttctaaaatacaaaaggttccaaaaatacaaaaattagccgggcgtggtggcgggcgcctgtagtcccagctacttgggaggctgaggcaggagaacggcgtgaacccgggaggcggagcttgcagtgagccgagatggcaccactgcactgcagtctgggcgacagagcgagacgccgtctcaaggaaaaaaaaaaaaaggaagggcaaaaaccgccattacttttccgccaacccaaatcgttgggtgactcagcgcatgcgcattcctctgcggggccacatctcaagccacaggcttcccagagcctataggagagatcccacattaatttaatttaattatttatttatttacttacttttttaaaaaaatttatttgagacagagtctctttctgtcgcccaggctggagtgcattggctcaatcaaggctcactgcagcctcgacttccgcggacttaggtgattttcccacctcagtctcccgagtagctgggactacaggcgcacgtaacccccaacccggataatttttgtattttttggtacagacggggtttcgctatgttagccaggctgttctcgaactcctggcctcaggtgatccgcctgcttcagccttccaaagtgctgggattacaggcctgagccaccatgcggggcctgaatttcaaattaggtttttctatttctgcaaaaaacacccctgggattttgaaagggattttgcattaactctgtagataggctgggcagtattgtcatcttaacaactacgcctcccaatccccaacatggaatatccttccatttatttatgtcttctttaattcttttggcaatgttttatagttttcaatacataagtttaagtcttgtgcctccttcgttaaatttattcctgtgtatttttaattctttttgatgctttttttttttttttttttttgagacagaatctcactctgtcacccagcctggagtgcagtgcagtgcagtggcacaatctcactgcaacctccgcctcccaggttcaaaagattctcctgcctcagcctcccaagtagctgggattacagctgcgtgccaccacacccgactgatttttgtatttttagtagagacggggtttcaccatgttggccaggctggtctcgaactcttgacctcaggtgatccacccaccttggcctcccaaagtgctgggattacaggcgttgagccactgcacccagccagaattgttttcttaatatcctctcggaatgttcattgctagtggataacaatgcagctgattttcgtgtgttgattttgtatcttgccatgtctctgaattctggagtgagatgtaaccattttattgtggattctttagaatttgctacatgtaagagcgtgtcttctgtgaacagaggtgattttacttcttcctttccagttcagatgcgatttatttttggccgagttgctgtgactacaacggctactactgtgttgaatagaagtccttatcttctttctgatgtttggggtaaagttttaagaaattcaccattgtatatgatattagctgtgggtttttcagatataacctttattattttgaaggaattcccttccattcctagtttattgactgctttatcatgaaagtgtgttggactttgtcaaatactttttctgtatcaattgagatgatcatttggggttttccccttcattctattaatgtggtgcatcaccttggttgattttcctatgttgaaccatccttgcatttacagactaaacctcacttagtcatggtatataattattttgataagctgctaaatttggtttgctagtattaaacattttgcatcaatattcataatggcggacgggcacagtggctcacgcctgtaatcccagcactttgggattccgaggtgggtgggtcacgaggtcaggagttcgagaccagcctggctaacacggtgaaaccccatctctactaaaaatacaaaaattagctgggtatggtggtgcgcgcctgtaatcccagctactggggagggtgaggcaggagaatcgcttgaacccggcagagggaggttgcagtgagccgagatcgtgccactgcactccagcctgggcgacagagcgagactgtctcaaaaaaaaaaaaaaaaaaaaaagaagaagaattcaccagtgaaaccatctggtgaagaaaaggccaggtcttactgattcaaccttagtagttcagagtctattcagatgttctactgctttatgagtcatttctggtatatcgtgtatttctaggaatatgtgcatctaatctaggttatccaatttgttgtatacaactgtttatgctattcttttataaaccttttactttctgttaaattggtaataatgtctccaatttcatttctgattgtagtaaactgaatcttctctctttttttctgaatccacctggttaaaagtttgtcaattttgttgatgttttcaaagaaaaactttggtttcattgattttctctgtttttctattctctacttcatttatctcagctctggttctttatgatttcctttcttctagctttcagtttaatttgctcttctctttctagttctttgaggtgtacagttaggttgtcaatttcagatctttcttctctttttaatataattattatttgtcaattatgcctcataagaagaaaagaattctgagtaaaaaataaaataatacagaatttgtcagctacataaaaaataaaacacagccatattttatttacaaaagaaacattttaagtatgtagacatacatagtctaaaactgaaaggatgaaaatagatcatgcaaatattaaccaagggaaaaattatatggctatattaatattggacaaagtagatctaaagtagaattacaagatataaagatacgcatttcaaagtaataaaaagatcaattccataggcagctcataaatttgtaaatatctaaaagcatgaatttcagttatgtaaagcttacagaactataaactgtggtttatagcttataactatagaagtaatatacaagtccggtggggcacagtggctcacgcctgaaatcccagcactttgggaggccgagatgggtggatcacgaggtcaacagatcaagaccatcctggccaacatggtgaaaccccgtgtctactaaaaaatacaaaaattagctgggtgtggtgatgtgtgtctgtggtcccagatactcgggaagttgagacaggagaatcacttgaacccaggaggcagaggttgcagtgagctgagatcacgccactgcactccagcctggtgacagagtgagactccatctcaaaaaaaaaaaaaaaaaattagtagaagaagaagtaataatacaagtctgcaatcgtaggggacactaatccactgtttgcagtatttttctttcatgtatagatttacaactataaatttccctcttaatgctgtttttgttgcatctcataagttttggtaggtatattttcttcttcatttatttatcttaaggtattatctaatttctcttgtgattctttgttagctcatttgtatttaagagtgttaatttccggccgggtgcagtagttcatgcctgtaatcccaacgctttgggcggtcgaggtgggcagatcacaaggtcaggagttcaagatcagcctggccaacatggtgaaaccgtctctactaaaaatacaaaaattagctgggcatggtggcacacgtctgtaatcccagctactcaggaggctgaggcaggagaatcgcttgaacctgggaggcagaggttgcagtcagccgagatcgtgccattgcactccagcctgggcaacagagcaagactccatctcaaaaaaaaaaaaaaaagtgttaatttccatatatgtgtgaattttcaagttttcattgttattcatttctagtttcattccattgtgattggaaaaaatgctttgtctgatttcagtctgttgaaatgtattaaaacttgtttttggccaggtgccaaaacaagtttgtgtcaaatcttttatcactatataatgcccttttttgtattttgtaatcattttaaagtctattttattgataataatacaaccactcagctctcttttaattactatttggtaaaataccttttttcatcattttacttccaacattatgtccttacatctagagtgaatctcttgttgacaacgtatagatggatcttgttttttttttttaaatccaatctgccaatcccagccttttcataggagagtttaattcagttacatttaatattagtgataaaactatattttcttttgccatttatgcatttgtttttgtatgtcttacattttaaaaattcctcaataccttcattactgcctttttgtatttttttaagtgtactttttaaactcctgtcatcattccatttctgtacatttttaaattattaacggttaacatgggggctacaattcacatcttaaatgtataacaacctagttttgttttgttttgttttgttttgttttgttttgttttgttttgagacagggtctcactctgtcgcccaggctggagtgcagtagagcaatctcggctcaccgcagcctccacctcctgggttcaagtgattctcctgcctcagcctcccaagtagctgggattacaggcatccaccaccacacccagctaatttttgtatttttagtaaagacagcgtttcaccgtgttgggcaggctggcctctaatactggcctcaagtgatccacctgcctcggccacccaaagtgctgggattacaggcatgagccaccacgcccagccttaaatttgtaacaacctagtttgaataataccagcttagatccaatagtatatactatgctcctataaatctgtctttccctctttatatgttattgtcacagattacttctttatacattgtgtactgattaacatagatttgtaattattgttttgtgcatttgcctattatataagaaaaagagaaaagccacaaggaatgccgaaagtacaataatactggcttttatatttatccacatagttccctttaccactgctctgtcttttggtctcatggcttgagtcgctgtccagtgtcctttcatttcagccttataccacttagcgtttcttgcagatcggttatactggtaatgagctccctgagctgttgttcatctggaaatgtctttattttctccttcattgttgaagaacagctttggcagatatagaattcttggttgccagtttttttctttcagaacttcatgtcatccccattgcctctggcctccatggtttccgaagagaagcagctggtaatcttacccaggccctcttgaatgcggctggtaatcatcttaccaaggctcctcttctatgtgatgtgatgtgtcagttctcttttgctgctttcaaaattctcctattcttcctttgggttttgataacttgattatatgtctcagtgtgcatttatttgagtatatcctacctgaagttcactgagcttcttagatgtgtgtattcatggttttcctcagatttggaaagttttaaccatcatttcttcaaatgttttttcttcccgtttatctctgccttcttctgggacttttataatttacatgttggcatgtttaatggtatcccacagggacctcaggctctgttgtttatttttcttcattctttttccactctgctcttcagattggatagttcgttgttttagagacagagtctcaccctgttgcccaggctagaggacagtggtgtgatcatagctcactctaatccccaactcctggctcaagcaatcctcccacctccacattccaagtagctgggactatagtacctgccaccacacctggctaatttaaaagaagaatttttttttttttttttacagatgggatcttgccatcttgcccaggtctcaattgatcctcctgccccaacctcccaaagaacagagattacaggtgtaaaccactgcacctgccagactggggagttctaattttcttatattacagtttactgatcctttcttctgcctgctcaaatgtgaacccctagattgattttcttttctttttttttttttttgagacagagtctcattcgtcactcaggctggagtgcagtggcacaaacatggctcactgtagccttgacttgacaggctcaagcgattctcccacctcctcagccccctgagtagctgagactataagtacgtgccaccacacccagctaatttttgtgttttttgtagagctggggtattgccgtgttgcccaggctggtctcaaattcctgagctgaagtgatccacatgcctcagcctcccaaagtgctgagattataggcatgagccaccatgccccactctatagcaacttttttatttcagttattttatttttcagctccagattttctatttggttgcttgtaataatttctatctctttattgatattctcattggttcatgtatagttttcttgatttcctttattttttttccatagtttcctttagctcattgacatatttaacacagttgatttaacatcttggacgaataattccagtgtctgggcttcctcaggggctaatttctgtcaaattggtttctccccctctccgtgtgtaggctacacattcttgtttctctgttttgtaatttcctcattgagaactggaaatatttgaacactgtgttgcagtaactctggagatctaattctctcagtcctcaggggttgcagaaccttgtttattgagtgttggagccatccattgtgacttttccgaactattttttgcgaagcatgccttgttatgtgtggtcactaaggtttttgttctattacctcagcagtcaccttccccagtcaaaagcagcaatcagccatcaaaatacagaatcctgaggtttggaagacaaggttcttattgcccaccccggcttccggaagccaccccaggaatagagaccacccttctctcagctgcctgctgtggggctgggaagtggggatttgaggcactaccgacaaagccaaaaattgggttctctcctggatgttgcacatgttcaactagaccccagttccacaataatgactcggaacagttcctgacaacgcaatggtcgttaagtggaaagatggcttcctggcacttcctaatataccaccacctatgacatcactccatttcttttcattgccaaagcatattcccttgtgtgcttacatcatattcccttgtgtgcttacatcatattcccttgtgtgcttacgtcgtattcccatgtgtgcttatatcgtattcccttgtgtgcttacatcatattttgtttatttgttcatctggtgatagacttttgggctgtttccaatttgaggctattataaataatgctgctatgaacattcccatatacatttttatgtggacatgttttcatttatcttggatatatacatacgcatggaattgccagatatactgattttttaatgttaaactacacttgcactcctgtaataaactctacttggtcatgatatattggattcaatttgcttgtattttgtgaaggatttttgcacatatattcatgaaaatattggtctgtaatttttgtttttatactatctttgttagttttgggcatgttatgttggcttcataacaagttggacaattgttcctcctctatgttctaaaaaagtttgtgtaattgagttgtgaggtggggtttcgctcttgttgcccaggctggagtgcagtggcgcagtctcagctcaccataacctctgcctcccaggttcaagcaattctcctgcctcagcctctcaagtagctgggataacaggcacgcaccaccaacgcccaggtaatttttgtatttttagtagacgtgcggcttcaccatgttggccaggctggtctcgaactcctgacctcaagtgatccacccatcttggcctcccaaagtgttaggattaccggtgtgagctgctgcgcccggcgtcgttacggttttgaattacacctatgtacacctgtcttactgaacacaggaaagagatattcgtcacagatctatgatggtcattacatttatttcctcaatcaataaaagagaaataacacgtaggaaagatgagttactattcccgagaaacaaccaatcaagaacatatcgaatccaaactaatgatgtgaaatattagttcttatgtcaggaatgtgatcctgcttttacttgagtgaaattaaagtgtggaaattggccgggtgtggtggctcacacctgtaataccagcactttgggagggtgaggcaggcggatcacctgaggctgggagctcgagaccagcctggccaatatggtgaaaccccgtctttactaaaaatacaaaaattagccaggaatggtggcggatgcccgtaatcccagctactcaggaggctgaggcaggagaatcgcttgagcccaggaggtggaggttgcagtgagccacctctgtactccagcctgggtgagggagtgagatgctctctccaaaaaaaaaaaaaaaaaaaaaggaacaaaaagtgttaaatttgaggtcaaggagaagaaagtggaccacaattttatataggtaatatttttgtgatggaagtaaaatagacatgcagatttaaaaataataattgtatatatgggtctactcagatgtcctgattttacgttaattttggtaatttgaatatatcaataaattcgtctacttatatttaagttgtcaaatttggggacataaagttgttcagagagccagacgcagtgactcacacctagaatcccagcaactcgaggctgaggtgggaggatcacttgaggccaggagttcaagaccagcttgggcaacatagcaagagcttgtctttaaaaaaaaaaaaaaaaattaaggccgctaccgccggcctgtgcccgcctgtgtggcgcgggcctggaggagccgtcgtgggctcgggtggaggctgctcctgtggagggtcgtcctggctcacagccgccatcatgctagcgctcatctgccgcctgccggacggtccccttcgctcgtctggaaggaggagatggagccgatgctcgtgggctgcagtactcgggcaaggccaccttcgtcactgccatcacgtcaggtgaattcagcggagatatgacggccacagtgggtttcaacacgaggaaagtaactaaaggtcatgtcacaataaagatccaggaccggccgggcggtggctcacgcttgtaatcccagcactttgggaggccgaggcgggtggatcgcctgaggtcaggagttcgagaccagcctgggcaacacggtgaaagccccatctctactaaaaatacaaaaaattagccgggcgtggtagcgggtgcctgtaatcccagctactcggaggctgagggagaagaatcgcttgaacccgggaggcggagcctgcagtgagccgagatcgcgccacgtcactccagcccgtgtgacagcgacgagtcaaggctattgtttacaggatagatgctgcagatcgtaagaagatagaagcttcccgaaacgagctacataatcttcaacaagagcaaaactccaagtcaaaaacaaaacaaaaaaaaattgagacttgttttaccacccaatgtattagtccattctcacattgctttaaagaactacctgagactgggtaattcataaagaaaagaggtttaattggctcatggttccgccggctacacgggaagcatgactggggaggcctcagggactgcgccatcatggcagaaggcagaggggaagcaggcgcatcccacacggctggagaaggaggaagacagcaaaggcgctgcgcactctcaaactacccgatctcgtgggatctaccatgacagcagcaagggggcattccgcccccgtgatccaaccacctcccaccaggccccctcctccaacactggggattacgatttgacctaagatttgggcagggacacaaatccaaaccgtatcacccagtatatggtctatcttgctgaatataccacatatacctaaaaaaagtatattttgcagttgttgaatgtggtgttctacaaatgtcaagtagattgaggtggctgatacagtggttcaaataatttgtcctgatttttttggtctagcttctctatttactgctaagaaatgggtgttaaaatctattttaatggcagaattttcatttctttttcatgtattttaaggtgcatacgtatttataagtctgctatcttcctgaatggctctctttacaattataaaatattcctatctttacggtactatctgttcaaagtctatttaatcttatatttatataaccattccagtcatagtatgctagtgtacatattgtattttttcccctttcaattcatctgtctttaaagtttcttataggcagcatataaatgggccttgattgttttttaatcatcagtcttgattagaatgttaacatgtcaataatgtaattattgatatggctggactcagcatgccacttcaccagtttttttgtttgttcctcttttggttcctgccaattctttcccttttgaggtcacttctccaagttttactcccctccactgtttgcctacctttgtttacatctcaggtttgggagagttttccccccgtcttactgagcttctggctgtaagcagcaggagggataggttgtaggaggcttatgtggtgactgtggaaccagagcccccatatatgcttttaggaagatctggtatagaattctcatttatgcacagacaactttgaaaatgtacataagaaatcggtaaatgaccaggcccagtggctcacacctgtaatcccagcactttgggaggctgaggcaggtgtattacttcagtccaggagtttgagaccagcctgggtaataaggcaaaaccccatctctcaaaaaatacaaaaattagcttagctgggcatggtgttgcctgtctgtagtcccagctactctcaggaggcttaggtaggatagctggaatccaggaggcggaggttgcagcaagctgaaatcatgccactgcaatccagcctgggtgacaagagcgagaccatctcaaaataaaaaaagaaaaattggtaattgtggagatttagagggatgacaactctggagactaagaggaaaatactttttaatacagacttttctgcactttgaccgtatgtgaatattttcaaaaaaggcattaaaaattatacaaagctggccaggtgcggtggctcacgcctttaatcccagcactttgggaagccaaggcgggcggatcacctgaggtcaggagttcgagaccagcctggccaacatggcgaaaccccatctctactaaaaatacaaaaattagccgagcatggtggcatgcacctgtaatctcagctactggggaggctgaggcaggagaatcgcttgaacctggaaggcagaggttgcagttagctgagatcacgccattgcactccagcctgggcaacaagaatgagactccatttcagaaaaaaaaaaaaaagaaaagaaaagaaaattatacaaagctgtccatttggggtggattaagcatgaggcagcttaaagggcaaatgcagcaaactgcaaaggctttatttaactcagcacctaaacctgttgacagccacaaggaagacattggtatctgatattgaattctaggcaaagctgtcttgcagataaccaggtgttttacaaatatttgtttaggacagcttcctaacccatgacctttcacataggcagtttctcccgtagaatacagcagtttaataatcatcttgcttctcaagggtatgaatgtggctaatttggacacgggaaagctggggcataggtgaggcaattaggcttccaattctaggggccacaattttcgtggccatacttaagaatcctggctggcactcatagcaatgagattcaattgtgtgatggattttttggtaaccacacggtagaaggccaaaataagaaaactctcaacaattacgccttttgctatagagctggtgtccactaaccatgtggctactgagcacctgaaatgtggctagccaaaactgagatgtgcattgcttgaggtacaagggagtttgaagacacggtatggagcacacctgtaatcccagcctctcaggaggctgaggcacaagaattgcttgaacttgggaggtggaggttgcagtgagctgcgatggcaccactacactccagcctaggcgatggggcgagactgtctcgggaaaaaaaaaaaaaaggaggcagagcgtggtggtggctcacacctgtaatcacacactttgggaggctgaggtgggcagatcacttgaagtcaggagttcaagatcagcctggccaacatggtgaaaccccatctctactaaaaatacaaaaattagccaggcgtggtggcccacacttgtaatcccagttgctcaggaggctgaggcaggagaatcacttgaacccaggaggtgggggttgcggggagccgagatagcgccactgcgccccagcctggacgacagcaaagattctgtctcaaaaataaataaaattacatatgtggtatatggtgacaatatattgtatatttagaaattgccaatagaggctgggcatggtggctcacgcctgtaatcccaacactttgggaggctgaggcaggcggatcacctgagatcaggagttcaagactagcccggccaacatggtgaaaccccacgtctactagaaatatgaaaattagctaggcgtggtggcagacacctgtaatcccagctactcggaggctgaggtaggagaactgcctgaggcggaggctgcagtgggctgagatcgcccacttagaagacagcagcaatcatgtaccttggtatttacctaaagagctgaagacctatgttcacagaaaagatatacacacaggtgcttatcagtttattcataactgccaaaacttagaagcaagattacttagtaagtaggtgagctagataaactatggtaactgcagacaacagaatattgttctgtgctaaaaagaaatgaggtatcatgtcatgaagacatggaggaaacaaatgctattgcttagtgaaagaggccaatctgaaaaggctatattctgattccaactgtatgacagtctggaaaaggtaaaattatggatatagtaagatctgtggttaccagggccttatagaagagatggatgaatgggcagagcacaagatttacagcaataaaaactattctgtaagctactagaatgatattacatatttgtcaaaaaccgtagaacaaaccctaacgtaaacagtagactaatgatgctgacggtgctaatggtgcacccgtgtaggctgcccattgtaacaaatatgccgctctggcgcaagctgttgaccgtcatggaggatgtgtaagtggcagaaacagtggatgtgtgggaattctgtttaattttgctatgagcctaaaactgctctttttaaaaaatttatctaaagaaatgacaactcagtgtttaagtattttattaaatcagacaaggaatctccacactgttgcacataacagcttttatacaatgataaggacatatcatttgtttacaaagaaagtctaaaatttcaagaacattcaaagagctaacacagtaaaggtcatgcaagttctagaatagtgaatcatgacagaactcattcattttatcctttacctccaaaaggcccatctccttaacgagaagacatctcaagaccaggagcttgtcactagtctgatatttcattcaggaatattgagcctgttagcacgtactggcttgataggaagtaactcaaccctaactgtagaaaagggttttctgaagagactcactgctgcaaaatgcatgccctgtattcatattgtgttatacgatgaacatgccacatgctttcatttaagtacgtgtgcgtaacacccgaaccaggaatctcagctatgaccttttcacttagctacgctaaatgtcagtccaagataaaagaggagattaaagataaaactgaagattaaagagactgtgagtagtgacacattcaagtgaggctgtaaatctaggtaagtgacactaagaacctgaagagaccctatgaacttttccctaggaggccgtttccaactgccctatgacaaacagctgatcatcacgtttataatgatggttcactcacggagcttcgaacttattcatacctacatttaattgatcaccacgaatgggtaggcagacgtgtcagaccttcaggggactctccttccccacagcccccaaaccttctatacaaagtccctctgctttaagtcaaaaggtcaattctggattaaaacttgtccgcactaagtttataggaggtaacatgcaaataatgtgataaagttaaaatgacttgtcaatagcaaacattataaatgtatgctactatctcattaagtagaggacctggagaaaccataaaggtaacaaaaacccaagctaaatttcaaattttgtagtaatttcattttacagtggttgaatttacccacccaatgcttaatgaccacaaaatgtttctgcaactaaaactaaaagatagggaattataggagttgggatacatgttagatactaacgatcttcaagctttgaagatgtcattgcatgaagaaaattatgggaaacactgttcccgataattacttacacccttagtgtaacatatggagatcactgtctccgatacagacactgtggtaggtaaaaactaccttgttctttatacattatggaagacactgctcccgataatgtgttaggattgtgacaaaggtactggaaattttgcaaaatgggaattagagttacaccttggataaactgagctataaaattttgcaggagtactaccacagcctttaagtgacattgatttataacttggtcacaattcactgcatttaggaaaaccagcattcttatctggtcagtgctcgcttcttagcaacccctaattaaatttaattcatctctaaatcttagcttcaactttattcaattacatttggctgacggctgttttctaaaacccttaagtgttgaccataaatgcaaaacttccagtatctgttgggttttattagcagatgctgcttttatttaaaaaaaaccgacagtataactgtcataattatggaaggcactgcttccgataattatattctattaaaaaaacaccatttatagtgaactctgtcactgataaataaacaataaatatctcagtgccaaaaggacagaaagctctcccctaagattaacactttggccaaaatttggcagcatattattctttaaagtctgacaaactgagtctgcaactaaacacctgaaactggttctctttcaatgtgctttggaagaaacaaaaataacaaagaactaaatggaggcttatgggggaagggacagaggaaaagaaaatatactaagtctttggcttctggtcccctcttttcataaatgacactgaggttaacatattaaggccttattcctgcaatcaacagttgaacctcattttatccagcagaaggacctccatttcagacctcattggcaagaaaacaagcccatctcttctgaaagttaactgtttctttcaggaatgaggaaaccagctacattccttatggaaaggcttagatctcatttggagaaggtctttcaacctggtatctcctatttagcatcaaatgaagttggaggatcactcaaagtaagcgaccacttacaaccttcagcagagaccagcccttaggattcagagagatcattcacataactggtttctgacattttcattaacaacaacaggaaagaggcagttcccattacaaagcacttaaaattctagagataggggaatattccatcatggacattttttaagtggttattcactttaacttgaagtacaggttatctaccctgtattaaaagctgctgcctaaagacatctagtagtaccaagatgatgggatggaattttaacatcaggttttgtagccctactgaaaatttagcacgatcagcacaagtctagaaaccagactaccctgctgttctcatggaagctatgggtatcacatttaaaactcattgtcaatgtcccaaacgtcaccagagagggcatttgcagctccctgaatagtccaagtagctagagccaactggtttctgaacagcgtttcattaaaagcaccgttattttgtttacgcagtttcaagttctccagtaaagctggcagcgtgtgagagccggagccccagaagacatgtcggaaaggagactcttttggagatacgtagggagagaggaagtgatactccacctacgaaaacaacacacaaggcaatttacacagccctgtgacttttgtagtaaaacaacagttcacttcaaatgtaaaatgtcccaaatttaagaatgccgatcagactttttttttttttttttttttttgacacagagtttcgctcttgttgcccagactggagtgcaacagcgctatctcggctcactggtaccctccacctcccgagttcaagcaattcatgctgggattacaggtgtgagccaccgtgcccggctttttgttgttgttgagacagagtttcgctcttgttgcccaggctggagtacaatggcgcgatctcagctcactgcaacctccacctcccgggttcaagtaattctcctgcctcagcctcctgagcagctggaattacaggcatgcaccaccacgcccagctaatttttgtatttttagtagagatggggtttctccatgttggtcaggctggtcttgaactcctgacctcaggtgatccgcttgcctcggcctcccaaagtactggaattacaggcatgagccactgtacccagccagctgatcagactttctatagcagagtaaggaaaaaagaatgctgagaaccaggctaatgctaatcttctaaggttaaaattctaaaggaggctaggcacagcggctcacgcttgtaataccagcactttgggaggccaaggcaggtggatcacttgaggttgggagttcgagaccggcctggctaacatggtgaaactccgtttctactaaaaatacaaaaaatgagccgggcgtggtgttgggcacctgtaatcacagcaactcgggaggctaaggcaggagaatcacttgaacctgggaggtggagggtgcagtgagccgagaccgtgccattgcactccagcttgggcaacaacagtgaaactctgtctcaaaaaaaaaaaaaatttttttaaaggaaactgattcattttacaaaggaaaactttaaatgtgttcagattcttttccccattggagcatacatggaagttttacagcaagtctcttccaaaaagactaggtttgactaagttctgaattagacagcagaaacagaaaatgacagctaaaccattaatgctcccttcttaaaggaattctagactcctagagtttgtccactttgcagaagtgtaagatttatcggttattttacacatactttagttcctcctttcccaaaagttcacttactctcatgacacgatcattgagtttcttcatgacaaatctgtctgttttctcagcattcccgaaatctgttgttagtctggaagtagcacggaagaagtctccacgagcagaatacagccactgtaaactcaggcccatttcctgaaacagacattattcgctatgagaagttttatttctaaggacattcttttgtatgcctttctaatttaacgtgcgttaagtaagattctgataaaaggaactcgcagataagctcaagactccgaaagcaccttgcacaggggttccaagctctatggactgtgatatacactcatatttgagcccagcatgtaagaaaaccattctcattaagaaattgaacataattatataatcctatgtactatattgtttccagttcaattctccttttgggggaaaatgtccctataggggaaaacattttggttcaaggtacttcaggatttagttatttccacctggtaagttccattttcaacagttacaattagtttcaagaaagacataagatgccgggcgtggtggctcatgcctgtgatcccagcactttgggaggccgaggtgggtggatcacctgaggtcaggagttcaagaccagcctggccaacatggtaaaaccccggctctactaaaaatacaaaaaattagccgggcgtggtggccggcacctgtagtcccagctactcgggaggcttaggcaggagaatggcgtgaacccgggaggcgcatcttacagtgagccgagatctcgccactgcacttcagcctggccaacatggtaaaaccccggcttctactaaaaacacaaaaactatctgggcatggtggcacacgcctgtaatcccagctacctggggagccgaggcaggagaatcgcttaaagccgggaggtggaggttgcagtgagccgagatcatgtcattgcattccagcctgggggacaagagcgagacttcatctctcaaaaaaaataaaataaaaataaaaataaaaaagatataaaaagattcggttgtcagtgatttacttcaattaagagatctgttaaaaatcaactcctagtaccataaaacaatctggaagctactttaatattagttttattaatttatttagagatgggattttgctatgttgcctgggctggactccagcaatcctcctgcctcagcagaagtagctggggctacgggtatgcaccacctcaccctgcttatcagtttcgtttaatagaatatttgacttttagatgcgcagatcactacgagatggaatcctgctagctgtgctgtctttccatccgggtcacgcccgagaggcacacagcccaactccttgctgagatcttcatattccgtgtcctactgacgggctgcctgggagacatgagtgacagaaaacctgacactgctctggattctgaaacacctgctgagctctgtcctaggtctctaatccacagcctcccgacttctctcaaacaagttaccaattctacatacaattatacctcagttcactttaaaatgtactatggctacaatcacccttccaacaggaacacacaggaacacatcacatttcaaaatacttgacattcagcaaaataaaaacgtaattggaatcagtgctcacctttatgtctgctctgtattggttcagatccctcacaaatgaaagcagttggctgttgtacctctcatagtccaggttcaattcaacatcatgggttagtttaatcacgaactgaccagcgacctctgcagctgctcgtgccactttgttcaactcaggaatcctctcaatcagttccttataggtgtccatggtggtacccaaataaggataatctgtgtcctgcaagacaacgcgaggctatggtactcacgtgagttctaagagcaagagcctcacattctggcttcgccatcgaggtaacagtgacgacagttccacccttgcttctaacatattcctaccgcaatttaccccaattctatctcattatctgctgctttaagtacattcttgctacttctctcaagctaacctactcctagagtgactactttcttccaggttctacagaatccctgttctatcgtatcatatgccctgaatagacttctagccaaattccttaaggctgtatgtttttctctctgggaagtttgggcctttatcaatgaaaaaagagaagatacatgaaacataccttgagacgaggtctctctgtcacccaggctagagtgcagtgatgcaatcacgactccccacagccttgagacaaggtctctctgtcacccaggctagagtgcagcaatgcaatcatgactccccgcagccttgagacaaggtctctgtcacccaggctagagtgcagcgatgcaatcatgactccctgcagccttgagacgaggtctctctctgtcacccaggctggagtgcagtgatgcaatcatggctccctctagccttgagacgaggtcactctgtcacccaggctagagtgcagtgatgcaatcacagctccccgcagccttgagacgaggcctctctctgtcacccaggctggagtgcagtgatgcaatcatggctccctgcagccttgagacgaggtcactctgtcacccaggctggagcgtggtgatgcaatcatggctccccacagccttaagctcctagctcaagtgacccccctgcctcagcctcccaaggagttgggactacagctggccactgggccacttaatttaaaaaattttttgtagagatatagtctaggcacgttacccaggctggtctcactcctggcctcaagtgatctgcccacctcagccacccaatgtgccggaattataggtgtgagttactgcacccagcctgaggaaaatactgttcagctggactgtccaatagatagccactgctcaatcactcaagaaattcagccttggttttttttttgttgttgttagacgatcttgctctgttgcccaggctagagtgcaatggcacgatctcggctcactgcaacctctgccccctgggttcaagcgattcttccacctcagcctcctgagcagctgggattataggcatgtgccaccatgcccagctaatttttttgtatttttagtagagatggggtttaaccatgttggccaggctggtcttgaactcctgacctcaagtgatctacccgccttggcctcccaaatgctgggattacaggtatgacccaccacactcggccaagcctcattattaaaactcataaagaagttttagcaataaactcaaatgctaattaagctaattgagattaacaagtctatgttaaaactaataatgaaggaacatgcaataattacatgtgtataacttttttttttgagacagggtcttgctctgtcacccaagctgcagtgcagtggctccatctcagctcactgcaacctctgcctcccaggttcaagcgattctcctgcctcagcctcctgagtagctggggttacaggcacacgccactatgtccgactaatttttgtatttttagcagagacggggtttcaccattttggtcaggctagtctcaaactcctgacttcgtaatccgccttccttggcctcccaaagtgctgggattaagggaggagaccacccctcatattgtcttatgcccaatttctgcctccaaagaaagaagaagtaaaaactaaaaggcagaggtggacagcccagcgctgccgcaccctggtcctggttaaagatcgagccctgacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttgccaaagctcccagccaaataaagcccttccttctttaactcggtgtctgaggggatttgtctgcggcttgtcctgctacaggattacaggcgtgagctaccacatccagcacatgtgtataacttcttaaaacattttaagcactgcagtaaatttggtctcaaagttgacacaagaagatccatggccaggtgtagtaagtagctcttgcctataatccaaacagtttggaggctgaagggggaggactgcttgaggctgcagtgagccatgatcgggccactgcaccccagcctgggtgacagagcaagtcaccattgtcaaaaaaaaaaaaaaaaacaaaacaaaaaacaaacaaaaaaaacccaacaactaagatatgtgcaagttgtcaaaatcaaaatggagtcactagtgttaacaaaaatgcaaccctgaagagaagggtctcacccttgtatgtctgataacaaggattaagggtttttttttttcctttttacaaaaactacaaccttacacaaaggccactgcaaccttgcaccaaaaaacttctctcgtgagaaaatctgcctagcaactgcctgtcaaccttggactggtgtcatccttgttattgatcttggtagccaagaataattacctcaaagtaattttgtaatcctcgtcatttgtccttaaaaacttgttttcctttactcctctgaatatgtacatagttgactatagcacaggcattcccattgcaatgccctattcccaaatacagatcacttccttttagagagcctctctccatttgtcatttaaatgaacagacttacctcgcaaaaacagaaagaaactgctgggattccagaatatgcaaggaaagggaaagcagcattgtctaaagtgagtttctcactgcaaagacaaagaatgtgtctttagaaagtgttttaaagaatagactgttctatcgtgctagtccccccatccaaaataaattctttagctgaatatctttaggtgtaagtaagttcaatgcaaggacagatttagattctacctaatgtagtaggtagaatctctgcttttctattagtttgttcattcacttttctcaacttacactttgctggcccagttgctgtcctgatatagaaattgcccagtaaccggatgcttcacctgtaagataagaaattatcattaaaactaaccttttggaacttatttattcaggctagtcactaacatgttactctataacaatttttaaataaaaaacttgtattatatcttcttgaaaagaaattatttatgatagttaaaacaatctcaactttaagttattactaactaggctcatgttgtcagttcctttagttatggtgaggaaaaaatgttttcttcttaattaacattttaaaagtgggcctaggccgggtggggtagttcacaactgcaatcccaacactttgggaggccgagctgggaggatcacttgagcccagaagtttgagactagcctgggcaacacagcaagactttatctcttaaaaaaaaaaaaggaaaaaaaaatgaataaaagctgggcgcggtggctcacacctgtaatcccagcattttgggaggccaaggtcaagagatcatgaggtcaagggattgagaccatcctggccaacatggtgaaaccccgtctctactaaaaatacaaaaattagccaggtgtggtggtgtgcacctgtagtcccagctcctcaggaggctgaggcaggagaatcgcttgaacccaggaggtggaggctgcagtgagccaagatcgcaccattgcactccagcctgagtgctggaggaagacagaggaagactccatctcaaaaacaaacaaacaaacaaacaaaaccatggtggcttacccacaattgtaaaagccctctctgggcttcacactatgcctatcttgtttctggtttcttccttctagtgcatcttatgccaccaacctaactggcaaattcatgatcaccttgcttgagatcctataatccctagtatctcttggatcaaggccaatgtctgctatctgacctgtttctaactttactcactccaatatacagcctctaatcccattaggcaaatattttcttttttatttatttatttattttttttttaattatactttaaattttagggtacatgtgcacattgtgcaggttagttacatatgtatacatgtgccatgctggtgcactgcacccactaactcgtcatctagcgttaggtatatctcccaatgctatccctctcccctccccccaccccacataggcaaatattttctttcacatgctctccctcattcaaaactatggtaattgtttattcaatgaatatttcctccggccttctcaaagtatagttcaagttgatttaagccttccttagcattgtgactctatagacaatcccctgtgggcccctgcactacagcttaggcctcatggcattttgttatatattcctaaataaacaacatattctttaagattggagccctcatctcatatggttcaataggcaagtatcccttaaataacgctgctataaaatttattctcaattcctattttttgttactgactacggtttacatatcagtgttttttatctcaggttgattcaacaaaaattaagtcatacatttttgtaatgaggtatatactcacattttgcattgttttctcaataagcgtatacaacagtgggctggcagaaaccttgaagttgctggtacctgaaaataaattgttttatcattgccccttctccattccgataattttcacactgctacttctacaactataagtacttgacaaataagacagtaatctagatcagtggccctgtgcaacaactatcccattcatcaagtaaacaaaagtaattttggtatcaagctctttagcaactaagctaacttcactcaagtgggctcgtactactccttgagtttgcatactttaatccaagtcaccttttttaaaaatatcagagcagttaggccgggcacggtggctcacgcctgtaatcccaggactttgggaggcccagacgggtggatcacaaggtcaggagatcgagaccatcttggctggcacagtgaaaccccgtctctactaaaaatacaaaaaattagccgggtgtggtggcgggcacctgtagtcccagctactcgggaggctgaggcaggagaatggcatgaacccgggaggcggagcttgcagtgagctgggatggcgccactgcactccagcctgggtgacaaagcgagactccatctcaaaaaaaaaaaaaaaaaaaaaaaaaaaaatcagaccagttttaggttcagcagcaaaattaagagaaaggtacctagaggtcccataaatccactgcccccacacatgtgcagcctcccccattagcaatttcatgtttaactttctggttcacccaggttagagctatacatagtatgcttgctatactcagcacattctgcggcaaacatacaacagggaaataactaacctagagaggtttaattgtaactctttccttttttcccccatgtagacatttcactattctcagctcatcagctacatctgcactttcttttttaccccattcctgttgaatgtacagctgcactttaaataacattcaaacccttttgtcaattttctgctgccagtgaacattcaaactcttctagaagtttcattatccaatatttctatcagtgatgccacaacgtaacaggatgtgaattactctctaagtaccattctatatggcatagtttagtttcttctcacctcaatatagtccagacttatggtcctaaaactttagtccatcagaattacctgtagtgcttgttaaagttttttgtttctttgtttgggtttttttgcttcaggatactttgtccttaagaaaataataggtttttattccccaagggttgccaaaaaaaaagcccagtttttttgtttgtttttttgagatggagtctcgctctgtcgcccaggctggagggcaatggcgccatcttggctcactgcaacctctgcctcccgggttcaagtgattctcctacctcagcctcctgagtagctgggattacaggtactcgccaccacacccggctaattttggtatttttagtagagacggggtttcaccatgttggccaggctggtctcgaactcctgacctcaggtgatccgcctgccttggcctcccaagtgctgggattacaggcgtgcaccactgcgcccagcccaaaaagcccagtttttagaccaacactcccatttctgactcaaaggtctggggtagacatgacagtttgcattcgtaacagttcctaatgctactcatctgggggccacactgagaactacccactgttctagacaagcaattgtgctcactgtgtaacttgacagactatttaaaggaaggttaagatacaggctgagggcaatggctcatgcctgtaaccgcagcattttgggcagctgacatagaatgcttgaactcaggagtttgacaccagcctgggcaacatggcaaaaccccatctctacaaaaaaaattagccaggtggctgaagtgggaggatcacctgagcccaggaggtcaaggctgcagtgagccaagattgtgccactgcactctagcctgggcaatacagtgagaccctgtctcaaaaaaaaaaaaaagctttcttccacttcaaagtagtttatctggccaggcacagtggcccacatctgtaatcccaggccgaggcaggcagatcgcctgaggtcaggagttcgagaccatcctggccaacatagtgaagccctgtctctactaaaaatacaaaaaattagctgggtgtggtagtgagcacctgtaatcccagctactcaggaggctaaggcaggagaatcgcttgaatctgggagacagaggttgcagtgagccgagatcgtgccattgcactccagcctgggcgacaagagcaaaactccatctcaaaaaagtttacctgaattcatacacagctaatgaaagggatacttaccaagaaccgctttatccagattaatataagtgaaagcctttaaatgcagggacgaaaggtatccctagaagagaagggaaaacactaataagtataaatctgtttatttatcacatacagtagcattagggattcattttcaattctggactctactgagactaaacgcaaaggcaaaagtggtaaaatcaaacctataaaaacatcacttctggacaacagcctaagcccacaagctcgtgtccaatatgggaagggatgataaagaatacctctagccattcagtggcaccaaccgatccaaagtctccagcactccaactggcaaagataatgcttctgctgggctgaaacccatctgaaagagaaaaaagttagctttacctgaggaaaggttatacacagacaaggatggaaggtatcccacttaagatgaatcagaaggtctaattccaagatagcagattccaaaatcttttttttctgagccaaaaaagaaaaaaaaaactaacaaaatctttttttgagaccccaggtaaaagaataaaagaataggaataattttttttaaagtaacctacaaagagcaagataggagatctgcaaataagattttgagtacatagcaggggccagtagtcaccctttcacaatttcattcttggagttccttaacttctggacccagagatcattgaaaacagtgtaagcatgatgatgcacatcttgagaaaaatcttcagaggtaaatccaaacattggatttttaaaaaaataattctaaaataaaataaaaattcacaaatttaagttacaagaagagtttgcagagaaactatatttgtgacagcaccttttgaggttacatgtatcacactgccctccatccctcccacttccctcactgtatctttttctccattaatgtactctgtattaaagttaagcattgcagtttgccctaagacccaaagattcaagaatgtgacgtgattttgaatgtgtgggtgggtaggagtgtgaaagagtggaaagtaggacagaaaggctcaaaaataaacaaaagaggcagggcacggtggctcactagcagcattttgggaggctgaggcgggtgaatcacttgaggtcaggagactagcctggccaacatggcgaaaccctgtctctagtaaaaatacaaaaattggccgggtgtggttgtgggtgcctgtaatcccagctactcaggaggctgaggcaggagaattgcttgaagtcgggaggcagaggttgcagtgagctaagtgagatcacaccactgcactccagcctgggcaacagagtgaaactctgtctcaaaaaatgaataaatgaataaacagaacaaaatttcaatagctgttaggcctcagtacatgagtagagaggtatgctactgctttcaaatagattgcttagggactatgatccaccttatcactctggatccaccacactaagcactagggctcagtaactccactgtctcaaagaaactggtgatttctagcacagttaagacactttatggaaagctgtttcaaaggaaaaggcagctacaacaaaagacaatctgccttgtatttaagaactagagtctagcatgagaaccacaggaatgcaggcaaagtgagcaaagcacagtataacatctagaactgtatgcagtgcaccaatattcaaaagaatcaaaatttgtactctaccttttaagaccatatctgagaacatctgggcaagtttcaataggagagctgtgcctacaccggattttgcagctccagggccccatgcatctctctgggccccaactacaacatagtgatctttaaaaaagaaaaaagaggaagaaagaacttatataatcagcttctaaacttttctagaattagcacatcagtagaaaggtaaaagcacagtatatgtattaaggataaaagagccttacttcaaatctgactaaaaactctgggaattaaaaattcacatgagaatattaattttaccttactagtagagctacttttttcctacactactaattaaatttactgactacttaagtccaaggacttatttcttagtaagtgttggctgtttgattgcatttaaagttaactccagggactggcaaactacagcccgcatgcccattcactacgcacagtctgtgcctgttttcttgctcccacagagttgaacagctaaaagagagactgtatagcctggcaaaaggtttattatctgcccccttaagaaatttgcttatcactggtctagtcaataacttagaatagattttctagtcataatggtcaatttttaacaagaatttcctagggccttattacctcccaataaaactgacacataggctgggcgcggtggctcatgcctgtaatcccagcactttgggaggctgagggaggcagatcacctgaggtcaggagctctgacctcatggagcctgaccaacatggagaaaccctgtctctactaaaaatacaaaattagccaggcgtggtggcgcatgcctgtaatcccagctactggggaggctgaggcaggagaatggcttgaacctgggaggcggaaattgcagtgagccgagatcacaccactgcactccagcctgggcaacaagagtgaaactctttctcaaaaaaaaaaaaaagaaactaacacataaacaattaactttaggacagacaagattgagcacttcataaaaccaagccaagccagcattcctacactcgctccttctctagccacatccttaggaacagaaaagaaaacaaaaaaaaagcggggcgggggggggggggggcggtctttacctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcctagaatcagaaagcaggcgtaagttctgagttattgttccttgcccagggtttactcctgtccagtgaagttacagattaagaggacatataaacaaaacttactctcagcccggcgaagtggctcacccctgtaatcccagcactttgggaggctgaggcaggtggatcacaaggtcaggagttcaagaccagcctgaccgacatggtgaaaccccgactctactaaaaatacaaaaattaactgggcatggtggcatgcgcctgtaatcccagctactaaggaggatgaggaggagaatcgcttgaacctgggaggcggaggctgcagtgagccgagatcacgccactgcactccagcctgggcaacagagcacaagtcctgtctcaaaaaaaaacaaaacaaaacaaaacaaaataaaaacaaaaaaaaacttactctctagtggtgaaccatttgcgtcttactttgatctgcaggcagccaattggaaaccattaattaagcaatattttaaaacacttctctaactatgcgcctttctgccagacatacttacgtagtttatatttggaatacataccaagatggactcaaaatgaagttcttctaatatataaaagaatattaatacacttttatgtttcccaactgtcaccactaacaaggatagtacacattcttagctcagttataaaaaatattcctcagctgggtgcggtggctcacgcctgtaatcccagcactttggaaggccgaggcagaattccttgaacccaggaggtggaggttgcagtgagccaggatcatgccactgcactcctgcctgggcaacagagtgagactgtcaaaataaaaaaaaaatcttgtgcttcccctatctaattcctctgtgttacccaaataatagctgctcctaagggggcttacttacataaatataggttgaaacattattactcccctactacataaggataagatgggacgctggcttcacaggttggttacgatttgtaggtggtaggtagaatgagtcaaaaaaatcacctatgctaaatgcctcttagcgttatcaatagtcatggtatgttacacactcccctatgctaaaggcctctcagcatgatcaacagtcatggtatttcatatactccttatatacagatgttcttcatttgagactatcaagtagaatatattttcactatccaattatgttaaagaaacaggatcagagaacctatgtcatacaggagataaatgctttcataaaggcctgaaactagatctccatcctgtaataacaggaaatgataaatatgtccacatccaaatcaaaattaatgctacgtactctaatggaactgggctctgtttttaaagagagacactaacgttacagggaggatatccagaggagcgagccacaaccataaatggtttctctggaaaccatcataagaagcaaggcttctcaatctatagacaaggtaactggaatcataccgtattgcttagaagaaaaatccagacaaatggatgtttcggggaataggattttatcccaatatgaattctaacagattctctctactaactgaatgggctgctataggcatcgtgcttcagcacagaagtacttgagcagaagctatgccaggaatcttgcacaaggaattcactgggtttataagtctccttattctcctgtgtttataagtccaaagtccattattaagatctctttatagagaaaaattcatttatatctgtaccaaggtaacagctaaccatcctccaaattcccaaatgtggaaaattatcatcatgtttaacattttaatcaacatattaccgttcttccctaatcataaaacctcactatgcaagaccgctttcaaataaaaacttacccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcctaggaaaacaaaagagcaattcactccatcacatacttcctcaaaacttctctgtaagattcaggtttggtataaggctgcagcccaaccttagtttaccaacttgaagcctcaaaaatctgagtggctctacaatgtgactcctgttttcatggcatatggaaattctcaaattcaaggcactattgacaaagtacttttagcaacaaataataaagcctcaaagtcaatgtaatctatcttcttgcttactgctaacgccctcccagaaaaaagagcagttaaggaagacacagtgctatttctgctaatacaggaatccaagaacaactcaaggaactcaaaacggtgatttactcaagaaataactcacatgtccaaagaatgaaagttctgcgttaacaatgggaaatttagtctggtccatgtatatcaacacaccaattgcatttaagctttcagcatttgcaacctaaaagaaaacatataaagctcagaaaatgaagatctgatcatacgaaatgagaatacatcctggacattatgctaaaggccaaatggttacagaggactaaacttataatacttccaaatatttcaaattgtttatctggtaatttattaattgcttcctgaaaaattaactcacttgtttgcaaaataagagtaacgggccaggagtggtggctcacgcctgtaatcccaacaccttgcaaggctgaggcagggggatcacaagctcaggagttcgagaccagcctggccaacatggtgaaaccctgtctctactaaaaatacaaaaattaactgggcgcagtggctggcgcctgtattcccagctatttgggaagctgaggcaggagaatcgcttgaaaccataaggcagaggttgcagtgagccaaaattgcgccactgcactccagcctggacaaaagagcaaaactccctctcaaaaaaaaaaaaaaaaaaaaaaaaagaataacaaaggccaggagtggtggctcacacctgtaatcccagcaatctgggaggccaaggcaggtggatcacctgacgtcaggagttcaagaccagccaggccaacgtcgtgaaaccctgtctctactaaaaatgcaaaaattagccaggcatggtggtggtgggcacctgtaatcccagctactcagaaggctgaggcaggagcatcacttgaacctgggaggcggaggttgcagtgagctgagatcacgccactgcactccagccagggtgacaagagactccgtctcaaaaaaaaaaaaaaaaaagaaaagaaaaataacaaaaacccatctaagacaaccacttttttgagtctcactgtcactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgtttggctattaattttcctttttataaaacatgcttttagctgaattctgtatatgcgtaaaactgagttatacagagaaatagctttcacttaagcacttctgattaggtaagtggaacttacttcatttgttgagcattttaataaattatattatctggtatgagagtttaagattgctgattttcagaatgtaagaatattaacaagaaatatcacttacctgaagagtaagataccaaaagtactgtatttaatattataataactcatactcaccttttctgcaaaggtgattttccctgctctgacaatcactatagatccattcacaggagtgtataaatcctcaaaatcttttttagtaccaaaattagcatggaccagtttaccctagaacaaagacattagatttaatgagcattatggtatcggaacagctctaaaatcttgagacagaagagtgttatagatcaaacctaagacaggcaacccaagtaagagataaaaggaggccaaggcctaaaaaagacatgagttctaaaaaactttacaacttttaggtcagagctattggaataaaatcaagatttttggcctcctatgtctttcatgcttttatcccatgctgcctttcatctgaagggcatttagattaaagaggcctatgtaggctggtcatgggactggaggcctggaacaatcttagccttgaggacatcatagaaataggttttaactgaaaggtctgataataaatctgtcccaaaattaaaacaccatctattacaacaaagtgacttgcatacaccaactttagatgtgtcatgatgttcctaagctcataagagtccagatgaacagccataaactgacactaacaaccaagccctcaatacagaaagcttgaagttgaacaaaaatcttcaatgttctttaacagaacaacctacccatctctaaactcctggcttataggcagccaggcaaagggataaagcacaagtatccagaaaggcaaggaatcaacacagaactgcaccagccccgaaaggtatccactagagatacgcctgacttacaaatgtgattttttttttttttttgagatggaatttcgcttttgttgctcaggctggagtgcaatggcgcaatatccgctcactgcaacctccacctcctggcttcaagcgattctcctgccccagcctcccaagtagctgggattacaggcacccaccaccacgcctggctaatttttgtatttttaatagagttcaccatgttggccaggctggtagctctgaccttaggtgatccacccaccttggactcccaaagtgctgggattacaggcgtgagccaccacgcccagccacaaatgtgatttttaagctgaaaattattctatctatctgttctctatttctgtgttaatttgactatatttgcctaaatttaaaaagatcaagggctgggcgaagcagcttcctcctgtaatcccagcactttgggaggctgagggtggtgaatcacctgagcccaggagtttcaattgaagaccagcctggccaacatggcaaaaccctgtctctaccaaataataataataataataataataataataataaaataaaaaataaaaattaactggacatctcagctactcaagaggctcacttgagcctgggtggtggtggagaatgcagtgagccaagctcacgccactgcactccagctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattcaatagggaagagtctcatgcactgttttgctttacttacagtaactgttgcagccttactatacgccacataacccccaggattctccaccaggtaaacaagtctaccgttcttatcaactatgatcaccgagttttgagcgctgttaaaaagattaagttaaaataagcctaaggtcatccttccaaaaaacacaatagcttacatttagtatgtcttgcattatttggcttgaggaaatttacctctaaatcttaagcttgatttttattttaaaagcctttgggccgcatgcggtggctcacgcctgtaatcccagcactttgggaggcccaggcgggctgatcacctgaggtcaaaagttcgagaccatcccacctctactaaaaatacaaaaattagctgggcgtggtggcgtgcgcctgtaatcccagctgctctggaggctaaggcaggagaatcacttgaacccagaaggcaaaggctgcagtgagcagagattgtgccactgcactccagcctgggcaacagagcgagactccatttcaaaaaaaagccaacaacactaacaaaaagtctttgctatatttagcacacctgaaaatagctacttgtataaaaataagtttaccatctttcaacatacctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcctggaggagaaaatgccttttaaatgaacttaagtttactttaaaataaacatttaagtcaaggattaaacaaattgttttgaaagcaaaatattatccctcatagttcagataaatgaactgtgacccaaaacttctagactgaccagaatatcacaaaagaaaaaaaattttgccccaaatcttgtaacttcaaagcttctttacccactacaaagcactccttcaagagcctcatcataacacaatgtatctgcttaggatagttttaggggaaatgagtagcttccagatctactataaaatctaagatagtaatactgtgctgaacagagtgcatagtttcaattctcacctacttgtgaagcatctgaataccctgaagcagaactgctccttggtccgatctcccatacttctttctatttactcagcatattagttcttacatttttgtggggtggactatactctcactttaaccataaggtctggtgtacagtaaataaacacaaaagcatcaactagatgaagtagaaaatgccataacttaagactaaagaattatagtaccactgtaagtgtaggaagcttgcaaaaaggaaaagataaatttattctttgcacagaggcatgtatgtgcaaagatagtaaaactctatggacaagtgttacagctcttttagaatttgtctagcatgctttctagtttttgccagaaagcccattacaaataaaataaataaataaatataaaatagaaatttggccaggtgcagtgcctcatcctgtaattccagcactttgggagccaagacaggaggatcatctgaggtcaggagttagacaccagcctggccaacatggtgaaatcccgtttctgcaaaaaaaaaaaaaaaaaaaaaaaacccacaaaaattagcagagcatggtggtacaagcctgtgatctcagctactcaggagactgaggtaggagaattgcttaaacctgggagacagaggttgcactgagctgaaatcgtgccactgcactccagcctgggcaacacgtaagactccatctcaaaataaataagtaaataaataaaaatctaagaacagaccggcctgggagacatggtgagactccatctcttaaaaaaaaaaaaaaaaaaattagctgggtgtggtgctgcgtgcttatagtcccagctactcaggaggctatggtagggggatgaagctgcggtgagatgagagcacgccaccgtattccagcctccaccagagggagacattgtctctggatactgactggcctaggggttaatgggtgagtatcacagaaattaagaagcactagagacttaaggcaggcagttacccatgatcaaggagatgaaaaaggctacttctggcatgtgttgcttcctaaaacagagaaaagctactgatgtccttgtcagcaaagcagagcttagtacaacgttacaagaggttaagaagaaaaatcagagccagagaatgacagcaagcaataagctacaaagatggggaaaacatcaagggcctattaattttttaagaaaaaggagactccccagagaagttctaccttttcccctaccagtatagtttcagttttttacaggccccttcccctctttagctaaacatgacaagtcttgtcttctctaacaagccattccccacagtgtcaccattattgtttccccgtggcctatcataattcttgaattacttgtctagatacttgcacagcagctggcactcacttgatggtgccggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatcctaaagagacaaagttccagagctgaactcagaatttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagcatttgcttcctggtggagtgggagcaaacaaaaaaatacataaataaaaagaaaacacttgcacgtcgtattgaaataattcatgggtctctctttccaaccagattaaattcaatgacaggtatagaatctactcatgattgtcttcctagtggcacttaaaaaggcataaagtggacgggaaagtggctcatgcctgtaatcccagcactctgggaggctgaggcgggcagatcacgaggtcaggagttagagaccagcctgaccaacatggtgaaaccccgtctctactaaaaatacaaaaattagccaggtgtggtggtgcacgcctgtagtcccagctcctcaggaggctgaggcagaagaatcgcttgaacctgggaggcggagattgcagtgagccgaaatcacgccactgcactccagcctgagccacagagtgagactccaactcaaaaaaaaaaaaaaaaaaattagccaggtgtggtcgtgggcgcctatagtcccagctactcaggaggctaaggcagagaatcgcttaaacctgggaggctgaggttgcagtgagccaacatggtgccactgcactctagcctaggcaagagagtaagcctctgtctccaaaaaaaaaaaaaaaaaaaataaggtacaaaataactatatgctgagctgacataacagacttcccagagttggttatagaaaacattgaagtttggaatggtcattctcaccaatcaagaaaaagacgatcacagcaatagtcccatagcagatacttccactacacctttttggttttgtgacattggcctttgtgttattgtcagcattttcttcttcatctacagcaagtttcatctccacatgactgttatcgccatctacttgccgagccaggctgaaccgggtatatgacaatggttctccaccaaactgtgttgcggaaaaaggcatgatgaagaacaggcacgggaatgtttaggaaaagctcgtttaggtatatgcttgttattgggccattactataacttgctatatattccttagggtgttctcctttcaaaccaacattcttccctgggcccagtcaagggctagttcacactggtcttctcagtcagtctctccctttttgtaaatttttttttttttttgagacaaggtctccctctctctcccaggatggagtacagtggtgtgatcacagctcactgcagcctcaaaatcctgggctctactgattcccccacctcagcctcctgagtagctgggactaggggcacaaatcagttcaggatactatgcagtaacccagaccatgatgttggtgggagcaagggagcaagaataaaacaaagttataaataagcagaaattctgactaagcataagatagaagacagaaaagagagaatagaccagacacagtggctcatgcctgtaatcccagcactctggggggggccgaggcacacagatcatttatggtcagaagtttgagacaagcctgaccaacatggtgaaatcccctctcactaaaaattcaaaaaaaaaaaaaccactagctgggcatggtgtcgcacgcctgtaatctcagccacccaggaggctgaggcaggagaatcgcttgaactcaggaggcggaggttacagtgagctaagattgcacactgcattccaacctgggcaacagagcccaggctgagactccatctcaaaaaataaaataaaaataaataaataaataaatacaaataagagagaattgaggtctagacagagtgttaagagttaggctccttctcgtcatggcctggatggctgttttttttgtatgttctttcagctttcactcatactgtctactcaatgtttcttaaaatttcattttttttttaatagagatgggcttgctatgttgcccaggcaagtctcaaactcctcaagtgatcctcctgcctcacctcccaaactgctgggattgcgggagtgagccaccacacttggcctcattcagcctttgcttttttttttttttttgagacggagtctcactctgttgcccaggctggagtgcaatggcgtgatctcagctcattgcaacctccgcctcccgggttcaagcaattctcctgcctcagcctcccaagtagctgggactacaggcatgcgccatgacactcagctaattttttttttttttgtatttttagtagagaccgagtttcaccatgttggtcaggctggtcttgaactcctgaccacaggtgatccacccacctcagcctcccaaagtgctgggattacaggcgtgagccacagcgccccgcaagcctttgctttttacttctcctactaaaacattttgatcagggctttaattcgtcttatctactaagctgtccccgtctaccacacccagaaccactctgagaattcttccaagactttccataattaaccctactgaaggctgaactctttgtgagatcagttatgcctcaagactaccaattcaaatgtaaatgaatacctgataatagattggggttattatttcatgcttactcagttaaagtcatgcttgtatatttcacattcttgcagacacagaaatacaactgaaaatatcttaccaagttagagaatgctgatctagcttgatccatcattctgaactgccacacagaagaacctaggtatcagaatagagaattattgagaaagatactactgtatcagattagtgagctttctattaccaggctaaatgatacattaaatttttaaaatacattatcacttttctagaaaaggtatttaaccatagtttacatgacaactaaattaagtgggatcctttttaaagtttgttatatacataattctttttttttctttttgtagagacaaggtcaccctatgttgcccaggctggtcttgaactcctggcctcaaacaatcctcccaccttggcctcccaaagtgctgcaattataagtacgaaccactatgttctgagtagacaaaagtgacacatactgctgggcggggtggctcacacctgtaatcctagcactttgggaggctgagatgggtggatcacctgaggtcaggagttcaagaccagcctggccaacatggagaaaccctgtctctactaaaaatacaaaaattagccggacgtggtggtgggcgcctgtaatcccagccactcgggagcctgaggcaggagaatggcgtgaacccaggaggtggagcttgcagtgagccaagatcgcgccactgcactccagcctggaaaacaagagcaaaactctgtctcaaaaaaaaaagaaagtgacacatacaaaaagacaaaattaagactaaggcagacaagaccagttatgctacaaataccacaaaccatctccaatgggaaggggaagaaatactgatcctgactgaatgaatagttcctacaagtgattcgatctttgacacaagaagaaacatgaaacacagattacgctgttttacagatgaagaggccagttattagagaaactaagtggcctgttcaaggctgaaaattgataatctaagcgaagttaaatgggttactgggttatagaaattgtgttatcatctctggaaatttaagacattaaccttaacttttgtcaaagcaaaatacatctctgtaatcaaagtcctaagttaagttaaaggccttaactgaaatctgaattttccagttaatttggtttgagggcatctagatacttgaaaatgacattatcctgagatttgcaaaatggacatttattggataccattttaaagcttttcctatatacgagtacacttagggcatattaaacacacacggcacaaagcaagctgtgaggtatacgcaaattgtaaagcaaagggtattataactggcattaagaaaaagctttctggccaggcacggtggctcatgcctgtaatcccaacactttgggaggccgaggcaggtggatcacgaggtcaggagtttgagaccagcctggccaaggtggtgaaaccccatctctactaaaaatacaaaaattagatgggcgtggtggtgggcacctgtaatcccagctactggggaggctgaggcaggagaatcgcttgaacccgggaggtggaggttgcagtgagccgagatggcaccactgcactccagcctgggtgacggagtgaaactccatctcaaaaaaataataaaaaagaaaaagaaaaagctctaaaacctattacaaaaaattctttttaaattcaagctttaaaaaccagtgtccatatgcaatagaccatattcttagaagcataatctttttttttttcttgagacagagtttcggtcttgttgcctaggctggagtgcaatggcaggatctcggctcactgcaacctccccctcccgggttcaagccattttcccacctcagactccgagtagctgggattacaggtgcccaccaccatgcccagctaatttttgtatttttagtagagacgggattttaccacgttggccaggctggtctggaacttctgacctagggtgatccacccacctggcctcccaaagtgctaagattagttacttgataagaacatcccaaggaaatcgaaggcgtgagccactgcgcccagccagaagcacaatcttttgccccttctgttacaaaaagcttatcactaccactccaccagaacagtaaggacccaatcattagagccagaactggaaggccccaccctgaaccaattttaatcatccttttctaggaaaaaacatcttgcaagttttaacactcatctgaaccatcattcctcaagttttcttgttttaaattaattttaagaacacaaagcgatggccgggcatggtggctcacgcctgtaatcccagcaacactttgggaggccgaggcgagcagatcacctgaggttgagagtttgagactagcctgaccaaacatggagaaatcccatctctaccaaaaaaatacaaaattagccgggcatggtggcgcatgcctgtaatcccagctactggggaggctgaggcaggagaatcacttgaacctgggggaggtggaggttgcagggagccgagatcacaccattgcactacagcctgggcaacaagcgtgaaactctgtcaaaaataaataaataaataataatctaagctacttgtgttatctttggtgttctcaatggtgactgaaaacaacaattcaatttctcacattaataatgaagctcaggtaggcaaaacgtagccccacgttttgaaccatgaaatggaacacattcactgcctaacaacttcactaccctctattttctccaaaatcagacagaatccagcccctgtttttacccaccaacattcttctctgttccttgaggtcctcctcatttcttccaggctcagctcaaggcttcatctctatgaagccttctctgactgacttccctatcctgtaataactggtattgaactacctgataatgagtaaaaatattgtctttaacagtactggggcatgcctgatgcatgagattccaaatgatatgaaaaatataatgaaaacattggaccaggaatcttttcccgtccccatcactcttctggtttagtagggagtttttttgttgttgtttttgagatggcatctcgctgtcgcgcaggctggagtgcagtagcacgatctcagctcactacaacctctgcctcccaggttaaagcgactctcgagcctcagcctcctgagtggctgggattacaggtgtgcaccaccatgcccagctaatttttgtatttttcgtagagacggggtttcaccatgttggccaggctagtctcgaactcctcaccacaagtgatccacctgcctcggcctcccaaagtgctggaattacagacgtgagccaccatgcccggctaatttttgtgtttttagtagagacaggatttcaccatgttagtcagactggactcgaactcctgaccttaggtgatccgcctgccttggcctcccaaagtgctgggattacaggcgggagccaatgcgcccagccgagggtcatttttaactagcattgtgatcgattcaggtttagctgggaatcttgctccatgacatttaaatacattatcagaggcaagtaactgcctcgccttagggcggagttagccaaactgctgtctatctaacaatcttcaacacaggctaggtttacagccaccattacttgataagaacatccaaaggaaattgaaggatgctatgctatatataaccttgcaaaatcgatgacaaaaattatcttaactctgagttttcttgagaagcatattgtaacccaaaattcagggccggggggcggggggaaccagcagggtccacaagtactctagacagcctaaccttaattttcacagtaagcttagcatataagcatggggtagccaaatacaatttcctactttaatcctcttatcaacggggaagaaaatggaaaaagctgcagaatccagtcccccgggtaagtgaggtctctacaagcagtaagcagagggaaagcgttatccgaaaagagccgaatcagaatgtattttcttacccaccctcccaaccttaaaagaactgtccagcagaatgtgacacaatcggcctctccggcgcccatcaatccagcacagccctctgaccacaccgctaatctccaagtatctttcacaaataagtcactcctatggctcccgtcttgtagtgagaactgctagcaatattcttaatgtgaacacctgcggcgttcagtcggattctgccttgagaaaacagaatccacacacaaggcgaacaggcagagcatggcaagatcaggttgtaccagagccgaagggtaagtttacagaaacccgtatctaattaatgcctgtaacacgctagtaaccgaatcggggacagctttgtccctttccgcagtgagaacggggcccgcccggagcccggggaaccgaaggtttaggagcccaaggtcacccacgaatcccagccgttccctggggcgacttcctggagcagccacgtgttcccccggcgccgcacgccgcgcagctgcaccttggctgcgcccgcgctcccggacccgcagcccggagccggcgcactagggcctgcggccttcaagggcgaggacccgaagtccccggggctgagagcgacagtgggggtacacctggtctcgtcattcgtcgctctgtgaccgaggaggcgggcaagaaggcagagagaagggaagggacgagaggcgaagggacgagaggcgcagggacgcctctgcgcacagccgccgaccccgtgtacctgcagccgctcgaggcgccgccacagccccttccccacaggctcgcggccccgctccatcccggccgccccgcctggggccgcgaccgctttcccgctccccgtgcggctccctatggctgctggacagcaccggagcggccgctccagccagccccgcaggatgaagggaggacacgagggtcggtgtagttctagaagcccgcactcacactagcgcgtcctccgtcccgagccgccacccgatatcccgacgctctgaggggatggcggcccctaaccggcggtttatagcctggccccgcccccggcccccaggggggctgtgcgtcacttcctgaggcacgtacgctcgcgaggtgctctgacagatcgcccggggggcggggatgcgcgcgcagcgggcggggccctatgcggagggcgctgcgggcgaggcgaaggccaagggaaaaggcgccaaggcagcaggtgccccgaggagccgcgcgatgggcgcactggcctctgcctcggcgccttcctccaccctggtagcctggcagcctccgcctgaccttgaccaacctccagtccctgcagtgctaggtccaatctgttggcgttgacgcttaaatgttggatattgcactgcggcagtgccttgaaatgtacgtgcaggatggaatgttaggtaactattaaagccactcttgtgaagatgtattttgcagcctcagaaatacaaaaaggaaaagaaaagcaaaatgcaaatttttattcagaatgtatacaagctgcactttaaccaagactagcggagtgctttgcgtaatgtttaatgcatgagggaataaaagggaaaatagaaacaagtgacttaatagggtgataggattgtagattaactttcgttttcattgccatcgctgttattggattgtgcaatgaataacaaataaataaaattcaattcttgtcactgtttaaactctttccaaacaatcacaccctctccctccctctggtcagtaaccagcaggccagggaggtagtagctacaatgcaagaaagcaacccataccttaaaaagcattgcacataaactgaccttcaggcccgtagggacacagaacagccctttaagaagcaaatccgtttctgggccttgggcttttactcttccctttatttcttctgctctaagatagagaaagtacttgggattctcaccgcctttctctttactcccattctctaaaatctctctccccaaagagaagtgtttaaaagtcatatgagttgccaggcgcggtggctcacgcctgcaatcctaacactttgggaggccgaggtgagcggatcacgaggtctggagttcgagaccagcctgaccaatatggtgaaaccccatctctactaaaaaaatttcaaaaaaaattagccaggcatagtggcacgcgcctgtaatcccagctactcaggaggctgaggcagaagaatcgcttgaacccaagaggcggaggttgcagtgagccaagatcgcgccattgcactccaacctgggcgacagagcaagattccatctcaaaaaaaaaaaaaagtcatatgagcaggagcattgctgcacctttaatgatctaatcaggaaaaggttaaggatgcacatccacagagggcctaccttaacattcagacaccaggcctgctcccctgtggtgttccttctttatttctttaattattaattttatttatttttattatttttacttttaagacagtgtcttgctctgtcaccctggctggagtacagtggcatgatctcgggctcactgcaacctctgcctccggattcaagcgattctcctgcctcagcctcccaagtagctgggactacaggtgtgtgccaccatgccaggctaatttttgtattttgaggagtgacgggattttatcatgttggccaggcttgtctcgaattcctgacctcaggtgatctgcccaccttggcctcctaaaatgttgggataacaggcatgagccaccatgcccagcctatttattttttatttttaatttgacgcagggtttgctatgtagcccagactagtcttgaactcctgggctcaaacaatcctcctgcctccggtctcccaaagtgctgggattataggcatgagctaacatgcctggctttctgcctttccttgactgaagtatcttttaaaaagaaacaaacaatgctggtatttgcaggtgaaaatcttatagcctcatggaggacataggtttaggtggccagatgcgatggctaatccctgtaatcccaacactttgggagactgaggcaggtggatcttctgaggtcaggagttcaagaccagcctggccagcatgataaaaccccatcacaactaaaaatacaaaatttagtctggcgtggtggcgcacacctgtagtcccagctactccagaggctgaggcaggagaatcgtttgaacccgggaggggggtggctgcagtgagctgagatcacaccactgcccttcagcctgggcagcagagcaagactctgtctcaaaaaaaaaaaaaaaaaagaaagaaagaaagaaaagaaaagaaagaaaaatatgtttaggagacatttagaggccaggaccatttggacatgaaaattcaaatctcaaaaatttatattcactaaaataaaaccataaacgtgacactaaagaggctatcaattatatttttatttttatgctgttattagtattaatagacactgcaattaaagtccacttattaacacttttactatttatttatttatttttaaacagtcttactctgtcacccaggctggagtgcagtggcgccatctcggctcaatgcaacctccacctgggttcaagcgattctcctgcctcagcctcccgagtagctgggattacaggcacgtgccaccacgcatggctaattttttgtatttttaatagagacggggtttctccatgttggccaggctggtcgtgaactcctgccctcatgatctgcctgccttggcctcccaaagtgctgggattacaggcgtgagccaccgagcctggccaaattattcgaaattattattggaaattatttaatttccaaccctccacaaactattccatgaggcttacctcatcctggaactaaaactcttgcagttcttctgcatcgtacacagaaatacgagaagtttcataaagggaaggaggttggcaaggaaaaagataccatgagctgtggggaaaagaaaagagcacaaagcctggagggccaagaagctggagttctcaactttcctgagcctgggttgtaccagctctaaaatgggaataaaggctgggcacggtggctcacacgtctaatctcagcactttgggaggctgaggcgggcgtatcatttgaggtcaagagttcgagaccagcctaaccaatgtggtgaaaccccatctctactgaaaatacgaaaattagccgggtgtggtggcaggcacctgtaatcccagctactcagtaggctgaggcaggagaatcgcttgaacccgggaggcagagggtgcagtgagctgagattgtgccactgcactccaggctgagagacacagcaagactccttctcaaaaaataaaatgggaataaaaatacctcattccaaaaatacctcttttagggtctagaagaccctaaaagcaatgactggcacatcatacactgttggtcagcatggttgaatcagagtcctcgtggggcggagtggggtcaggtaggaacgtgacgtggaagatgtctgcagactgggatggatgtgggctcatgaagaggaaggatgaaggcatttcagcagaggagaaccggccacctgaaggctctgtagtgagaaggagcctgtggtgtgtgttaaaattcctaaggagatgtctgacagctaattcaggggaattactgctggaaacaacagtgcaggatgattaacggcaaaattctgcctccctctcttttttcttcaccaagagatgaaagcagaagtcttgctttttggtgagagagaactggcaggaaaagcaaaccagataagccacttacctagtgaaagagccccagctggcagggcatggaggctcacgcctgtaatcccagcactttgggaggcagaggcaggaggatcacttgaggtcaggagttcgagaccagcctggccaacatgacaagacactgtctctactaaaaatacaaaaattagccaggcgtggttttgtgtgcccataatctcagctacttaggaggctgaggcaggagaatcgtttgaacctgggaggcggaggttgcagtaagctgaggctgggccactgcactccagtctgggtgacaaagtgagtccgcctcaaaaataaaataaaaagcccccgcctagaaattagcaacttgtcccagtgggactgtcacccactgtgctgcggaaacatgggcgtcagtcatggctctgtacttcattttccctgtctgccatgtggaaataatatccctttattgccttcattcatttaccagtgaaataaaaagtaagaaaacttattaaactacatgtttatacaaatttaaggtgttactagtgcagagcccagtctaagtgaataaatgtggtggtgacgggtcgaagctttaaaaaaaaaaaaagaaaaggaaaatttttttttctcgctctgtcacccaggctggagtgcaatggcgcagtctcggctcactgcaacctccgcctcccaggttcaagcgattctcctgcctcagcgtcccgagtagctgggattacaggtgcctgccaccacacccagctaatttttgtatttttagtggagatgcggtttcactatgttggccagggtggtctcgatctcctgacctcgtggtctgcctgcctcggcctcccacagtgctgggatttcaggcgtgagccaccgcgcccggcccttcaacggcttttgaatgcacctactccagaaaaagtgacttggtcattgataatagtggatacagaaaggtaatgccatcattatttatcgagtactgttatgtgctggaaaaggacgtgtaaagaggtaagaagcaagtctgtacccctgaaaaggcaaacaatgtagctggggaagcataatgtatatttataagaacttatatttaaaggccaggcctagtgcggtggctcatgcctctaatcccagcactcaagaggccaaggcaggaggatcgattgcttgaggccgggagttcaagaccagcctgtgcaacacagtgagaccccctatctctacaaaaaaaacttaaaaattgccaggtgtggtggtgctgcctgtagtcccagctactctgggggctgaagtgggaggatggctggagcccaggagttcagggttacaatgaactgtgattgcaccactgcacccagcctgggcaacagagcaagaccctgtctcaactaataataataataataataataataataaatatataatgccagtcactgtggctgtagtgagccgagattacatcactgcacccagcctgggcaacagagcaagaccctgtctcaaataataataataataaatatataatgccagtcactgaggctgtagtgagccgagattgcaccactgcactccagcctgggcaacagagcaagaccctgtgtcaaataataagaataataagaataaatatataatgccagtcactgtggctcatgtctgtaatcccagtactttgggaggccgaggcaggtggatggcctgagtgcgggcatttgagaccagcctggacaacatggcaaaaccccatctctaccaaaaatacaaaaaattagctgggcatctggaggctgaggtgagagaacagcttgagcttgggacgctgaggctgtagtgagccaagattgcattgctgcacccagcctgggcaacagagcaagaccctttctcaaataataataataacaataataataataataaatatataatgccagtcaccgtggctcatgtctgtaatccgcagtactttgggaggccgaggcagatggatggcctgagtgcaggagttcgagaccagcctggacaacatggcgaaaccccatctctaccaatagtacaaaaaattagctgggcatctggaggctgaggtgagagaatggcttgagcttgggaggctgaggctgtagtgagctgggattgcattactgcacccagcgtgggcaacagagtgagactgtctcaaaaaaaaaaatcccacaaaaataccattaatttgccaactttgtaatagagttacaaagttgccacttgctctttctggggtcctacctgtggcccaaacagcagatgaagtctcttagttcagcatttctcaaacgttttttactgcatttcatggacaaatgtccatcttacttcacaactcagtacacccatgtgtatgcgtgtgtgtatgcgtgtgtatacacgtgtatatttccttcagtatacccacgtggatgtgtgtgtatatatgtgtatatttccttgaaacccaaagtaaaagtttcatgaaataatacccttgaggtgtggaaagccctccagaattttctattctatttaatagtaaaaatgctaatttttaacccattcaattgatttcccaatgggccgtaacctatttttgaaaagcatagtcctaggccatttcctctctcagagcacaagactttttagtgaacaggataaatgactttttagtgaacaggataaatgatgctcaaagttaaatttcaattcccaaggtttctccctgttctttctgcttgtcgctgtttcaactttctaccgccctacatttcagcaaatattggttacggtttttttgtttgtttgcttgtttgtttgtttttaatgagttgggaggctgagttagaaggcagagagaaagtcttttcaatcttttttttttttttgagatggagtctcactctgtcacccaggctggagtgcagtgatgcaatctcggctcaccacaacctctgccacctgggttcaagtgattctcctgcctcagcctcctgagtagctgggactacaggcgcaccaccacgcctggataatttttgtatttttattagagatggggtttcaccatgttggccgggctggtctcgaactcctgaccccattgatccacccgcctcagcctcccaaagtgctgggattacaggcgtgagacaccacacccagtgttttcactatttttacttttttaaatttcttaaaataaaatatgtagaacgagggtctccctatgttgcccaggctggtctcaaactcctgggctcaagggatccttctgcctcggcctcccaaggtgctaggattacaggcttgagccaccatgcccggcctgaagtcttttcaaatgctgtcaaatagctgcacacactccggtcagtgagggcagcaccctgcctgtcacacggctggtcttcacagcagcttctacagaaatcactctaacctacctttagctctgaccctagctcctatttaacatgccggatccattttattttccttggaatcctaagcctcgggcaatcactttaggaccagagtcataaaataaaaatgtggagctctgccactttggaagaggatgcaacctagaaaaaaggcaggtggactgtcaactcatagatttgaggttgatactattttccattttattttgcatttctttttctccaccctcagtttcctgtccttatcctgctgactcaattattttttctttctccattgccaaacggaaggtcacccacgagaacatggaataggggcaagattcagattaatatggaggagtttgctcccattttatagcaaatggaaaggttacttaggacagtgaaagataactaattttgttttttttttgtttgtttgtttgttttcttttgagatggggttgtgctctgtcacccaggctggagtgcagtggcacgatctcagctcactgcaatctccaccttccgggttcaagtgattttcctgcctcagcttcctgagtagctgagattacaggtgcccaccaccatacccagctaatttttgtatttttagtagagatggggtttcaccatgttggccaggctggactcgaactcctgacctcaagtgatgcacccaccttggccttccaaagtgttgggattacaggcgtgagccaccatgcctagccaaagacaatttttaaattgattacaaggacatttatgccaaccagtacagtggtctaagttgaagttttgagtaggatatgaagttctatttagtcccattcggaggcaaaatagaactcactgcataatagagtttcaagttcagaaggaactatataactaatgtactgtctctgacctatagtaggtgctcaaaaaatgtatgttgaattaattcaacaaaattcctctacttcacctcatcaggtggttatctagtgtctcctttacctctccaatgggagcaaatctataatttcccaaagcagaaagacctgggcagtttgaactgtcagaaagtttttatctgggccaggtgcggtggctcacgtctataatatcagcactgtgggaggccaaggtgggcagataacctgaggtcattcaagaccaacctggccaacagggtgaaaccccatctttactaaaactacaaacattagccaggcatggtggcgcacacctgtaatcccagctactcaggaggctgaggcaggagaattgcttgaacccaggaggcggatgttgcagtgagctgagatcgcaccactgcactccagcctgggcgacagcgtgagactctgtctcaaaagaaaaacaaaagtttgatctactaaactaaattctctctccctcttctatatattaattattttatatatatatatattttttttaaatagatatggggtcttgctatgttgctcaggctggtctcaaactcctgggatcaagcagtcctcctacctcagcctcccaaagtgttgggattacaggtgtgagccaacacgcccatcctataaattaattattgtttgaagactgctctcctgttcacagctgtcttctccagctaaatatccaaatctcttctaatggttaccacagggcgtgattccatgtctccccacccactggtcactttgtggttttttttgtgtgtttttttttttatttttttgttttgagatggagtttcgcttttgtcgcccaggctggagtgcagtggcatgatctccgctcactgcaacctccgcctcccaggttcaagcgattctcctaactcagcctcccgagtagctgggattacaggcgccttctaccacgccgggctaatttttgtgttagtacagacggaagtttgctggtctcgaactcttgacctcaggtgacctgcccgccttggcctcccaaagtgctaggattacaggcatgagccaccgcgccaggccccactggtcatttttggaagtatagtttggccaatccagagggggcaggaacatcattcccctgttgtagatgctgcagcttttggtggccatctgtctgccaccatattcactaccttaatagccactgtctattgttaacttctgttgagttttcagcagggttcaagggaatagatcaatctttggagcagaaagacctgggccccaaatctagttttgccgtgtactagtaccctctatgctccttttatcatggagaatgtgatatccaggtactgttacagtctactatagcgtatgaagaggatctgtccccgcttatcaccagtctaattcagctggaggtggaaaagagcctgatctatttggctaggaacatccttgccttggagctgaataaaaatagccaaggtttattgtacatctaccaggtgctccattctagcgcctttaaacatatgagctcatgcaatcctcagaacaattcttaaaaataaattcttaaaaaaaattaaaaactcttaaaaataaagaggtaatcccattttcaggtgtggaaactagcttaatacagaagtaaagtaacttgccccatgtcacatggctaataaatagtgacagcaagaattcaagcctaggtcatctagcttctaacctggccctaaaaaattccactacactgcctccttacaaacccaggcatgacacagactgactgcaccacccgcacagctctgcagacacctccccagggaagaatttctattcaagaggtacagggaccatctaggtggaaccatttgagaagatctagtatctgagggatctattttttttcacttcagatttaagttaatttcaaaatttggattcatattcctatgtggggaatcccagatatttctttcttttctttcctttttttttttttttttgagacggagtttcactcttcttgccctggatggtgcaatagcgccatctcagctcactgcaacctccacctcctgagttcaagcaattctcctgcctcagcctcccaagtagctgggattacagccatgcgccaccacgcccagctaatttttttttttttgagacggagtctctctgtgtcactgaggctggagtgcagtggtgtgatgtcggctcagtgcaacctctgacaccagggttcaagcgattctcctgcctcagcctcctgagtagctgagattacaggcaagtgcgaccacacccggctaatttttgtatttttagtaaagacgaggtttcaccatgttggtcaggctggtctcgaactcctgacctgatccacccgcctcggcctcccaaagtgctgggattataggcgtgagccaccgcgcctggctagaatcccagatacttctaaaaataagagtttgtagtacaactgatgctccagaaatctgggtaccatttgacagaaatgcagtgcattcatattgtccctgcaagctagctcatttgcttaaatttccagaatgcgtacctacctttgataaggagagttattgaattgataaaattatcgtatgaatgtatatatattaaacattgtttctgggccgcatggcaaaaccctgtctctacaaaaaaataccaaaaaaaaaaaaaaaatgccaggcatggtggtacactcctgaagtcccagctacttgggaggccgaggcgggaggatcccttgagcccaagagtttgaggctgcagtgaaccgtaaccatgccactacactacactgggaacagagtaagagcctgtctcaaaaataaataaataaatacttcaaaaaaaaaaaaactttgtttccaaaatataaattagtcagtttggtttttcttatttgcatctttatctttctttctttttttgtagagacaggaccttgctatgtcgaccaggctggtcttgaactcctggcctcaggctatcctcccaccctggcctcccaaagtgctgggactgcaagcatcagccactgtaccccgcctcttatttgtatcttcttttgacatctgagcttgcaactctcacttatgtctgagtttcccttcctctatggctgggaccttaagcaataatacttctgataaactgtgcgccagatggccaaacattgcctaaaaaaaatgactaagaaagaggcctttgaaaagaacattgtgaagtggggatgactgatgatgtaaataggaaaaatgaacaaatgtgtgaagaaaacatttgcaaacagacgtctacatctaaatcccaagtcagcaaatctagtattcaggaaaaataccaaataggcagaaactttttggtttcttcagctttaatatacacagtagacaaattttcctttggtttggaaaatgttcctgccaaaacttgtatttcttatacatggaaatgtggtcaaggaggcagctgtacagtggttacatttgtgagagctggagtggcttcccttggttcatctcacacaatcccctaagtggtaggaagacccgtatcccagggctggggtgcccaggtgtcagagtgcggtaacgttcgctgagcacctatggtgtccaggtactgagctgggaacttatatttgtatcatcttactttggcccccaacaattctgtgaaacaggtatcatacctattttatagatgaataagtagaagtgtgaagaatataaaaggattggctgaaagtggcacagcttttaaatagcaagaccctaacttcagatctctgtgatttctgttttttttttttttttttaaataaatgttaagagatatagcaatggggatctcaccatgttgtccaggctggtctcaaactcctgggctcaagcaatcctccctccttagcctcccaaagtactgggattacaggtgtgagccaccatgcctggccaggtttctgtattaaaaccactttttactatatctcaggtatggaaatatgaaaacactgttgtagcaggcgggtagttgaagctctgcactcagggtaggctgacgtactgccaggctctgaccaggaccttacaacaatacccatccttggaaggtttgagtcaactttatagctgaatttgatgccaggagcacaaagcaaaagatccccatatataaagacaaggttataaggtacagtgtgcctggtacaactatcttccagaatgcttcccagaagtaacatagctgggcaccctggcacatgtttatactctcagctacttggaggtgctgaggcaggaggatcatttgagcccaggagtcagaggccagcctgagcaacatgctacgaaggggggcaggcttctctgataaggtcgagcccaagtaggcaatgagagcagagaattccaaagggagagacagttctgggcccgtgagccaatcctgctagccaggtcccctccaaccccctattccaggcagaccacttctgtgtcaaggtctgaaatccagccttgactttattttatttatgtattttttgagacagctctgctgtacaggccagaatgcagtgacatgaccatagctcactgtaacctcaagcgatcctcctgcctcagcctcccaagtagctggaactacaggcatgtgccatcacacctgtcaaattttaatttttttttgtagagatggagtctcactgtgttgccccggctatttttgaacccctgagatcaagggatcctccagccttggcctcccaaagtgctgggattacaagcgtgagccaccacgctgggctaatttttaatttttttttgtagagacaaagtctcactatattgcccaggctattcttgaactcctaagctcaaaggatcttccagcctcctcggcctcccaaagtgctgggattacaggtgagagccagcatgcctggctctagccttggctttattaaggtacaggcaggttttcctgcaggtagtaagatgaataaaggttagattggttttgagatccagatagaggctagactctagcctagcgcttctttttttttttttttttttgagacggagtcttgccctgtctcccaggctggagtgcagtggcgtgatctctgctcagtgcaacctccgcctcctgggttcacgcaattctcctgccccagcctcccgagtagctgggattacaggcacatgcctccacacccggctaatttttgcatttttagtagagacggggtttcaccatgttggacaggctggtctcgaacttctgacctcatgatcacctcagcctcccaaagtgctaggattacaggcatgagccaccacacccagcctagcctagtgcttcttaaacattcatgtgagctccatgcagtgtcacatctataatcccagcactttggaggccaaggcaggaggattgcttgagcccaggagtccaaggctactctgagctatgattgtgccactgcagctaagccttgactacagagtgagaccttgtttcttaaaaatatatatattcatatacatatattatttattttcatttattatttatttatttatttttgagagagaaagagacgaagtttcactcttgttgcccaggctggagtgcagtggcgcaatctcagctcactgcaacctccacctcccgggttccagtgattctcctgcctcagcctcctgagtagctgggactacaggcacccaccaccacgcccggctaatttttgtattttttgtagagaaggggtttcaccatgttggccaggctgatctctaactccttacctcaagtgatccacctacctcaacctcccaaagtgctgggattacaggtgtgagccaccatacccagcccttgaaaatatttttttaaagaaactttaatgtgcagataagtcccatggaggggacgtgttaaaatgcagattctgattcagaaggtctggtgggggtccaagacggtgtttctaacaagctcctaactgatacccaggctgctgctggtcttagaccaacccttgagtagactttagaggaagaagtttttattagctgtttctacaacactccccacagaaagggcaccctgtgtggccagctggcatgaaagcggtttctgcttggcagctatttttaggtagctgtaatgcattctattttttgcattctaagcttttcagtggaccagggcgatccctggggctgtcccagcttcagcaacggtccctaagaccattcagctactttgcagccactgcacaactgccaaacaatccactaatcctgatcttgaaacaattttccctcctgagaagacaccagacctcagcaggaagacttggcctgcacagcagttctcttaccccacacgaattaataaataggcctcatgaatcgggattttgtgcccttgggtagcgaattacctgatgactctggtgaactgacgaaactgagtttgtgaaactgtgagccggaagaacagtctacagctgtcgtggactcccctgaacccctgggaagacgcagctcaacagccagtccacacgaaccctgctctgaaacctctcctgcagactgggcctgggctagagaagaacaggagttttcttttctccttttttttgagacggagttttgctcttgttgcccaggctggagtgcagtggcatgatcgtggctcactgcaacctctgcctcctgggttcaagtgattctcctgcctcagcctctggagtagctgggattacaggcgtgcaccaccacgcccaactaatttttgtaattttagtagagatggggtttcaccgttttggtcaggctggtctcaaactcctgacttcgagtgatccacccgcctcggcctcccaaagtgctgggattacagagatgagccaccgcgccaagctgtgaattgattttttagtgaaacttcagggagccaaggactttggcccccacagtaccatctggattattgggaacaggtgcaaaatatatagggccagcgaaaactctcaaaggaatgattgacattataaatttagagaggaaggactgccttcctttctgtgacaacagcactttaatgttccaaaacaggatgtccttggatttggttttaatgcttatgtatataaggttagctattgccaggagactgatacaattaatcagagtccatctctcccttccaggcacaccttcacttcgctgcagtttctcatggccataaatccattagagcaagaaacagcaagattagtagagggccataaatttagattctgggccattttacctgataagtctttttgttcttttctctttttttgagatagggtctcactctgtcacccaggctggagtgcagtggagtggccatggctcaccgcagcctctacatcccaggctccagccatcctacctcagcttgcagctggaactacaagagcacgtccccacccctggctagttgttttgtaatttttgtagagacaggatctttctatgttgctagggctggtctcaaactcctgggctccagtgatccacccaccttggcctcccaaagtgctggggtttcaggcgtgaatcatcatgcccagccagaaaccagtcttaaaagactgtatactataatgattctatttatatgacattctggaaaaggtgaaattatagagacctaaaatacatcagtggttgccagaggcttggagaatgaagtataggctgaataggtaaaccatatatgatattttagggcagcgaaactcttctgtatggtacatgagactgcatttttcaaaacccatagaactggctgggtgtggtggctcacgcctgtaatcccagcactttgcgaggccaaggcagcggatcacttgaggtcaggagtttgagaccagcctggccaacatggtgaaaccccgtctctactgaaaatacaaaaaatagctgggcatggtggtgggtacctgtaatcccagctactcagtaggctgaggcaggagaatcacttgaacccaggaggcagaagttgcagtgagccaagatggcacttctgcactccagcctgggcgacacagtgagacatcatctcaaaaaaaaaaaaaaaaaaaaaaaaaaaaactttagctggctgagcggcacgcgcctgtagtcccagctactcaggaaggtgaagcaggaggatcccttgaatccaggagttcatgagctatgatcatcccacagcactccagcctccgtgacagagcaaaaccctgtcactaaaacaaaacaaaacaaacaaacaaaaacccatagagcacaaatttctctacagcacaaatttcaaccttaatatatgcaaatgttaaagcgggagtgggagggttcccaggatggaatgcaaactgttataaagaacctcaccatgctacaaacatgacctaacatccaaggggaaggaagggaagtgctgggtgttgaaggggatggaagggaagtgctgggcattgaaggggatggaagggaagtgctgggcgttgaaggggatggaagggaagtgctgggcgttgaaggggagggaagggaagtgctgggcgttgaaggggagggaagggaagtgctgggtgttgaaggggagggaagggaagtgctgggtgttgaaggggagggaagggaagtgctgggtgttgaaggggagggaagggaagtgctgggtattgaaggtgagggaagggaagtgctgggcgttgaaggggagggaagggaagtgctgggcgttgaaggggagggaagggaagtgctgggcgttgaaggggatggaagggaagtgctgggtgttgaaggggagggaagggaagtgctgggcattgaaggggagggaagggaagtgctgggtattgaaggggagggaagggaagtgctgggtattgaaggggagggaagggaagtgctgggtattgaaggggagggaaaggaagggaaatgctgggtattgaaggggagggaaaggaagtgctgggcattgaaggggatggaagggaagtgctgggtattgaagaggatggaagggaagtgctgggtattgaaggggagggaagggaagtgctgggtattgaaggggagggaagggaagtgctgggtattgaaggggagggaagggaagtgctgggcattgaaggggatggaagggaattgctgggcgttgaaggggatggaagggaagtactgggcgttgaaggggagggaaaggaagtgctgggcattgaaggggagggaagggaagtactgggtattgaaggggagggaagggaagtgctgggcattgaaggggatggaagggaagtgctgggcattgaaggggatggaaaggaagtgctgggcattgaaggggatggaagggaattgctgagcgttgaaggggatggaagggaagtgctgggcgttgaaggggagggaagggaagtgctgggcgttgaaggggagggaagggaagtgctgggcgttgaaggggagggaagggaagtgttgggcgttgaaggggatggaagggaagtgctgggcgttgaagggggtggaagggaagtgctgggcgttgggggtggaagggacgtgctgggcgttgaaggggatggaagggaagtgctgggcgttgaaggggatggaagggaagtgctgggcgttgaaggggatggaagggaagtgctgggcgttgaaggggatggaagggaagtgctgggtgttgaaggggatggaagggaagttctggatattgaaagagaaggaagggaagtgctgggtattgaaggggatggaagggaagcgctggtctaagtgactttggaaataagtgaagactataagactaaaaataaaaggaactgtacataagcactgaactctaacagcaaaattgtttcccatggggatatgggttaacaactgtgaaaccactctacattgtgctgggattgaatggatggcaagccagggagccaggtagctcaccgttgtctacacacacacacacacacacacacacacacacacaattctctcttgcttatattaatgtgtatataaatatacatacattaacaactgtgtgtgtgtatatatatacacacatataaatatatatgctaataatcatgtatgtgtttatgtgtgtgtatgtattatacaagaatcatgtatgtgtgttacatacatgatagttaatgtatatatatttatatgtgtgcaccagttagtacacacatataaaaactacaaagcaagtcggccagacatggtggtttatgcctgtattcccagcactttgggagaccaaggcaggaggattgcttgagcctattagttcgagaccagcttgggtaacttgacaaaaccctgtgtctacaaaaaatacaaaaattagccaggtgtggtggcaggtgcctgtaatcccagctcccgaggaggctgaggtaggaggatcacctgagcccggaaggtcaaggctgcagtgagctatgatcgcaccactgcactccatcctcggtgacagagtgagaccctctctaaaaaaaaaaaaaaaagtctgaaaaagaaaacacaacaagtatagagaaagtcaagaaaactgaagttgtctttttgaaaagaccaacaaaactgacaaaacagtctggcgctcacgcctgtaatcccagcactttgggaggctggggtgggaggatcacttgaggccaggaattagacaccagcctgggcaacagagcaagactcctgacccccaagtctctacatgaatttttttgtttgtttgtttgtttgagatggagtctcactctgtcgcccaggctggagtgcccaggctggagtgcagtggcgcgatctcggctcactgcaacctctgcctcccgggttcccgccattctcctgcctcagcctcctgagtagctgggactacaggcacccgccaccgcgcccggctaattttttgtgtgttttttagtagagatggagtttcaccatgttagccaggatggtcttgatctcctgacctcgtgatccgcccacctcggcctcccaaagtgctgggattacaggcgtgagccaccgcgcccggccgaaaatttttaaaaattaggcatagtggaaacctgtagtcctagctacttgggaggctgaagaaggattgcttgagccgaggagtgaccaatgatcaagccactgcactccagcctgagtggcagagtgacaccctgtctcgattttttaaaaaactgacaaatcttttgctaaactgaccattttaaaaagagaaaaagtggccaggagggtggctcacgcctgtaatcccagcactttgggaggccaaggcaggcggatcacgaggttaggacatcgagaccatcctggccaacatggtgaaaacccatctctactaaaaatagaaaaaaaattagctggacgtggtggttggcacctgtagtcccagctactcgggaggctgagccaggacaatcacttgaacccaggaggtggaggttgcagtgagctgagatcgtgccactccactccagcctagcgacagagcaagactctctctcaaaaaaagaaaaaaagttcaatatatgaaaatcagcaattaaagaggacatcactatataccttacagaaaaaaaaataaataaaaggtggccaggtacagtagctcatgcctgtagtcccagcactttgggaggctgaggcaggcagattgcttgagcccaggagatctgttgtccaggagatctgagatcagcctggacaacatgacaaaaccccatctctacaaaaaatacaaaaattaggcaggtgtggtggcacaggcctgtagtcccagctactcagggaggcagaggcaagaggatggcttgagccctggaggttgaggctgcagtgaaccctgacggtgccctgcactgcagcctgggtgacaaagtgagatcctgtctcaaaaaataaataaataaaaatagattataaaagaataccatgaataaccatatgccaacaaattagataacttatataaaataaaatgggcacattccttgaaagacacaaatttctgaaacagacagaagaagaaggagaatatctaaatagacctatagacctacagcaagtaaagagattgaattcatactgacagtggctcacacctataatcccagcacttttcaaggccgaggcaggaggagcacttgagcctatgagttcaagtccagcctagacaatgtagcaagacactgcctctaatacaaaaattaacactaaaacaacaaaaacactcaacaaactaaaaggagctacctcaatccaataaagggcacatacaaaaaaacctacagctaacaaagtgaaagactttctccctaccaaaacaaagatgtccactctcacctgttcaacactgtgaaggaggttctagccaaagcaattagacaagaaaaagaaacaaacaggctgggtgcggtggctcatgcctgtaatcccagcactttgggaggccgaggcgggtggatcaacaagtcaggagttcgagaccagcctggccaacaaagtgataccctgtctctactaaaaatgcaaaaaattagggggtcgtggtggtgggtgcctctaattccagctaccaaggaggctgaggcaggagaatcccttgaacccaggaggcagaggctgcagtgagctgagatcgtgccattgcactgcagcctgggcaacacgaatgaaactccatctcagaaaaaaataaaagaaaaagaaacaaaaggtattcagattggaaaggaagaattgaaactatctctgcttataaatgatatgattttatatagagagaatcctaatgaatccaacaaaaagctactagtatttacatgtatatttcccagctctgtccacttagaggccccagaaacaatatccaggtagcaatgagaacacacccagtgtccagatctcggtttctaataccattccccagagcagaggaccctggtttctcataccattccccagaacagaggaccctggtttctcataccattccccagtagagaggacactgctttctaataccattccccagaacagaggaccctgctttctaataccattccccagtacagaggaccctgctttctaataccattccccagtagagaggaccctggtttctcataccattcgccagtgcagaggaccctgctttctaatacgattccccagaacagaggaccctggtttctcataccattcgccagtgcggaggaccctgctttctaataccattccccagtagagaggaccctcgtttctaataccattccccattgcaaaggaaccagcctccctggagaaatgcctgatttctttttttattttttgagatggggtctcgctcgtcatcaggctgcagtgcagtggcgtgatctcggcttacctcaacctccgcctcctgggttccagcgattctcctgcctcagcctcccgagtagctgggattacaggcgcccaccaccacacccagctaatttttgtatttttggtagagacagggtttcaccatgttggccaggctggttcaatctcttgacctcatgatcttcccgcctcggcctcccaaagtgctaggattacaggtgtgagccacactgcccggccctgatggttttgttgttttttttttttttttttttttttttttagtaaataaacttgtaccagaagaaatggctgattctaagcctgggtcaggaaatatccaatatgaacctggagcatcttctagtgccagaaagtacgaaagagctcaaagaacaaaatggtggggatatgtctatggacacagaagccaactacagaagctcccaatggccaaagctggagcaatttatactacagaatgaagagcctaatacagattataacccaaagtataaaaaataaatatccatgagaccccactgccataaataagtgattgcctaaacaaataaatgaggacgaataggcaactctcttgtacagtggaactctagatgatatactgacatttatcatggaggaggtggggcataactccctaccgctgaggcaggagttgcatagagtgacttcctactaaagagtatagtacggaaagcggaggaaaggccgggcacggtggctcacgcctataatcccagcactttgggaggccaaggcgggtggatcacgaggttaggagttcaagacaagcctggccaacatggtgaaaccccatctctactaaaaatacagaaaattagccaggcatggtggcaggtgcctgcaatcccagctactcaggaggctgaggcaggagaatcgcttgaacccaggaggcagaggttgccgtgagccgagattgcgccattgcactccagcccgggcaataacgcgagactccatctcaaacaaacaaacaaactaaaaagaaaatggcactttatctctgtggttttcctccccaaaaccccaaaccccaaaccccagtctaatcatgagaaaaacatcagacaaatcccagttgaaggacattctacaacatgtatgaccagtactccttaaaaccgtcaagttcatttaaaaaaaagaagggctggacgcggtggctcacacctgtaatcccagcactttaggaggccgaggtgggcggatcacctgaggtcaggagttcgagaccagcctggccaacatggtgaaaccccgtctctactagaaatacaaaaattatccgggtgtggtggctcgaacctgtagtctcagctacttggggggttgaggcggtaggattgtttgagcccaggaggcaggggttgcagtgagctgacattgtgccactgtgttccaacctgggtggacagagtgagaccctgtgtgagaaacttacattttattttatttaggtatttggttttgggattacaggcatgagcctccgcgcctggccgaaacttacatttcagaagagcgtaaggagacctaatgactgaatgtgatatggcatcctagctgaaatgctagaaatagaacactgggtaagaacgaaggtaacccaaattatgtatggtcttcagaagactgtatgaatattgactcataggttttgataaatgtaccatagtaatgggataacaataggagaaactgagtgtatgggtatatggaaactctatatttgatcgattgattgattgagatagggtctcactttgttgcccaggttggagtgcagtggtgtgaacatgactcactgcaacctcaacattccgggctcaaaacatcttcacgaagctgcccaagtagctgggaatacagaagcatgccttgccagtttttacaatttgtgaagagatggggtttctttgttttctttctcttttttttttttttcgagacagagtctcactctgtcacccaggctggagtgcagtggtgcgatctcagctcactgcaacctccgcctcccaggttcaagcaattcttctgcctcagcctcccgcgtaactgggattacaggcgcccgccaccacactcagctaatttttatatttttaatagagatggagttttgccatgttggccaggctggttccaaactcctgacctcaggtgatccacccacctcggcctcccaaggtgctgggattacaggcgtgagccaccgggcctggccgagatggggtttcaacatcttgtccaggttggtcttgaactcctgggctcaggtgattttcccaacttgccctcccagtgtgctgggattatagtcctgagcctccaggcccagccatctctacactatccttgcaaattttttgtaaatcaaaaatattctaaagcaaaaatttattgagaaaaatatacacatacatatcacatgtacacacatacacatagttgcagaaaagggaacagaagaaaaaatagtttaaaaaacctttttgtttttccattaaatattctttaataaatatgtactactttgaacataaaaaatgcttttctttaaactatgagaatagaaaatgcttatttgtttgaaatgtaaccctggctttctctttctactgtattctacccattactattctatattttgtattttattatattattactatttttgagacaggatctcactctgtcacccaggctgagtgcagtggcatgatcacagctcactgcagccttgacccccccaggctcaagtgatcctcccacctcagcctcctgagcagctggggctataggtgagtgacaccacacctggataattttttgttttttgtagacagggtcttaccatattgcccaggctggtcttgaactcctgggctcaactgatccttccacctcagcctcctgattagctgggactataggtgcgtgccaccacatttggttcatttcttatgttttgtacacagggtctcgccatactgcccaggctggtcttcaactcctgggctcaagtgatcctctcacctcagtctcccaaagtgttgggattacaggtgcgagccgctacgctcagccttttttatttttatttatttatttatttgagtcagaatctagctctgtcacccaggctggagtgcaatggtgagatcttggctcactgcaacctccgcatcccgggttcaagcaattctcctgcctcagcctccagagtagctgggattagaggtgcccgccaccactcccagctagtgtgtgtgtgtgtttagtaaagacaaggtttcaccatattggtcaggctggtcttgaactcctgacctcgtgatccacccacctctgcctcccaaagtgctgggattacaggggtgagccaccacacccagccagcctattttattttattttattttgagacagggtctcgctctggtgctggagtgcagtggcatgaggttgcttactgcagccccaaccttttgcgctcgagtgatcctcccacctcagccttctgagtagctgggatcataggcacgtcctaccatgcccagccaatttttagttgttgtttacagacacagtgtctcttcctaatgcagtctcccttagtatctcactggtctttaagtaaaaaagaaaaaatttaaaaattggaataacaaaagatatgtggtctccctgtgttccccaagctggtcttgaactcctgggctcaagcaatcctcctgcttcggcctcccaaagtgctaggattacaggtgtgagacactgcacctggcctactcttctataataagagtctcatctttctcttatgttgaacgtgatacagatactgggttctttttaacttttttttttatttgagatggagtctcgctctgtcgcccaggctggagtgcagcggcgcgatctcggctcactgcaagctccacctcctaggttcacgccattctcctgcctcagcctcccaagtagctgggattacaggcgcccgctgccacgcccggctaattttttgtatttttagtagagacggggtttcgctgtgttagccaggatggtctcgatctcctgacctcttgatccgcccgcctcggcctcccaaagtgctgggattacaggagtgagccaccgcgcctgtcatctttttaacattttttaaggaattcttatttgccatgagccaaggaatgcacagagactagattcccatggacagctcactcctaccgaacacatacaatgggacacacctgtgctgggtgaaaggcgcagcctagagggctggcaggtgttgggtgaggctcaggtttcaggctgaggggaggagggtcagctggcagatcctcagcaactctggcagcctcacagggccacagcccccctggagctcttggttcccccagggtcaaaccaggtctcagtcatggagctaggatcaagctttcctaccctcctcagtaggaggcccccttcttcccaggagggagagctaggggaagggagatagtggagggtgagggaacggcattcgcatttgtaagcagtgccctggagctgcatgctggagataagagaaggcccctcccgaggctgggagcagagggagctgcagcctgaggcttgggcaggacaggtgaacccaggtttcccaaccactgaatcaccctttgccccaccacgcacatgcgctcttgcgtgtggacgcacgtgcacacacacgcacaccccacagcttccacgtggcaatgtgtctaagcccaagatcctggacagcccagacacagaactgccatgagaacccacagcagtcccactcgggagccctcatcagcactgctgagtgccaaccgaacaacagtgagaacgagaacacagacccttatcctgggaccacacagttggcttctcaaggcttcatgaaattcttctttttattttttctttgagacacagtcttgctctgtcacctaggctggagtgcagtggcgtgatcctggcttactgcaacctctgcttcccaggctcaaacaattctcatgcctcagcctcccaagtagcagggactacaggcatgtgtcaccacacccagctaattttgggggtattttttcttcttttttttttgagacagagtctcacaccatcacccaggctggagcgcagttgtgcgatctcggctcactgcaacctctgtctcccagcttcaagcaattctcctgcctcagcctcccaagtagctgggattacaggcacctgccaccacctgctaattttttgtatttttagtagagacggggtttcactatgttggccaagctggtctcaaactcctgacctcgtgatccacatgcctcagcctcccaaagtgctgggattacaggcatgagccaccgcgcccagcctaatttttgtatttttagtagagatggggtttctccatgttggccaggctggtctcaaactcctggcctcaagtgatccgcccaccttggcctcccaaagtgctgggattacaagtgtaagccactgtgcctggcctaaattcttctttagcatcatgcaatctgccttaattgagaaatgttatcacgaaaacccacatgaaactcaatattgcacttactgtaggagctattattggaagctagtgatcctgagaacttgcctagagtttcagtgcaagaaaaggctggcttcggctgggtgcagtggctctcgcctgtaatcctagcactctgggaggccgaggcgggtggatcatgaggtcaggagatcgagaccatcctggctaacatgatgaaaccccgtctctactaaaaatacaaaaaaaaaaaaaaaaaaaaaaaaaagctgggcatggtggcgagtgcctgtagtcccagctactcgggaggctgaggcaggagaatggcgtgaacccgggaggcggagtttgcagtgagccaagatcgtgccacggcactccagcctgggcgacagggcaagactccgtctcaaaaaaagaaaaaaaaaagaaaaggctggcttctcctgattaatggtcatcttatttttgacacaatttgtaataacttttttttttgagacagaatcttgctctgttgcccaggctggagtgcagtggcgtgatctgggctcactgcaagctctgcctcctgggttcacaccattctcctgcctcagcctcctgggtagctgggactacaggcacccgccaccatgcctggctacttttttgtattttttagtagagacggggtttcaccatgttagccaggatggcctcggtctcctgaccttgtgatccacccgcctcggcctccccgagtgctgggatcacaggcgtgagccaccgcacctgccacgtagagcctattttcttatccataaaacaatacctacttcacggggttgttctgaggattaagacaatctatgtaaaataattagccaatacacaacctatagcatgctcagtaaatggtagctggtataacaattatgggtttcttgtttgtttttttgtttgagatgcagtctggctgttgcccaggctggtcttaaattcctgggctcaagcagtcctcccgcctcggcctcccaaagtgttgggattatgagcacgagccaccacatccggataaaggaagtccctgtccgggatcacctgaggctaaagagagctgcgtcacccaacgtcatgctccccctagggacagctgcattcctgacaagggccatcccagctccagagagtcactcctattgagagatttgctgaggcctttgtttcctgagctccaggccgacgtcccctaatcctgcagccctgcctcctcacaggtattaatcctgagggcattttttttctttctttttgggcggggggcggggggggcacgaggttttgctcttactgcccaggctagagtgcaatggcacaatcttcactcactgcaacttccaactcccgggttcaagcgattgtcctgcctccgcctcctgagtagctggggttacaagcatgcgccaccgcgcccagctaattttgtatttttagtagagatggggtttcaccatgttggtcaggctggtcttgaactgctgacctcaggtgactcacccaccttggcctcccaaagtgctgggattacaggcatgagccacagtgcccggcctcctgagggcatctttaataaacttcctgatcacaaatctccctcttggtctgcttcccagacacccaacctctgtctgttgtaaggagaggttattaaatggccctgtctctgacagtctaatgtatttctctccacaatggcatgtaccctcctagttcccctgagagtacactgtcttcttggggatgcatctagacctggtaatttctagaaactgatcgaagttagagactgggagaaaatacagaaatcctaatcctggccgggcgcggtggctcacgcttgtaatcccagcactttggaggccgaggcgggcggatcacgaggtcaggagatggagaccatcctggctaacgcggtgaaaccccacctctattaaaaatacaaaaagttagccgggcgtggtggcgggcgcctgtagtcccagctattcgggaggctgaggcaggagaatggcgtgaacccgggaggcggagcctgcagtgagccgagatcacgccagtgcactccagcctgggccacagagtgagactccgtctcaaaaaaaaaaaaaaaaaagaaatcctaatcgttcctgcaccaattcccatccttacttcctacttcgccctgcccaaatgaaaaaatacaaaaattagctggtcgtggtggcgggcacctgtaatcccagctactcgggaggctgaggcaggagaatcgcttgaacccaggaggcggagcttgcagtgagccgagatcgcgccactgcactccagcctgggcaacaaagagcaaaactccgtctcaaaaaaaaacacaaaagattacaactccaagaccagcctgggcaacatggtgaaaccctgtctcgacaaaaacacagacattagcctggtgtggtggtgtgtgcctgtggtcccagctattcaggaggctgaggtgggaggcagaggttgcagtgagccaagatcatgccactgcactgtagcctgggcgatggagcgagaccctatagtaacaaaacaaaacaacaacaaaaaaattccacaaacgactaaagaggaacaaaccaatcagacttctcagaagtacttggcactgaacttttcaaaggatccttaccaaaatcgagcttttttgttttccctctgaagtctcatgttaagcaagaggggaaaacccagtgtctgcctggggtaagaaaagtcgcaaaagtcttcaaaggtcatcaaggttttaaatgttcacagtaatgagtttcttttttttttcttttttttttttgagatggagtcttgctctgtcgcccaggctagagtgtagtggcatgattttggctcactgcaacctccacctcctgagttcaagcgattctcctgcctcagcctcccgagtagctgggactacaggcacccactaccatgcccaactaattttttgtatttctagtagagacggggtttcaccgtgttagccaggatggtctcgatctcctgatctcatgatccacctgcctcggcttctcaaagtgctgggattacaggcgtgagccaccacgcctggctccaagtttcttcatggagctctatctgcaaggatctgagtcgagagggcacacacacaggaggcaaattcacgacctgaaccaaggcccattctcctgagagactttcaggtcactgacgtagctacagatattggaaaaaaatgcatctgtagtagttcagttgaggagaggggatgggtggcagtaaatcttaaggggctcaggggcatctattccaaatttccagagagggtcctcacagtctgtcattgcatatacatcaaatgtaaatgtatccttaggggggtttttggttttgttttcagagacagagtctcactctgttgcccaggctggagtgcagtggtacaatcacagctcactacagccttcaactcctgggctcgagggatcctcgcacctaagcctcctcaggagctgggactataagggcatgggccaccacacccagctaatttttaatttttttatttgtgatatggtcttgatctgtcatccaggctggagtgcagtggcatgatcacagctcactacggccttgacctcctgggtccacctcaacctcccaagtagctgggactacaggtgcatgccatcatgcctgtgtttcattatatatatatatgttgagagagagagagagagagagagagagagagtagagagagagagtagatatggggtttcaccattttgcccaggctggtcttgaactcctgggctcaagcaatcctcttgcctcagcctcccaaagtggtgggattacaggagtgagccaccacacccagagaatttttaaattttttgtggcgatggagtctcgctctgttgcccaggcttgtttcaaactccgagcctcaagcaatcctcccaccttggcctcccaaagcactgggatgacaggtgtgagacagcatgcccaggcatgaatgtgtctttaaacataccttttactttctttttttttttttttaactgtagtcataatagctatttacttgggtaaaattttctcaggatatttttggtatgtggggcagagggagagctagcaagtgagagaagctgtcttttcagtacaaagagctcacagtactccggtctccactggaagttccgtctttatttttaaaggaatctggtcatgagtctgttgaccaagcacatcctggtaatctattgtcagatgagaagtgttctggatttccaacttataccatgcatgatagatgctgagtttcaagcataaaactactctagttaccaagatcatactgcttttatgttgatataacttaattttattatttgcttcacctcccaccagaatcacttatttgctcacttttcttgtctatgctctagaatgcacttactgcttaagcggcatattatatgaaccatccttttacattatagtttattaaaaagtggcttttgccgagtgtggtggctcacgcctgtcatcccagcactttgggaggccgagacaggtggatcacgaggtcaggagatcgagaccatcctggctaacacagtgaaaccccgtctctactaaaaatacaaaaaattagccgggtgtggtggcgggcgcctgtagtcccagctactcgggaggctgaggcaggagaatggtgtgaacccgggaggcagagcttgcagtaagccgagattgcgctactgcactccagcctgggcaacagagcgagactgtctcaaaaaaaaaaaaagaagtgtcttttcttttttcttttttctttttgagacagggtctcactcacccaggctggagtgcagtggcgtgaacttgggagcctcgacatctgggctcaagccatcctcccacctcagcctcccgaatagctgggactacaggcacacaccatcacacccaccctgctaatttatattttgtagagacaggattttaccatgtttcccaggctggtcttgaagtcccaggctcaactgatcagcccaccttggcctcccaaattgctgagattacagacgtgagcctctgcgcctgcccaaagcagctgttcttttgcaaggatttattggtctgtggtgcctctccctcagtacccttgcgtggttcttttctttttttcttttttgtttactggagctacccaccatgaactattggttggttatttataaaaatatgtttaggtttatgcacatcattatatttatttgcccacgtgggccccttgagcatcagagcttcctaaagcaggatctttgcaggccatctcatccctcctcatcatgtatggatacacaaaccgaggtccattgagtccttttgaagaaggatagctgcagctagctgaaggccaaggcaggtggatcacttgagcccacgaggttgaggctgcaataagctgtgttcttgccactgagagagagactctgccttaaaaaaaagtgcaagctgcaaagtggttgccttttgctgaggaggtgggtactgggagcagcaggaattgactggaaagaggcatgaggacacgttcctttttttcccttttttattttttattttattttttgagacagtctcgctctgtcacccaggttggagtgcaatggtgcgatcttggctcactgcaacctccacctcccaggttcgagtaattctcctgcttcagcctcctgagtagctgggattacaggtgcatgccaccatgccaactaatttttgttcccttttctattttttacatgtaataattatatatatatatatgtatgtattttttaagtgctatttttgttgcattaagagtatggctccccagggaccacaaaggccttttagaagcctccgtatgtatttataggttatcaacaacaacaacaacaaaaaaacctctgctgaaacatacgcaatagtgatttaagaagaaaaggaatttttcacattggatgagaaagaacttcccaagttagttgcctttacaaattcaaacatgacgggctatcggcttggagtgttttttaagagtgacgatgggaggcttatggtaagcccattgtttgacgtgacccaagcatggcctggttaattttgaccatgctcacagcagtggtagaagcaactagccacacagtaccgtacttgttctgaaacacccatctctacttgtgaaaaagtagaggatcattgaaggatcttaagaaaaatttctggaccatagcatatctctgcagcaaaagaaaagtaacatatttgaatgtaaacaaaaacctgagactcacccccacaccccaatgctcaccacactcataagaaaggaagtgagaatgggaacccccaaaggcccacagaacctatatacaactgtctttctctgtgaaaacagatcagccccagaacctctatacgcctctctatgtgaaaacaataaatcagccccagaacctatatacacttgtctttctctgtgaaaacaatgaatcagccccagaacctatatacgcctctctttctatgtgaaaacaataaatcagccccagaacctatacacgcctctctttctatgtgaaaacaataaatcagccagagaacctatatacgcctctctttctatgtgaaaacaataaatcagccccagaacctatacacacctctctttctatgtgaaaacaataaatcagccagagaacctatatacgcctctctttcgatatgagaacaataaatcagccacagaacctatatatgcctctctttctatgtgagaacaataaatcagtcacagaacctatatacacctctctatgtgaaaacgataaatcagccaaagaacctatatacgcctctctttctctgtgaaaacaataaatcagccccagaacctatatatgcctctctttctctgtgaaaacaataaatcagccagagaacctatatatgcctctctttctctgtgaaaacaataaatcagccagagaacgtatatacgcatctctttctatgtgaaaacaataaatcagccccagaacctatatgcgcctctctttctatgtgaaaacaataaatcagccccagaacctatatacgcctctctttctatgtaaatacgatagatcaggatgccagaaaatatgtgattgtccccttcacattaccttcctaattaatgattcaaaactttagcaatccataattttattttttttccttatacagggcctaccctgcttctagataatcccacaacagatactaaataaaaccttacacaattgaattgaaggaagtaagctttgtttgtgtagtacctgagtgagtttagagagtacaaacattgcccataactgagtataatagatatcacaagcatcttccctatatcacctcaaacataaaaataaaatgccaggagatttaacgatgtgaatgggaaagtccaaattataagccttttagaaaaaaactaaatagaaaagtatcttattacgttgggatagtaaatgattttttcctttcccaccccccacttttttttttttttgttggcagcctcctgagccagagtaggctcagagactccagttttttgtgtttttgtttgtttgtgttttgagacagagtcttgctctgtcacccaggctggagtgcagtggcgtgatcttggctcactgcaacctctgccttgtgggtttaagcgattctcctgcctcagcctcccgagtagctgggattacaggcacccaccactacacccagctaattttttgtatttttagtagagacggggtttcaccatgttggccaggctggtctcgatggtctcctgaccttgtgatctccctgcctcatgatccctcaccctcccaaagtgctgggattacaggtgtgagccaccgcgcccggccctgtttttgtttttaagtagagatggacctcggcctcgcaaaatgctgggattacagttgtgagccaccatgcctggctggaagtgattttcaaaatcagacataaaatgtgcaagccatacaagaaaattattgataaattttattctattaaaactcagaattgatatttattaaaagattccataaagaaagcaaaaatcaagctacaaacattttaacatacataatcaaaaaattatttgcatacaaaatatgttctaattctttaaaccatttatgtgtgttatatacactattctgaaaacaaaaaccagcacccaagacagacaaagcgtgtggagctagtgtggctaagttgaggcgggaaattaatgctgcaacaaagttactgactgtctccaacctgttttgtggtgttacacatgggcataataatagctccttcctcataaggctctcggagctataaaccacagtgtgtctaaaataccttgcccagggtctggcgcatggcaagagctcaaccaatggtgaatggttggaactataaataaataatcgtgtcagagccgagtgggaatcaaactcagctccttaagtcctccatgacctagacaggattgttccagaccatgtggcagaagttaaggggccttggtgatgaaggcaagaatgcccacactgtttctcctgttcctccctctttctgtccctgaggcagtagctgactccaaactgagtctcccacacatatccagcagggctcagcctcagggaatccataggattctgggggtggacctttgggaggagaaaccatctcaactaagacactttcctctctcgtcagcaaagatattcagagatggatagccgacttacatttttattttcttcattaattaatttttttgagacaggttctctttctgtcacctaggctggagtacagtggcaagatcactgctcactgcagcctcaacctccggggctccagtgatcctcttgcctcagcctctcaagtagctgggactacaggtgtgatgcccagctaatttgtttgtttctttgggttttagtagagatgaggtcttaccatgttgctcaggctgactgttccatgtcagcctcgcagagtgctgagattacaggcatgagccaccatgctgggccaatttacattttttaataggagaaaccaacttggccctaactcaggtgcactgaaaccaggaactcttactctgaataggtttagctcatgagataaattcccccaaattattggctcattcgtaaattgtctttttttttttttttttttttgagacggagtttcgctcctgttgcccaggctggagcgcaatggcgtgatctcggctcactgcaacctctgccccacaagttcaagcaattctcttgcctcagcctcccaggtagctgggattacaggcacctgccaccacgaccggctaatttttttgtattttcagtagagatggggtttcaccatgttggcaagactggtcttgaactccagacctcaggtgatccacccgtctcgtcctcccaaagtgctgggattacagctgtgagccactgtgccggccctttttttttttttttttttgagatggagtctttctctgttgcccaggctggagtgcagtggcacaatctcagctcactgcaacctccgcctcccgggttcaagcaattcttctgcctcagcctcccgagtagctgggattacaggcatgcaccaccatacccagctaatttttgtatttttagtagagatgcagtttcaccatattggccaggctggtcttgaactcctgacctcgtgatccgtccgccttagcctcccagactgctgggattacaggtgtgagccactgtgccaaattgtctattttatcacaattacatttatggatgttaagtaagatacaaaatacaaaaataaaaaggaagggactgaacaacaacaaaaagaatgattagaaggaggctggattccatcaagcgggtccaggtcagatgctgggggctccacgggcccttctccatggaaggactgaacccaatgcccctccctgctgggacggtggagctaggaagcttttcataacaggcccagtgcttggtgcccatggaggctagagcaaaaaaccttcatgggccaggcgtggtggctcacggctgtaatcccagcactttaggaggccgaggcaggcagatcacctgaggtcaggagttcgagaccagcctggctaacatggtgaaaacctgtctctactaaaaatccaaaaattggctgggcatggtggggtgcatctgtaatcccagctactcgggaggttgaggcaggagaatcacgaacccaggaggcggccaagatcacaccactgcactccagcctgggtggcagagtgagattccatctcaaaaataaaataaaatatttaaaccttcatgggatgagcagagacagccctgttcacccgttcttattgaattttgtgtcttagttttttattccaaaagcataatgtccacgtccatttcattctaagacactttgaggatttgtttgtgtcaggagcgcttagggccaggaggtttggttcctcttcaaaacactgagggaatgtggacttactgtagataagatttgggcgaagcagctccgacccgaaggacacaggccacgcagtcctagtaccccacagagccagcggccaggcatgagtcccagggatgggggcagacgccgcatccaccttgtgtcctaggagggatggggcacacgccgtatccaccttgtcgccctctcacagtcaagggctagagagcagaacccagaagtgggggccacgctgggtcccccagcctgtaggttggcatggggcttcctcagggactaagggagacccagaggtgaaagccaagaaatagcccccctctctcgtcctcttccaccctaactgaccccttggctcccagcccaggcaggcgcccgggaagaataagggctggacacgtgcaagagaaaaggaacatccaggctgcatctcccatgcggacagctgacaggaagccagaccgaagatcaagaagggggcaccctagtttccccaaacccacatggcaaataactgcaggccttctgcaggaagtgtcatgaaaggaagctgacccgcagaatcatcggctggtataataactgccttcctgtgagccactgctaaaattctgccactcttccagtctttaagccacacaagcattgccttctaagccaagggaagaatttactgtatcaggaaaatgtattgcaacatcattctcaggattaacatgtctctttaccttagatctttatttatctttctgccaggtgaccaaagtaggacctgaagaattatcctcacactctatcacaaaaaaaaaaaaaaaaaaaaaaaggctactgagctgagtggggtggtgcagccctgtaatcccagctactcaggatgccatggcaggagcaatgcttgcgtccaggagtttgagatcagcctgggcaatatagcgagaccacgtctctaaaaataaaaataagttactgtggagaatgaatgagtggctaatcccgtgttttgctgagggtttttagatgaccccaacttctcagaacctggctccgaagatcagtcatccccacagccagcccatgaccgtctctgcagtagggtgagctggcctttgggtggcttttggggaaactgcctttagctctacatgccacaaggatttgtaaaagcagctcccaagcaaaaccggagagcaaaacttgaggctccacggaagatacacgaccaacgccctgttccaggtaaacgtaaggccaggccagggtctcccatgtccccctacccaccagacctacacggaagatagcgccatggaagtggcatccagacatcgaaggggcaggagtcagggtggccccatctctccagcaggcaggagggccatgggggtcctggctgcaaagaggccaaggcccctccacttggagaggccttcagtgcccatttcagcagcctcgtccagtgctcctccagcttcagtatgtgcctgagtccccttggaatcgtgttaaaatacggactctgcctcagtggttttggggtggggcctcaggtgcagcctccgtgtcccagtcaacagttagggccaccatacttagcggcaagtcatctactcataggtaagtggtcagtaactaaggaggaccagtcaggccggatgcagctggaatatttctccccatcaagattcatggaacaaataatgatagcgaacaccaagaaagcacaaccaccgctctacaccctttacatgaactcatttaatcttcaaatccgccccaagaacaggtgactaatattatcctatttacagatgagaaaaccaagcacagagaggtcaggagactcacctaggctggtgagtagcaagctgggatttgaacccaggccacctggctctggagttgtgggtcttgacagatcccggtacttctgtacactggggctgtagaatgtgagcagttgcgcaagactcaggatggagtgtgttgtctcggccgggctgagacaaacatgtctgtgatctattatcagaatcttttcaaactatgatgagctctccaaagtttgtttcaaaatactgtaagccttccccctcaccaggcttggcccagaaaatatcttttatcgtcaaacgacttcaaaacttgtttgtattttaatagaagcttagtttcttaggaattctgaaacagtgtttaaaataatcagtatgggcttcaggaattttatcttgaacttcctcactctggggcacaggttgtattcatgtgcttcaaacgttgttgatctgtcttgtctgagtttgtggggaaacggggccgtgttaacctctcgtttgttgtttgatccatggccgtgtgtggtcacgggaggaactcgtggtggtggggctgatcgctggttcaaggatcagaataagaaggttccagtgctgctctgtctccagtttgctgtgtggcctgatcggcttatagcccttctcggggcctcagtttccccatctgtaccatgaaaggtctggctagatgctccgaagtgctggacgtggtgcgttcttgttgagggggtcttgatctttgtcagggtttccccaacagctgccaattttctgcatgattttcatgccgaagggtgactggttctagcaaagcaaggagcgcccagtgaaggcccaaatgcaggtgagaacttcgtggatgaacgagtgttgacagagatctgggcttcctctcggtggttctgggtcccttcaacttgttcccagcactcatctttcctcatgtggcccaagcaccttgatattttataacctgcttgacttcttccagttcctacttctagccccttgctagactccctcaccatctccctgctgcccaccacccctccgagtccacacttcttaccaggctcccaagccccacgtgttctgcggacatccccagaggcctcctcgccccccagcctgagcggcctctctaaccgcattttccttcttccccctgggcttccctgcgagccggcccactgcctggggtgcccgtcctcccttgcttgaccagtaaacgctgactcatccctcaagaccctccttgtgaaactgcctttgcaaaaaccgtaacagaaaattacgacagtgaacgagaccagacctatctgacctcatctttcttctaacctcgaaactgtccttcgtcattcctgggtgtaagctgaactctctttgggaagggatttagtgtatggtttatggaagagcccttcctagaaggctaaactgttcttttaaaacaaatgaaaggccaccagccagcaagtccagatgagagcggctggaattctaaatattcccagccattattccagaggccataggatttgcagcttccacagtgagtcttgaaggtaacttcactccaggagctgactcagcagaagagaacagtttccattccctgtgatttttttttttttttttttttgacatggagtctccctctgtcgcccaggctggagtgcagtggcacaatctcggctcactgcaacctctgcctcccgggttcaagcgattctcctgcctcatcctcctgagtagctgggactacaggcacacaccaccatgcccagctaatttttgtatttttagtagagatggggtttcaccatgttggccaggctggtcttgaactcctgacctcaggtgatctgcccgcctcggcctcccaaagtgctaggattacaggtgtgagccaccacgcctggacggtgactccctgtgatttcaccccctagccaaccagtcagcattccgattcacgggccccctacccaccaaattatccttaaaaactctgatcccaagttttccaggagacttatttgagtaataataaaactccggtctcctgcacagccggctctgagtgaatttctctttctctattgtaactgctctgtcttgataaatcagctctgtctagacagtgggcaaggtgaaccccttgggcggttacacttggagaagggttttccaaggagccttttatggtctgtcctggtaaagcaagttatccatcatttgtgcttccactggatctcatgctgatcaccgtgatttcagatccaccattttattcgtttggatgtgttcagctgcaagtaacagaccacctcactaacagtggcttaagcaatagagacatttaattatctctcagggctgggtgcagtggctcacgcctgtaatcccagcactttgggaggccgaggcaggcagatcacgtgaggtcaggagttcgagactagcccggccaacatggtgaaaccccgtctctactaaaaatacaaaaattagccaggtgtggtggtgcatgcctgtagtcccagctactcgggaggctgaggcaggagaatcgcttgaacccgggaggtggagcttgcggtgagctgagatcgtgccactgcactccagcctggcaacagagtgagactccatcttaaaaaagaataataatcctctctcggccatctggcagtggccccattagggttagttcttcaaggacctaggacctttcccttctattatccttagtgtgctgggtgtgtcttgcctcatggcaaccagatggtggctgcagcctcaagcatcacatcctcacacctcagcgtccaagaaggaagaaaggcagtgggggaaagcaccttttattcatgagtgtatctttttgtagacggaaaatccttactgtggagcacccagtagagatttccttatgtataattaattggccagtgccaagtcatgggcccaccaaccaagactaatcattgacaaggggaataggattgcatgattaatttcgaccagtcatgggtcatcccctgtgactaggtacattcaggcttctgtggtcaagaaataagagaaatgaactttgggtagatcattcggctccgttgaggtccatggaccaacaacattggcatcagctgagaatttgctagaaatgcagactctcaggccccaccttgcacccaatgaatccgaatctgcatttgaacaagatcctccaggtgattcgtacgcacccatagtctgagaagtgctatggttacccgagtcaaatcgtaagcgctagtgctttttttgttttgttttgttttgtttttttgagacggactcctgctctgtcacccaggctggagtgcagtggcgtgatcttggctcactgcaacctctgcctcctgggttcaagcgattccactgcctcagcctcccgagtagctgggactacaggcatgcaccaccacgcccggctaattttttgtgttttagtagagacggggtttcaccatgttggccaggatggtctcgaactcctgacctcatgatccacccgccttggcctcccaaagtgctgggattacaggcgtgagccaccgcacccagccaagcgctttttttcgtggagtcttactcttgtcacccaggctggagtgcagtggtccctatagggagtagggattatgtcttattgatctctatagggagctctatagggagcttagcatatatagggagtagggattatgccttattgatctctatagggagctctatagggagcttagcataataggttctccacaaagctgcttaagtaggtgagaaatgactttctgagtgtggactcctatacctgctcttggcctcttttcctacccttggtatctatccctgtacttcattgttttaatcaatatatttatttatttgtttgtttttgagatggaatttcactcttgttgcccaggctggaatgcaatggcgcaatcttggctcaacacaacctccgcctcccggttcaagtgattctcctacatcagcctcccgagtagctgggattacagacacctgccaccacacccggctaatttttgtatttttagtagagatggggtttcttcatgttggtcaggctggtctcaaactcccgacctcaggtgatccacctgcctcggcctcccaaagtgctgggattaccggtgtgagccactgcacctggcctatttattttattgtatttattttattttattttattttattttaattttgagatggggtcgcactctttcacccaggctggagtgcaagggagtgatcacagctcactgcagcctcaacctcctgggctcaagcgttcctcctacctcagcctctggagtagctgggaccacaggtgtgagcaaaccacatccagctaattatttatttttaaattctttttatttttttgtagagatggggtctcactttcttgcccaggctcatctcaaactcttgtgctcaagtgattctcccacccgggcctctcaaagtgctgggattatggcgtgagccaccgcacccagcctgcccctgcactttattagaggccccaattttctttctttctttcttccttttttttcagatggagtctcactctgtcgcccaggctggagtgcagtggcacgatcttggctcaccacaacctccgcctcctgggttcacgcgattctcctgcctcagcctcctgagtagctggaactacaggcgcacgccaccatgctgggctaatttttgtatttttactagagtcggggtttcactatgttggccaggctggtcttgaactcccgaccttgtgatccgcccacctcagcctcccaaagtgctgggattacaggcatgagtcaccgcgcctagactagatgctccaattttcacttcttgacctgaccaggcacctttaaatgtccacactcaagacctgactctctcaagtgcctgaagtcaaagacatcttttgtccttaaaaaacaaaattcctcccatagtctgcagttgtgaaaggtcctggcggtctggacatgtactcgctgttgatagtcctgttgtatgtgtagcttttgctggaaggtcctggcggtctggacacgtactcgctgttgacagtcctgttgtatgtgtagcttttgttgtgagctgcctcaaatgcttttttggaagtaggtgtggtataaataataaataaatgagtgaatatctggaagtgtggctgtttttatttaatcatgggagaatgtggttacctctgcgataagtccctctggctaagagtaaacaggatggcccggcccctgtctagaatctaaaagctgcaggctgatacagaggacgggcgtggtaggagctggtttgagactcgaccttcctttttggtgcagcttgctggttgtgtagtaggtgagtttcagagaggaaaaggtctgaagcctcatcactgccatcagagcaactgtctgtgtgatgaaaggatccctctgcctgggccttattttccgcaagcgaataacaaggaatttgggttagattgcctcaaaaggccctttgaacttggctgatgtgtgtgttttgagggagaggatctgtgaggtgcttcccagagtgagggtggggctgaccgtgcagggcaggggggacaggaaatagcaccctgaccgctttccttctcaaccacctgaggccgtggccgtctcacaggagctgggaaggagctgataagagggcttactggccccctgccataaaaggatgcagttcccactcttgaagctgttctgtcccgggcaggaggctcagcaacagagagcccctgacacccctgctctgtgcttttggcttgggggactgtcccctctgtgctccaagtggattcagtggccagcctcttccccacccagcctcaaccagcacagagcagccaggacagggcaggcagagggaggaaaagtttgcaaaagtggggtgcttggggcacagacaaccctcaggtgcctgggggatctgagggggctcctaagtgatgagaaagcagcaggggaggccccccccagtgccctggtcgaggagaagaggggctcacatttgctgtgctgcccaggctgtagtgcagtggtatgaccacggctcactgcagcctccatctcccagactcaagtgatcctccagccacaacctcctgagtagctgggactacaggcatgtgccaagatgcctggttaattttttattttaagtggagatggggtcttgctctcttgcccaggctggtctcaaactcctgggctcaagcgattccccaacctcagcttcccaaagtgctgggattgccggcatgagcaccacatccaccgcatcgctggctttgaagatgaagaagggagcgacaagccaaggaatacaggtgattgactgcctgtcattagcgcggtggctcacgcctgccattgcctgttgtccccgtcctctgtggccctcttggcttctgtatcactgtcacgcgtagcagggccaggcttgctgaactgaaccgaagcaagaagacaagggaagggctgtgggaagcgtccatcatgaggctccgtgtcctcctcccaggcctcgcctggcctcgcctcaattcacctcgggcagcagctcaacatgtgggatttcaagactaagcctgaagatcagccagaagcaagctcctcacccctgacctggccgttcccttccccgaggctttgtggccacagtcctagaagacggagacatgctttggactagcctccaggagtcagggcccttcaacaccatttttttttttttttgagagaggatctcactatattgcccaggctggccttgaactcctgcgctcaagagatcctcccacacagcctctcgaatagttggggcaacaggtgcccacgaccacaccagctccgtcgctcttcttgaatgtacctggaatcctggtctgaactgagcggttggctgaactttcctctctttttgcctctctccaggctgagagatgagccctgctaaggagcagattgctcagttatagaatatttacagtcttgtattgtagagaacagttcacaaagccccttctgcttatttcatttagttgctgccagtcagcaagatggatgccataatcatcatctccatgtcacagctgagaaaaccaaggctccgagagatctgagaaaaccaaggctcctggctgggcgtggtggctcacacctgtaatcccagcactttgggaggccgaggcgggtggatcaggaggtcagatcgagaccatcctggctaacatggtggaaccctgtctctactaaaaatacaaaaaattagctgggcatggtggttggcgcctgtagtcccagctacttgggaggttgaggcaggagaatggcgtgaacctgggaggtggagctggcggtgagctgagatcgcgccactgcattccagcctgggcgacagagcaagactccatctcaaaaaaaagaaaaaaagaaaaaaaagaaaaccaaggctctgagagatctcagaaaaccaaggctcagaaagatctgagaaaaccaaggctctgagagatctattttctgttgttgctgtaacaactgaacacaaatcgagcatcttaaaaccacacaaatggggtgggcacagtggctcatgcctgtaatcccagcactttgggaggccgaggctggtggatcacttgaggtcaggagttcaagaccaacctggccaacctggaaaaaccccatctctactaaaaatacaaaaattagccaggcgtggtggtgcacgcctgtagtgcagttactctggaggctgaggcaggagaatcgcttgaacccgggaggcagaggttgcagtgagctgagatcacgccattgcactccagcctgggtgacaagagcaaaactccatctcaaacaaaacaaaacaaaaaaccccacaaatgtattaggtcacagttctgtgggtgagaggtccaggcacagcacggctcactgctttacaagaccaaaatcaaggtataggccaggctgcctgcctttctggaggttctgggcatgaatccgcttccagtcctgtgagggctactggcagaattcagttgcgtgtggtgtgggacgaagggcttgtttcctgctggctgccacctgggggcctttctcagcttctagaggccacctgcagcccttggcttgtggctctgttccttcctctccaaagccagcgatggtggctgctgctcatgcttccaagctgtctggcatcctttgtgtcttacgtctcttctgcctttatccagagcgagttttccacttttgagggctcccgtgattagaccgggtccactgggataaccaaggataaaacctcactcacatttgcaaagtccactttgctgtgtggtataacacagtcacaagttctgggaattagggcacggacatccctggggaccatgattccgcctaccacagagtggcttccaaacctgtcgctaagctcgtaagtggcagaggtggaagctgaagatcctctggctgctgaactctttccaccacatccctgctgctttgggccatcatttacgtcaacccagctgagcccaggaagaagaccgtctcgagagagtatttctgcaggccctcggtcacccggactggctcctcaccccctgcgactgtcccagaagttctctggaagtcaaaactaattgatacaagatggggctgaggcaagtcgagggcctctgcctgtttctgttgtagaagcctccaggaaggcctcacatcgccggtagatgtcctgggtaccgcggagtgcacttcctttcccgtccagatcgggcagggtgaaagaatgagctggagattccgaaataaaccagcatccctgactgcggcagacacggcccctccaacgtctgcctctggtccgcagtaaaagtatatttattccttcccatcaggaacttccccctataagcagattggatgctacatacctttcactcattcacgattcattcactcatgatcgtacccctgctttgtgtggggcacattctagacactccagatctatcagtgaacagaagagacaggcctcatggagcctgcattctggttgtggcaaggagagggttgacagttataaataaacacagtatatgagttaatgatgtcatatgttagaataagagctattaaaaaaaagagagggtgacaggatacggggatcaggagtgctggtgggaatgcagacggcactgttaaacatgggggacagccgggcgtggtggctcaagcctgtagtcccagcactttgggaggccgaggcaggcggatcgcctgaggtcaggagttcgagaccagcctggccaacatggtgaaaccccatctctactaaaaatacaaaaaattagctgggtgtggtggtgggcacctgtaatcccagctactcaggaggctgaggcaggagaattgcttgaacccgggaggtggaggttacagtgagccaatatcacaccattgcactccagcctgggtgacaaaagcgagactctgtctcaaaaaatatatatacatatatgggggataaggtgtgtttcactgagaagatgaggtttgaacaaaaacttgaaggagagatgtagcgaaatggatacttgaggtgggagcattccacgtagagggggcagccatgcaaagtccctgaggcagaagcatgcttgacatattggaggaacagccaggagcccagtggattggagagcacagccactataaggacttggtttgagtggaacaggaaacccgggtggggctttggataaagcaacgacttgtcaaaagttcttgagtttccacggaatgctcacgcagggggcaggtggagcatcctggtcctgcggattctgctgataaaccggaggcaagacggatggctggctgggccaggtggaggctttctggaatgtagccttgggagaattgtggatgctgaggcaggtgggccctggcctcgggtcagctcatagatgagggagcggttgctgggccgtgcagattggcttgatatcgtaaaccaactggatgaggacagagattgatgctctccagggtctcacaagctgagccacagaaacaccccggcatccaagccaggagatgggaacgaccggctcccacatcagagaatcagcaacaagtcaagctttgtgagggggaatccaggtgaaaccgtgtaggtttcaccataagttaccagctacgaagccaagcaaaatcatgattgtcccggtggagctttaagtgagggagaccctgaggggtttgtgtcgattactttggacattaacaggccctgctggatggaagtggcacagggccagctatgtccagtgtaagatgtggtggaggcgttgccattccctttgtcccaggtgctgtcttgattatgttgatccacaaaaaccatgattacaggggctttcagagtttctttttttttcttttgtagagacgggctcttgccatgttgcctaggctggtctccaactcttgggctcaagagatcctcccaccttggcctctcaaagtgctgggattccaggcgcgagccaccatgcccagctccgagttccaaccccagctttctgtcttgcccctccaagcgcccttccccatgggaaactctttttgtgctccgcggataagaagctcttcttccttgagggtttcaggacagaggacactggggagaagatacctgtgtctctactgggcagctgctccagtcagtggtgtctggtggggccaaagccctgcctggagagcagagagctggacccaacagatgaacctcctgggaagctgcattcttgatggtaaatgaagagatcagaacctcacagggaggaaacaggcaatgccaatgacacctacatctatggcttgaagtgcagagagaaaagcacagaagaaaatatactaaaacatgagcaagttatatttccagggtgggggtttattggtaatattttttccttccttataattcatatgtattccaagtatatatttttcctatatctcaagtgctctgtaatgagaggaaaacaatgaaattattatatttataattatagtggcagaaaacgtaacttggtgtaaagaagaactccctgaatgaatggggactgacaaaaaaggggtcaccggccgggcacagtggctcacacctgtgatcccagccctttgggaggctgagatgagaggatcgcttgaggtcaggagttggagaccagctgggataacacagtagactctctctctctctcttttttttttttatggagtctctctttattacccaggcttgagggcagcggcacaatctcggcccactgcaacctccatctaccaggatcaagtgattctcctgcttcagcctcccgagtagctgggattacaggtgcacatcaccacatctggctgatttttgtatttttagtagagatggggtttcaccatgtcggccaggatggtcttgaacttttgacctcaagtgatctgcctgcctcggcctcccaaagtgctgggattacaggcgtgagcccccgtgcccggcccagaccatgtctctctaatttttttttaaatgagtcttcagtgaggaggctctgccacctctccgtccttgagagggacacacactgcagtgcctgggaggactggcacatgcttagaggcctgggggagagtggttcatctctctttaaaattattttactgtattttatttttttagagacaaggtctcactgtgttgccaaggttggtctcgaactcctgggctcaagggatccacccacctcagcctctcagagtgctgggattacgggcatgagccacagtgcctggcccatttttatctatttatttatttatttttattatttatttatttatttattgagacagacttttgctcttgtcgcccaggctggagtgcaatggcgccgacctcagctcactgcaacctccacctcctgggttcatggattctcctgcctcagcctccggagtagttgggattacaggcgtgcgcccccacgcccagctaatttttatatttttagtagaggcagggttttaccatattggtcaggctggtctcaaactcctgacctcaggagatccacctgcctcggcctcccaaagtgctgggattacaggcatgagccactgtgcccggccattttttaatgtttttatagagtcagggtctcactatgttgcccaagctggtctcaaacttctgggctcaagcgatcctcctgccttggcctcccgaagtgttgggattagaggcgtgagccaccgcccccagccaagtatgtctataactggggaagcctaaaccatgagccactgactgtctgttcccggcaaagtccagacgctgaagctgtgaaaagtcggctggaatgagctcggaggcccctccagcatggatcctctcgttccgggttccctgtggggtcagggctacggccaagatctctcactccagatcctctgactgtgtcccagtgccctggtcactgctcttctgggtttgaagggtcttgagtgttttcatggcctcttgtcaatagaagtatattttctgccctttcccagactgtcccaggagagacttctctgccctcttctccttctgaaacagtcctgtgcgtccctactctgctcagcttcatcccaataactcaggaagcaggaaacactcaggaagggcttactcagcactaagccctgggaaatagaggcgagcaagacaaggtccccatccttatggaacttactcgtaacgaagagaatttcaaacggtgaaaaatgtatgcgaagcaccggggagataggacagtgagtggctgtgcagagatactctaaatacatggcccagctcatcctctctgagcaggtgacattggaatcaagaatttcatttgctgagcacggtggcccacacctgtaatcccagcactttgggaggctgaggtgggaggatcacttgagcccaggagttccagacgagcctgggcaacatggagaaaccttgtctgtacaaaagatacaaaaattaggccgggcacagtggctcatgcctgtaatcccagcactttgtgaggccaaggtgggtgaatcacctgaactcaggagtttgagaccagcctggccaacatggtgaaaccccgtctctactaaaaatacaaacattagtcgggtgtggtggtgggtgcctgtaatcccagctactcgggaggctgaggcgggaaaatcgcttgaatccaggagtcggaggttgcagtgagccgagatcgtgccactgcactccagcctgggcaaagagtgagaccccatctaaaaaaaaaaaaaaattagccgggcgtggtagtgtgcacctgtactcccagctactcctgaggctgaggtgggaggaccccctgagcccaggaggttgaggctgcagtgagctgtgatcacaccactgcactccaacctgggtaacagtgagactgtctcaaataaaaagaaaggatatttcatgatacttctctgttgatgtgtgtccctccctttgtctgatggggtctgtgtcttagtacacatatctcagaggtcgcatagtgcctggtacatagacagagcttgcagatgtgaattgaatgcatggatggacagtgagaccgtggaggggatggtccaaccatcctctgcactgttcagacccatgaggagctctgagtccaggtccagggaggcagattcctccccagaacccctcgacttatcaccgaagagtgcataggagactggagaggttgaagagcttgccccactgcacagccagctgggcggcatagctccctggtgagctcagcacagcagtgggaaacagaggtgaagggcagagccttgaacttggctgtgttctctacccactgtgtgacctcaggcaactcacccagctctccagctttgagagttgggtaacttgcccgactctcattgggcacctacctcattgagttctgtaaggattaaatcgagataaaatatgtaaagaactcagcaggcaggtgggctgagaaaaagggagcagccagcatgtctgtttctgcagtgcctcaggcaccagggcctgccagtggccacagaaatggagttgacctcaccggctcccttccagtctcccaggctgtggggcagtgacaaccccaagcaggaggctggaggcacagacttccaagaaggaggagacgaggcatgctggtacattttccaccttactccaacccttcacccacatcctgacttcttcaaaagaattattgtataaacaatataaaggcattaaaaaaaactgcaaaggaaaaacgaaccacctatgatctcagcattcgagcccaacaaggttgttttcttcctgtctagttcttccagcttgtccaggcatgtacatattttatttcgctgtagtcagagtcattatttattttttgcttgtgtaatatttttatcataaatgttcattcacaatcctgtagtcttcataagtagaattttttttttcccccttcaggacagagtgttgctctcgtcgcccaggctggagggcaatggcgcaatctcggctcactgccacctccgcctcccgggttcaagggattctcctgcctcagcctcccagtagctggaactacaggcgtgcaccaccccatgcccatctaatttttgtatttttagtacagacagggtttcgccatattggccaggctggtctcagactcctggcctcaggtgatccacctgcctcggctttccaaagtgctggatgacaggcgtgagccactgcgcctggcccataagtagaatttttaatggcaacctgatatgccaccaagctgatgcgccatcagttatttcttcattattctcttgctggatattttcttctttttgctgttgaaggacaacatatttatacataattttaatttatttacttacttatttttgagacggagtctcagtgtattgcccaggctgatgtgcagtggagtgatctcggctcactgcaacctccacctcctgggttcaagcgattctcatgcttcagcctcctgagtagctgggaccacaggcatgtgccttcacacccagctaatttttgtatttttaccagataaacggtttcaccatgttggtcaggctggtctcgaactcctggcctcaagcgatccacctgtgttggcctcccaaagtgctgggattataggcgtgagccaccgcacccggccccaaattctttatggctacattgctccccagagtggaataatttacacttttctagcagcatgtgagtaccttccaaccaactcggcacgggcttttgtgctgttgatatggttgcatcttgtcagtttcatctggtacagtgtggtgttattcactgttgaacttcctctcgaataaaatttagttcatattttttgctcattatcagtttttgtttttgtttgagacagggtctggttctgttgccaggatggagtgctacggtgcgatctcagctcaccgcagccttgatctctcaggctcaagtaatcctcctaccttagccttctgggtaactaggactacaggcatgtgtcaccaggcctaggtaatttaaaaaaaaaatgtggccaggcatggtggctcacgcctgtaatcccagcactttgggaggctgaggcgggcagatcataaggtcaggagatcgagaccatcctggccaacatggtgaaaacctgtttctactaaaaatacaaaaattagctgagcatggtggcacatgcctgtagtcccagctacttgggaggctgaggcaggagaattgcttgaacccgggaggcagaggttgtagtgagccaagatcacaccactgcactccagcctgggcaacaagagcaaaactccgtccccaaaaaaaaaaaaaaatgtttagtagagacgaggtctcattatgttgcccagtctggcctcaaactcctgagctcaagttgatcctcccacttcagcctcccaaagtgctgggattacaggtctgagctaccatacctggcctagcttatcagtcttattagctatttatgaaccttgtcttttgtcattatttgctgcaagctcttcctccaaatctttttctttttcaaaattatatttttaaaaagttataaaagcaatacatgtttatggtagaaaatctgaaaaatagagaaaaagtcataaaatatatgccaccacttaaaattaacctttattatcctgtttgtctgtctgtttttgagacagggtctggcaccgtcccccaagctggagtgttgtgagtgtggttcccagcagccttgagctcctgggctcaacgatcctctggcatgagccgctgtgcctggtgttattatcctgtttcaaaaccagctgtgaaaagataatttgaccctattgggaaatgaagatatggactggttgttggatgatactgaggaatttttgttagttttgttgagggcgtaatagcagggtagatgtatgttttcaaaatcccttatcagtttacatgctcactggaatatttacaggaaaattcatgtgacgtcttggctttgcttttaaaaactccagcacacacacaaaaataaataaatgattggggaaaattagataaaaccaaattggcagtatttgttgatactagatgatggatatatgagtattcatttcattgttctctctacttttacgtacatttgaagttttctgtgacttacgtttaaaagttatcttctcaggaggactcccaggcttagcttgcctaaaattccaatcccatctccttggctgactttcatactcctcactcctgctttgtttttcctccttagcatttcatcacgacctgccacgctaaacgcgttcttaggtatctggtcatcttggcttcttacctctccccaactggaatgtgaactccctcaggaaggaattttactgttttcttcccgcccttgctatcaacagtgcctgagtattcaaatcattatcacatgaaaaacaaactcactgttaacatttttcttcggttttttgtttttttctgagacaggctctcactctgtcacccaggctggagtacaatggcatgatctcggctcactgcagcctcaacctcacaggctcaagagatcctcccacctcagcctcctgaatagctgggattgtaagcacgcatcgcaatattcggctaattgttattttctgtaaagacagggtgtcactctgttgcccaggcaggagtgcagtggtgccatcacgactcactgcagcctcaacctccgaggctcaagcgatcctcccaccccagcctcccacctcagactgtagtcatgagccaccatgcccagccaataaaaactttaaaagacctttctaaaccatcaaggttggaggcattaaggatttttgttgttgttactgctcatttcttttttcttttttctttttttttgagacagagtctcaccctgccccccaggctggaatacagtagagcgatctcagctcactgcaacctctgcctcctgggttcaagtgattctcccgcctcagcctcccaagtagctgggattacaggtgcccaccaccatccccggctaatttttgtatttttagtagagacggggtttcaccatgtttgccaggctggtctcgaactcctgacgtcaagtgatccacctacctcggcctcccaaagtgctgggtttacagtcctgagccacggcgcccgaccatcatttcttaacgagcatacattaaaatttccaggcagtcaaacttagtgactgctttacaaacatgaaatatcacaccaatatttaaagaaatgagcaaaacctgtttttaaaaatttacacacaccaaaaacgacatggaaaacctaggcccacttttaggatcgccctctagacaaaacaaataaggaaaggctaatctttgaggaaaatatcctataaaatatacctgaggggagaaagcccctatcatgaagaaatggttagagctattctgtttcccttgtggtacttttatcactctttaagagaatccatcacaggccttcaatctctagccagcctagacacagatgtgcgtgggccgacccagcaaggggcaggaggaaaacccctctgcttcctgtccccggcttctcccacttactcccccgccccccacctctgcccgtctaatggttccctgggccgactcggtcgccctgccagcctgtcctccttcactcaggcacacactgtttccacgcccgggagcctggctcacttgcagagctataaaaacagacatccaccaggcacggtggctcacgcctataatcccagcactttgggaggccaagatgggtggatcacctgaggttaggggttcgagaccagcctggccaacatggtgaaaccccatttctactaaaaatacaaaaaactagcctggcatcatgtcatgcgtctgtaatcccagctacttgggagactgaggcaggggaatcgcttgaacccgggaggcagaggttgcagtgaaccgagatcacaccactgcactccagcctgggcaacaagagcaaaactccatctcaaaaaaaaaaaaacaaaacaaaaacactcagacatcaggctggccgccgtggctcatgcctacaatcccagcactttgggaggccgaggcagggaggatcccttaagcccaggagttcaagatcagcctgggcaacacggcgaggccccgtctctactaaaaatacaacaaaattagctaggtgcagtggtgcttgtggtggtctcagctacttgggaggctgaggtgggaggatcacttgagcccagaaggcagacagaggttgcagcactgcactccagcctcggtgacagagtgtgactccaagtcacaggaaaacccaacaaaacacagacgccgcccccacctgctttgcccgactctgcagagtcccacccggatgatctgggggagggaaggagtttgtctttttcgaagccctctgtggttttcggatgagcggatttagggacagtctgcacatgtctttcactcctgctatggaccccagaacccaccacagtgcctggctaaattgcacgtgcttaaataaatatggaacaaatgaaccaactgacctcttttgatgttcccagccattctgtgaggcagaggatcaaatgggtattattgtccccatttgacagaggcccagagaggtgacaggaattccccaaggtcacagatggaggggcccgaggctgcctcccactaccaggctgatttccagaggcttaaggtgggggctgagtttaaggaggggaaaaagaaaaacacatccccttacctagtgggtagagaggagtaggggcaagggagagaaaagaggaaacgaaagaagaggggaaagaggaaagaagaaggggaaggttagagatgcctaaaagcatggaactggaggaaagacatcaaaataacaaagagcaagactagccgcgtggtggctcacgcccgtaatcccagcactttgggaggccaaggtgggcagatcatttaaggtcatgagttcaagaccagcctagccaacatggtgaaaccctgtttctactaacaatacaaaaaaattagctgggcgtggtggtacatgcctgttatcccagctactcgggagagtgaggcaggagattcacttgaccctgggaggcagagtttgcagtgagccgagatcatgccactgtactccagcctgggtgacagagtgagagtccttcgaaagagagagagagagaaagagagagagagaggaaagaaggaaggaaggaaagaaaagagagagagagagggagggagggaagggagggaaatgagggaagctaagagggggttgggctgcaaatcctatctctgggcagcgggtctgggcccctcgtccctgcagcaggtctgggcccctcgtccctgcagcgggtctgggcccctcgtccctgcagcgggtctgggcccctcgtccctgcagcaggtctgggccactcttccctgagtttgatgcttggtttggagtcagggctctgagcccagagtccctgtggaaaacacatccctccactgactatggcctctgtcccacaacctcccccctccccaggcctgtgtgtgtttagacagcttgccctgcatttttagaacaatttttaacttgtaggctgtacctgcggaaccagaatgtctggccaagacctgttacctaacagcctcagaccatttgggtgccaacagcaactgcagctctggcccaagccaggtgtgggctgacctagccagggagcggggaagtgaaaggaatgggtcccttcccactcagagggcggagcccccacttctggtgagagaaagctgagcagaatggatctaatctgattcctccacccagaagcccttaaaatgcagctttgttttaagccttcttgaagatttgggctagatctagaaaagaacctcaccacggaggatgtgcaaagtacaacacgtgaccccggagacggaagctcttctctacctccgtaaagatgatctctgatgaacagacatgatcatgcctggagaacagggatggacagtcccgcttctgaaagaccctgtctggctgatgattcatggtgcgccgggcagaccccaggccaagagaccccacccacagtacctgagtgctcagctgggaaccagaccagacctcaaaacaggtttgcagaattaagatgaggagctgagctcaacacagcctccgcagctccccagggcgggcctgagccgagggagagcccatggccatcagggtgctggaatgcatgtcacactgcattacgtgcattacgatccacgctgcaatgacagcccagagcgtggagaacccagagagggtggggagatggaatcccggcgagccagcgctggcagggaccacggggagcagctggtccagccgccggttttccaagagagaagactaagaagtgagtcacttgcccacagccacagagagaaggagggcaacgaggccggcaggtcagcagcgagcagttagttcaaggccttgagggcttccactaactttgaagggcgaggatgggcggagctctggaggccgccggggtaggttcgaggggagtgttcaagaagcctcttttttttttttttttttttttttttttttttttttgagacggagtcttgctctgtcacccaggctggagtgctgtggcgtgatatcggctcactgcaacccccacctcccaggttcaagaaattctcttgcatcagcctccggagtagctgggattacagacacccgccaccacacccggctaattgttgtatttttagtagagacggggtttcaccatgttggataggctggtctcaaactcttgacctcaggtgatccacccgccttggcctcccaaagtgttgggattacaggcctgagccaccacaacaagccaagaagccctttttgtagagttctaatcctgggtctgcggctgagccatggttgtgttcacaaagcagagcaatcaaccgggcatagggatggacctcctggggccaaaatggcggctgacatctccaccctgacctttcttctcaggttcccaaggttaccacccaaccctgccaactttcgcaccccgcaaggagcaagaccccgcccgctcaccacctgcctgtgcagccaacgggcctcgctgagctgccctgggccgctccctccattcacacagttggccctccctctccctgcctcccttcgcctaccccacgaactacttcatccctctgggccggcactgtagaagccccattgttcacatcgacctcccaattatctcctctttccctctccctctgctcctgcccagaccagccccccagcattgacctggatgcctgccacagcctcctccctggtctccggcctcccacctctgctcctcggtctcctctacccagccagtaactgcagagagcactaaagcacagtcctggcatctcacccccttaaccctggccacggcttcccagtgcctccaagataaagcaccaacacctgaggacagcaggtgagtcctcccggagctagctctcccccaccttcctgtcaccctctgccccaggctctgcccgtgctgctgccccctgaacccacacttccgtcttttgctttccctttccctgggatgctcttataccccctggccccctgggatatcttctcatctgttaagtctcaacccagagctgcttcctctgggaaaccctcattggtctcctcgggcagaggctggtgtttttctctcatgcgtcctcgggcagaggctggtgtttttctctcatgcgtcctcgggcagaggctggtgtttttctctcatatgcctgcaacagcctgggatttcctctctcagcgctttttttttttttaatcaaaaaaatttcgacggggagacaggatctcactatgttacccaggctggttgtgaactcctagcctcaggtgatcctcctgcctcggcctcccaaagtgctgggacgacaggcatgagccaccgtgtctggccctctcagcactcgctaccgagggtgttctaatacttcattcgcctgctgtgggaggcagcctctaagatgacgctcagtgatccctgcctcttggtatttcctgtgtaaaaccgtccccttgaatgtgggctgggctaattgactcactttttaatttatttttcagagacagttttaaatttatttttcattctattgcccaggctggagcacagtggcataatcatagctcactgcagcctcaaactcccgggctcaagtgattgcccaccttagcctccctagtagccaggaatccaggcgcacaccaccacgcctggctctgattgacagacgcacaccaccacacctggctctgattgacaggcacacaccaccacacctggctctgattgacaggcacacaccaccacacctggctctgattgacaggcgcacaccaccacgcctggctctgattgacaggcacacaccaccacagctggctctgattgacaggcacacaccaccacgcctggctctgactgacaggcgcacaccaccacgcctggctctgactgacaggcgcacaccaccacgcctggctctgactgacaggcgcacaccaccacgcctggctctgactgacaggcgcacaccaccacgcctggctctgattgacaggcacacaccaccacagctggctctgattgacaggcacacaccaccacgcctggctctgactgacaggcgcacaccaccacgcctggctctgattgattcacttcaaaccaggagaatctgtaactgcccatgtgctcttcttgcccaatgcccagttagagctgatttattacaacaggggaattgcaatagagaaagagtttaatacacgtagagccagcgaaatgggagaccagagttttattattactcaaatcagcctgccccaaaattcagaggcgaaggtctcttaaggagagtttggtgggcagggagctatgggacgtgtgctgctgatcagctgggggggcaatcacgggggtgtggaaattggcccttgtgctctgaggcagcctctgggtagtggccacagaggagctgctggtttgggtggggccttccggtcatcagtaacctgaaaccctgaaaagagatctcaaaaggccaatcttaggtcttacagtagtgatgttatttacaggagtcattggggaagttgcaaatcttgtgacttctcatgggaatcatctcacagcacccacatattcgcggaattcatgcccctttcctcctcttaacccagtggcctttggaatagtggctgggaatcatctcacggcacccacatcttcgtggaattcatgcccctgtcatccccctaacccggtggcctttcattagttttacaaaggcaatttagttttggaaagggctattatcatttaaactataaactacatttctcccaaacttagcttggcccacacctgtggatgaccaagggcaccagcctgaacaacacggtgaagcccctcatctactaataatacaaaaattacccgggcgctgtggcgtgcccctgtagtcccagctactcagggggctgaggcaggagaatggcatgaacccgggaggcggagctggcagtgagccgagatcacaccaccgcactccagcctgggcgacagagccagactccgtctcaaaaaaaaaaaacaaaaaacaagcagtgaatgtggatctaaacaaaatcacaacgtaactcaatcaggaggaagagaagggcagagagtttctgtgtggtggggacagggagaacaaaaatgagctacatcctcattgttcacagtgaaaactcaatagatttatctcaggctgggcacagtggctcacacctgtaatcccagcacttcgggaggttgaggccggctgaccactggagtccaggagttcgagaccagcctgggcaacataggaagaccccgtctctacaaataattttaaaaattagccaggtgtggtggtgcatgcccgcggtcccagctactcagaaggctgaggtaggaggatacctgagcccctggaggtcgaggctgcagtgagctaagatcacaccactgcactccagcctgggcgacagagagagacctgtctgaaaaaaaaaaaaaagaatcatctgaaaaaattgacagtggttgaaaatcattgacatgaggccaactaattaacagaaaaaaggcataaaactaatttacatgcacatagggagagtcagggtgcctgcgccccagtggggttcagaagctcatacagcatcctggcagcacagtttatgggaggcaggaaaagagggggataaaggattactagggaaagtaaatggatctaggaacagagatcagtttacatactattttgtggaaagttctgttcaagtttggttacattcctggctttacaaataattgctccttgtgggtctggaacttgaccaattaaaaaacttcaacttctttggggaaaggtcagagagacctcaaggcttcttcggtcccatatgtcaaagcaccatattctggggtattggtttctgagttccagcacctgtaaggagtagaaaaaggagtctgagttgcaaaggatgggggttttcacaccaagtaaactcataaaactatgttcaagtataactctattacaaattaaaatacaaatctaccacggctgggcacagtggctcacgcctgtaatcccaacacttcgggaggctgaggcgggcagatcacctgaggtcaggagtttgagaccagcctgaccaacatggagaaaccccgtctctactaaagatagaaaaattagccaggcacggtggtgtgcacctgtaatcccagctactcgggaggctgaggcagaggaattgctcgaacccaggaggtggaggttgaagtgagccgagatcgcaccactgcactccagcctgggtgacagagcgagactctgtctcaaaaaaaaaaaaaaatctaccacaatgtctacatatggaaggtgctccaaaagcgtgaaccattagaattcctatggaatgacgttttcatcaaacagcttttgctatacttacaggtggatgtgattgcaaacaacaaagcctgaactcagatggggaaagaatcagtggggatcatattgtgtcatgtccaagaggttcacagatcaaattcaggcatggctggatccaggcgttcacagcgtgccaacagagatcttgctgtctccatttcttggctccattcactgtgttgactttgctctcaaacaggctcctctcagaccttagcacactggcctccagcggttgcaggattctatactgctggcttagtgctcccaacagaaaaagagtgtctctacttggtagttgcaaccaaatgcctcagatagacactgacatggtttggctctgggtccccacccaaatctccagttgagtcctaatcctcagtgttggaggtggggcctggtgggaggtggttggatcatggggtggatttctcatgaatggtttggcaccatcctctcggtgctgttctccatagtgagttctcgagagatctggccgtttgaaagtgtgtggccccaccccctcgctctctctcttgcttctgctcctgccgtgtgaagtgcctgctcccgcttcgccttctgccatgattggaagtttcctgaggcctccccaaaagccgggaagaggccagcgtcatgcttcctatgcagcctgcagaactgtgagccaattaaacttcttcttttttttttttttgaaacggagtttcaaaaaaacaacggagctcttgttgcccaggctggagtgcaatagtgcaatggttgggattacaggcatgcaccaacacgcctggctaatttttgaatttttagtagagtacagacgaggtttcaccatgttggtcaggctggtctcgaactcccaacctcaggtgatctgcctgccccagcctcccaaagtgttgggattacaggcgtgagccaccacatctggccaattaaaatgatttcttcttttctttataaattacaccgtctcagggttttttttgttttgttttttgttttttgtttttagacggagtctcactctgtctcccaggctggagtgcagtgatgtgatctcagctcactgcaacctccgcctcctggattcaagcgattctcctgcctcggcctcccaagtagctgggaccacagtcacacaccaccacgcctggctaattctgtatttttaatagagacagggtctcaccatgttggccaggatggtctcgaactcctgacctcaggtgatccgcctgcctcagcctcccaaagtgctgggattacaggcgtgagccaccgcactcagccagtctcaggtatctttttacaccagtgtgagaacagactaatacagacactcattgatctggcttgggtcacatacccacccttgaacagattgccgtgaccaagggaatagagcacttggattggctaaatcccagtcctaagccgaccgctggaaccacggacaaagtgggggcagagtggtctcacaaagaaaaatatggatgcttttattagaaagagagaagacgctgcaaaaccaacaggtctcccctgtgtctgaagactgagactaggccaggcacgatgactcacacctgtaatcccagcacttcggggggcggaggcaggcgaatcacttgaggtcaggagttcaagaccagcctggccaacatggcgaaaccccatctatactaaaaatacacaaattagacagatgtgcttgtttgaacccagggagtgaaggttgcagttagctgagagtgcgccactgcactctagcctgggcaacagagtaagactctgtctcaaaaaaaaaaaaaaaaaaaaagactgagactgctgtttgccttcatcagcacagaagccgctagttaggaaccattctcctagcacacccactccctgtgcttcacaaaagcaggtcaatgtttacagaagtcccctcttcccacgtcttctcatcttcaggggaaactgttgcgaggaacagaggactggagagaccaatacgggaaacaggaggatgtttatttaaggtgcaccagctcagaggattcgtatccaaaaagctgagcattgaacaaagtcagggtttagcttatataggccagcgcaaaggctgtcaatcacacagtgacagcttctgtcatctacagcataactagtgacttggcacaacctgtgcccttgcatagcgggtaaccttgcagctgaggcaaaagaaaacaggaacttacaaatctgactaagtacaagcattggcaaacatagtcagaattattagttcagagaaggagagacagtcaaggaatttggttttggggattttttgtttttcaaccatgctcgggggtgtctggagcctattcttgcagcttttgcttctcagactaggtcaccgcgacctttttatagccttgcctgttactatccttaaagtaaataaatgcagtacttatgtttctttaaatttctgcctcaaaacaacactaattctcctgattgtctttcatgacagtttccagacctctcacttttctggctgtctttcctggatgctgagtaatgtcaaatgtggcactaaaattcagcacccagggctgaatgaagcttcaggtgtgccccgatcagcccagaggccagtggcatgctcagctcaattctgcttggcagcaaagccacttacagatgcactggcttttcaaacgactgaatgcattgttgactcttactcagcttgcagccaatatctttttttatgtgagctgtcatcaagccagggattcctcattctccattggtgcaactggctcttgaacctacatcaagaactttgtccgtgttcatttcacattgtaggtcttagtgcatttttgctgttctttgaggtgtttttgaatatagatcctgtcttcagtactaaccatctctccgggttttgcacaatctacccatttgaatggagacattcttaattttcatccaagaggataataaaataaatcagggtcaaggttaaaactcacaaccaggcgtggtggctcatgcctgtaaccccagcacttttgggagtccaaggcgggcagatcatttgaggtcgggagtttgaaaccaggctggccaacgtggtggaacccaccccccatctctactaaaaatacaaaaattagccgggtgtgctggcatgcaccggtagtcccagctactcatgagtctgaggcaggagaatggcttgaacccaggaggtggaggttacagtgagccgagatcgcgccactgcgctccagcctgggcgacagatcaagactctgtcacaaaaaaaaaaaaaaagaaaagaaaaggataaaactctgtcccaccacccaagcccacgtgacatgtggacaataattagcatattctggatgtgaagccaaatccctatggaacaaccaaactctattcgttttccagttttgccataacacgtaatcacaaactagatggcttaaaacaacagaaattcattctctcacagttctgccatcagaagtcctaagtcagcagggccatgctccttctgaggctctagggaagagtccttcctagcctccttctagcttttcagggttgttgtgtatccttgatattctgtgggccgtagctcatccttccatccctacctctatctccacataggggtccctcctcttacaagtcattgaatatagggcccaccctaatccattatgagtttatcttatttgattacatctgcaaagacccctatttccaaacaaggtcacatgcccagggactaagggttagaacttgaacataactttttggagagcacaattcaacccacaacacaagtaggatcagtttccgtctttctgtctccttgacctccaggctctgaagagcatctccatcagaaaacttgctgcagcctcgacctcctgagttcaagtgatcctcccacctcagcctcccaagtagctgggactacaggtccaggccaccatattcagctaatttttttattttttgtagagatggggtctctgttgcccagactggtcttgaactccttgtctcaagtgatcctcctcctttggctgggattacaggtgtgagccactgtgccctgcacttgctgacatccagatggccataggattccatgtacccctggcccccaacaccagtcaacctgatccactaacccagtctagagtggtggttgtcagcgggaactctgtgtggctgccctctccctttccaactctttgagattcagacaaaatctgccctgggggaggaggctggagactcctggttgtggaggatgcaggccatggagtgacttgctgaagagaatggcgtgagacagacctcagtgactttgggcttactcagcctcccttgcaactcattttcttcagctgtaaaatgtaaataataaaacctatccagctgggcgcggtggctcacgcctgtaatcccaacactttgggaggctgaggcaggcagatcacaaggccaggagttcaagaccagcctggccaacatagtgaaactctgtctctacaaaaatacaaaaattagctgggcgtagtggtgggaacctatagtctcagctacttgggaggctaaggcaggagaattgcttaaacccaggaggtggaggttgcagtgagctgagatccgtctaaagaaaaccaaaaagcaaaaaacctatcacctttatgaggattaaatgacatcacatttgtaaagtgcttagcccaggcagccgtgagtagcagtggtcgttgccaattgttgccgctgttagctgcttgggagtcagataaagctagatttgaatcagatcttttcttttgttttttttttgagggacggggtcttgctttgttacccaggctacagtgcagtggcaccatcatagcttattgtagtctcaaactcctgggctcaagtgatcctcctgcctcagcctctcaagtagctgggactacgggcgtgtgccactggcccaccaactatgaacccagattttctttttaaaaattgttttttaatttttttttttttgagacggagtttcgcttttgttgccaggctggagtgcaatggcacatctcggctcaccgcaacctccgcctcccgggttcaaacgattctcctgcttcagcctcctgagtagctgggattacaggcaggcgccaccacacccggctaattttgtatttttagtagagacggggtttctccatgttggtcaggctggtctcaaactcccaaccgcaggtaatctgccctcctcagcctcccaaagtgctgggattataggcgtgagccactgcgctcggcccagtttttaaattttttgtatattcttctcttttttccccataggttattggggtacaggtggtatttgctcacatgagtaagttcttttgtggtgatttgtgagatttgggtgcacccatcacccgagcaatatacactgaaccctatttgtagtcttttatccctccctccccccacactcttcccccaagtccccaaagtccattgtgtcattcttttttgctgttgttattttttgtttgttttttgtttttgtttttgagagagagtctcgctctgtcacccaggctggagtgcagtggtgcaatcttggcttattgtaacctctgcctcccaggttcaagcaattctcctgcctcagccttccatgtagctgggattacaggtgcatgccaccacacccagctaatttttgtatttttagttgagacggggtttcgccatattggccgggatggtctcgaactcctgacctcaggtgatccgcctgcctcggcttcccaaagtgctgggattacaggtgtgagccaccacacccagcctagatggcttttattatattgagatgtgtcccttctatgccgattttactgagagttttaatcataaagggatgctggattttgtcaaatgctttttctgcatctattgagatgatcgtgtgatttttgtttttaattctgtttatgtggtgtatcacatttattgacttacatatgttaaaccgtccctgcatccctggtatgaaacccacttgatcatggtggattatctttttgatatgttgttggattcggttggctaacattttgtgaaggattttagcatctatgttcatcagggatattggtctgtagttttctttttaggtcagttttctttttggttttcctggctttggtattagggtgatgctggttttagagaatgatttagggagcgttccgtctttctctatcttgtggaatagtttcagtaggattggtaccaattcttctttgaatgttggatagaattctgctgtgaatccatctggtcctggacttttttttgttggtaatttttaaattaccatttcaatcttgctgcttgctgttgttctgtttggggtatctaattcttcctgatttaagctaggaggattgtatttttccaggaatttacccatctcttcttggttttctagtttatgcatgcaaaggtgttcacagtagccttgaatcatctttggcatttctgtggtatcagttgtagtatctcctgttccgtttcttagtgagattatttggattttctctcctctctgtttttctttttcttttctttttctttcttcctttctttctttctttattattattatttttttgagatagaatctcactattgttgcccaggctggagtgcaatggcacgatctcagctcactgcaacctctgcttcctgggttcaagcgattctcccacctcagcttcccaagtagctgggattacaggcgcccaccaccacgctcagctaatttttgtattttgagtagagctggggtttggccatgttggccaggctggtctcaaactcctgacctcaggcgacccacctgcctcagcctcccaaagtgctgggattacaggcgtgagccgctgcgcccggccctcttcttttcttggttaatcttgctaatggtctatcaattttatttatcttttcaaagaaacagcttttggtttcatttatcttttgtaattttttgtttgtttgtttcaatttcatttagttctgctctgatcttggttatttcctttcttctgctgggtttgggtttggtttgttcttgtttctgtagttccttgaggtgtgaccttagattgcttgtgctctttcagacatttttttttttttagacagagtctggctctgtcgcccaggctggagtgcagtggcgcgatctcagctcactgcaagctccgcctcccgggttcacgccattctcctgcctcagcctcccgagtagctgggactacagatgcccgccaccgcgcctggctaattttttgtatttttagtagagatggggtttcaccgtgttagccgggatggtctcgatctcctgacctcgtgatccgcccccctcggccttccaaagtgctgggattacaggcgggagccactgcgcccggcctcagactttttgacgtaggtgtttagagccacgaactttcctcttagcactgcctttgctgtgtcccagaagttttgacaggttgtgtcactattgttgttcagtttgaagaattttttaatttccatcttgaattaatttttgacccaatgatcatccaggagcaggttatttaatttccatgtatttgcgtggttttgaaggttccttttggagttgatttccagttttattccactgtggccatgagagagtgcttgatagaatttcaattttcttatatttattgaggctcgttttgtggcctatcatatagtctatcttggagaaagttccatgtactgttgaatagaatgtgtattctgcggttgttgggtagaatgttctgcatatatgttaagtccgtttgtttcagggtatagttttaatccattgtttctttgttgactttctgtcttgatgacctgtctagtgctgtcagtggagtattgaagttccccactattactgtgttgctgtctatctcatttcttaggtctattagtcattgctttacaaatttgggagctccagtgttaggtgcatatatgtttaggattgtggtattttcctgttggacaaggcctttcaccattatatactgtccctctttgtcttttttaagtgctgttgctttaaagtttgttttgtctgatgaaagaatagctacccctgctcacttttggtgtccatttgcctgaaatgtctttttccagccctttaccttaagcttgtgcgggtccttatgtgttagacgagcatcctgaaggcagcagatagttggctggcgaattctgacccattgtgcaactctgtgtcttttaaatgcagcatttaggccattggcattcaatgttagtattgagatgtgaggtagcattccattcatcgtgctatttgttgtctatatggctcggttttttgtttttattttttaaattgtgtttttgtttcatacgtcctgtgagatttatgctttaaagaggttctgttttgatgtgtttccacgatttgtttcaaggtttagagctccttttagcagttcttgtagtgctggctgggtagtggcaaattctctcagcatttgtctggaaaagactgtatctttccttcatatatgaagcttagtttcactggatacaaaattcttggctgataattgttttgtttgaggaggctgaagataggacctgaatcccttctagcttgcagggtttctgctgagaaatctgctgttaatctgataggttttcctttataggttacctggtgcttttgcctcacagctcttaggattatttccttcgtcttgactttagataacctgatgactatgtgcctaggcgatgatctttttgcgatgaatttcccagatgttccttgagcttcttgtatttggatgtctaggtctctagcaaggccgggcacgttttcctcgattatttcctcaaatatgttttccaaactgttagatttctcttcttcctcgggaacaccaattattcttaggtttgggtgtttagcataatcccagaatccttggagcctttgttcatattttcttgttcttttttctttgtctctgttggattgggttaattcaaagaccttgtctttaagctctgaatttctttcttctgcttgtttgagtctattgctgagactttccagagcattttgcatttctattaggtgtgtccaatgtttcctgaagttttgattgtttttcatttatgctgcctatttcctggaatatttctcccttcacttcttgtatcatttttttccttacattggggttcgcctttctctggtgcctccctagttagcttaataactcacctcctgaattctttttcaggtaaaccagggatttttttcttggtttgggtccattgctggtgagctagtgtgattttttggaggtgttaaagaaccttgttttgagttggttttctggttccttctcattttggtagtctctgtcagagggaaggtctagggctcaaggctgctgttcagattcttttgtcccacggggtgttcccttgatgtagcactctcccccttttcctatggatgtggcttcctgaggacaagctatagcgattgttatctctcttctggatttagccacccagcacgtctaccaggctccaggctggtactggggttgtctgcactgagtcctgtgatgtgaactgtctgtgtgagtctctcagccatggataccagcacagtatttggggtgtctcatgggtcctgcaggagcgatctgcttccttcatggggtctgtgggtgctctcagctttcctgctttattcctgcagtcattccagagcaaaaattcactatgtgagtctccacagctgctctgtccatctgagtcacagctgcaatctagtcctgcctcccgtccgccatgatccctgtaactctctatttattattattaattattattactgagacagagtctcgctctgttgcccaggctggagtgcagtggcacagtctcagctcactgcaactccgcctcctggattcaagggattctcctgcctcagcttcccaagtagctgggattacaggtgtgtgccaccacgcctggctaatttttctactttttgtagagacaggacattgctttgttggccaggctggtctcgaactcctgacctcaggtgatctgcccacctcaacctcccaaagtgctgggattacaggcgtgagacatggcacccggcctgaacccagattttcaactgccccctgaagcaaatttctttttttttttttcactttgctcattttattttattcaatcctcacaacaacctaagaggtgtattataatcagcactagtttaaaaatatgaaaactgaggcttagagacattaaataatatgtttaaagtccttgagctaataggcagaggagctgtgattaaaaaccaggtttgatgacataatgtctacattcttaatctgtggtgttgaatttccaaacacatttaagtaattaagtcccataatgtttcacacaccacacaactctgagaggagtttctcacaacactcactgcagcccttcagtttcggcatctgtaaaacgagacacctgactaacccttaggctgctgtgagcgctcaggtcacccagcatggagcctggagtgagaaacctgttacagatgtttgcttcttcccttcccttctcctgtgaataaaaggggctgttcacctgacatggcctacccttaggaaactcaaggtgcctcttttttttttctgagacagagtcttgctctattgcccaggctggagtgcagtggcacgatcttggctcactacaacctctgcctcccggattcaagctattctcctgcctcagcctccccagtagccgggactacaggcacacgccaccacgtctggctaatttttgtatttttagtagagacagggtttcaccatattggccaggttggtctcgaactcctgacctcatgatccgcctgccttggcctcccaaagtgctgggattacaggcatgaaccatgatgtccagccatgaccactctcttttctatgtccctggggagagacctcgaattttatttggagcctgtctttataaagactctaaattgtggccaggcacagtggctcatgcctgtaatctgagcactttaggaagccgaggcgggtggaggtcaggagttagagaccagcctggccaacacggtgaagccccatctctactaaaaatacaaaaaattagctgcgtatggtgccgcacacctgtaatccccagctacttgggaggctgaggcaggagaatcgcttgaatctgggaggtggaggttgcagtgagccaagatgacaccactgcactccagcctgggcaacagagtaagactccatctcaaaaaaaaaaaaaaaagactctaaatagtgtttatatatggtgtatatatatatatatatctttgatgtatatctttgtccatcaggtcagcttgttctttcgaaaccctctccagtcactagttttgttgtcgttgttgttgtctgagacggagtttcgcgctcgtcacccaggctggactgcaatggcatgatcttggctcactgccacctccgcctcccaggttctagcaattcttctgcctcagcctcccaagtagctgggattacaggtgcgggccaccacacccagctaattttttgtattttgagtagagacggcgtttcactggttcagtgtttgtacgtgagtgcgttcccacaaatggcagtgtgtgctgtgcgtggtttggtaaccttcattgttttactccacagcttgttttgagagtcccctccattgaaacacgcacatctaatttgtccttcagttcgctggactccacgctgaacgtgccatgctccattgccccgtgagtaactccatgctcttgccggtttcacacggcctctcagagctggagcctttgttcaggagccctgggcagctttcaggaagctcttgggctcatcagcttcctctggctgaagccgccccagtggaatcatggggatttcttactttgaaggtggggccacccgcagactgtaaccggctggttcaagatcaaggacttccccaggccacctgcctcagaggcaagaaaggctcagctgagtcccagacactcctcgctgtggcccctccttcctccctgctgggcaggcccccctcaattctgtttgccagcagggcctagtaacactgaaagacgaaaagggaaataaaataaacacaattaataggctaaaggttactgaataaagtggcagcagtaaataaattgactactgtgcaaatacaaagacatgaagacatgaaacccctgctctaaatgaccactcaccaagagcaaggcctgggctggaggcagggagcacctccctaaggagcactccctctttcccggagtgagtcctccttctagatggaattcagtccgggttcctcttgagccacagtccctgttggggcctatctcagtggactcaagatcctgaacttcttccagattgctgactacacatttgagtcacccagagattaaaagaaaaaacaaataatttcccagtgatcaggagtaaatcagctggggcagggttggtgctatgaatgaccacactgatttgtacacttcactgatttgtagtgtttgctatttccgtcgtgtaaatactgccaacatggacaatcttcagttgctaatggtttactaactggcttgtaaatgaattcattcagtattcaagaaaatggcactacatttagaaacattttgtagcatttcttactttctaagaatttccaatagacaccatgatcactaaaaaatcataaccaggctgggggcagtggctcacgcctataattccaataatttgggagaccaaggagggaagatcacttgaggccaggagtttgagaccagcctgggcaacatagcaaagactccatctctacaaaaaaaaaaaaaaaaaaaaaaaaaaaaagttaggcagctggtggcaggcacctgtggtcccagctattcaggaggctgaagcaggaggatcacttgagcccaggaggttgaagttacactgagccgtgatcacaccactgcattccaaataaaaactaaattaaaatatatatatatatatatatatatattttttttttttttttttttttttttttttttctgagacagagtctagctctgtgtccagactggagtgcagtggcatgatctcggcaacctccacctcccaggttcaagtgattctcctgcctcagcctccggagtagctgggattacaggcgtctgccaccacgcccaggtaatttttgtatttttggtagagatggggtttcaccatgttggtcaggatggtctcgatctcctgacctcgtgatccacccaccttggcctcccaaagtgctgggaatacaggcgtgagccactgcgtctggcctaaaataaacttctaaaaaagaaaaattggccaggcacagtggcttatgcctgtagtcccagcactttgggaggtcgaggcagttggatcacctgaggtcaggagttcaagaccagcctgaccaacatggtgaaaccccgtctctactaaaaatacaaaaattagccaggcatggtagtgggcacctgtaatcccagctactcaggaggctcaggcaggagaattggttgcacctgggaggtggaggctgcagtgagccaagatcataccattgcagtccagcctgggcgacagagcaagacttcgtctcaaaaaaaaaaaaaaaaagggaaagaaaaattataaccaatcgacattcaataaattatttattggctgggcgcagtggctcatgcctgtaatcccagcactttgggaagccgaggtgggcagatcacatgaggtcaggagttcgagagcatcctggctaacatgatgaaaccctgtctctactaaaaatacaaaaattaggtgggcatggtagtgcgagcctgtagtcccagctacttgggacgctgaggctggagaatcatttgaacccgggaggcagaggttgaatgagccaagaatggcatcactgctctccagccgggacaacagagcaagattctgcctcaaggaaaaaaaaattcaataagttatttatttgtcaaataatttataaagcagctttctcaaagccctttcaaaaagtttacagcagccaagagtggtgactcatgtctgtaatcccagcactttgggaggccaaagtgggcagatcacctgaggtcatgggttcgagaccagcctgaccaacatggtgaaaccacgtttctactaaaaataccagaattagccaggcatgttggcatcagcctgtagttccagttacttgggaggctgaggcaggagaatcacttggacccaggaggcggaggctgcagtgagccaagatcatgccattgcactccagcctgggcaatggagcgagactctgtctcaaaaaaaaaaaaaattacagcaaaaaatacttgatgtgggccacaggtgtgttttaatatgcttgatctgatgtgcgagaggccctgagagggagtgtttccaggacctacagagggaatgagagaggagagtccctgctgtcgggaggtgggtgagaaaagctcctaccactgcagaaatcctcctgtaaggctcctcggcggctcaccaggcgattcctcagcgaagaaaggtgaggcagcttgcccagggtcacccggccagtctcaattgaggactgacaaccaaaatgagtgactgaggcaagtcttaatcactgaggtttattaagccacgttagggcgcttctgggaaaaacaagccacagacacatctgtggctgtttttcccaagaagttccaagttttgtatttgtacatttcttcctttttttttttctttttgatacggagtttcactcttgttgcccaggctggagtgcagtggcgcgatctcagctcactgcaacctccacctcccgggttcaagcgattctcctgcctcagcctcccgagtagctgggattacaggcatgagccaccacacccgactgatttttgtattcttagtagagacggggtttctccatttggtcaggctggtctcaaactcctgacctcaagtgatccacccacctcagcctcccaaagtgctgggatgacacctaggaagaggggcaggcgggcagtcaggcttaggcgaacactacattttatataagataaggtgaacatctgaaggtggaaatgagcgccactgcactcagcctggacaacagagcaagaccctgtctcaaagaaaaagagaagtgtgagtggtcctgatttttaaaattttcctttacaggactttggacactagaactaggcctctttccaaaacatgctgatactgaaggggtcacgctgaaggctgagggctagggcctttaaaggtggggcaccctcttccttctacccgtccttgaccctcagcagactacaggttgatctcccctttgccatgagtgcccaaggagggaacttgtgatctagcagtttcttgataatccccaaaaggctttaattactccatttccctgccacgcccagggcaggaggagggtgagcgggaaagctgtccaccttctgctaaacgggtcaggaggcatcgggagccacgtgggttgtggtttaggagcctgagctgctgatccccaggcaggcctacacaatgggagctgctccctgcagcccccgggccggcctgggttgcataacccatgaggtcagcccggcctgcggcagttgctttcccacaacggaggggccgctccccacctcctgcgggacccacagccctgggtctctttccagctttcctctttcactggcaaagctgcaggccccataaactggggaagggttgaggccctgcctctcctgaactgggcaagggtcgaggacttccccatgggtccaggcctccagcattacatcaggaggtagcctggggaggacagagcactgaatccctctggcatcagctcctctggccagccctgcacctgctctgtggggctagggcctggggaggtgtcccaaaatagcccgcaggggcccgggagctctggccttcaaggtcagacactagcactgagaatcctggtgaggctgtcttcccagaccccgcctggcaggccggctgggcacggctgcggagaaagacagggcaggctccccaggcactggcccccgcggcaacctctcctgtctctaaaatcggatgtagattaagaacgctccatctggcaagaccaaatggaattcggcagaagcataaccaggacactgggttttggatctgtgactctccacacatgcagaggacaaaaatacaagagaaaggggtcaggagagaggcgtatgatggggggcgggggtgtgatgtgtgtgttgtgtgggtgttgtgtgtctttatgatatgtgtgtgtacacctgtgttgtgttgtgtgtgtattgtatgtgttctgtgtgtctgttgtggtgtgtgttgtgtgtgtgtgatgtgtctgttgtgtggtgtttgtattggtgttgtatggtgtgtggtgtgtgtgtgtctgtgtgtgatgtgtctgttgtgtagtgtgtatgtatggggtggtgtgtgatgtgtgtgtctgttgtgtggtgtgtgtatgatgtatgtccgttgtgtggtgtgtggtgtgtctgttgtgtagtgtgtgtatatggggtggtgtgtggggtgtgtgtggtgtacgtgtgtttgttgtgtggtgtgtctgttgcatgatatgtgtatggggtggttgtggtgtgtgtctgttgtttggtgtgtgtgtgtgtgtgtgtgtgtctggggggttgtgtgctatatgatgtggggaatggacattgactcagtgtgtggtgttgtctgttgtgtgttgtggtgtgtgtatctgttgcgtgttgtgtggtgtgtggtgcgtgtgtgtgtctggggggttgtgtgctatatgatgtggggaatggacattgactcagtgtgtggtgttgtctgttgtgtgttgtgtgtgtgtgtctggggggttgtgtgctatatgatgtggggacattgactcagtgtgtggtgttgtctgttgtgtgttgtgtgtgtatctgttgtgtgttgtgtggtgtgtggtgtgtgtgtgtgtctggggggttgtgtgctatatgatgtggggaatggacgttgactctgtgcgtgtggtgtgtgtgcctgttgtgtgttgtgtggtgtggtgtgtgtgtgtgtctggggggttgtgtgctatatgatgtggggaatggacagtgactcagtgtgtgtggtgtgtgtctgttgtgtgatgtgtgttgtgtggtgcgtgtgtgtgtctggggggttgtgtactatatggtgtggggaatggacattgactctgtgtggctggaaagtgatctttcaagagaggattaaccaaaggaaatgggaaattgaggtcaggatggataaggaaaacatggggcaaactgggtggtcagagaaagacgaggatggcctctaggctccaagagcaccccagataaaaggctggaataggggcaggagagaagccccccgtacagagggttattccagggcctgagggcatcccctccaccccagaggagtgaaggtgggaggaagtgttttctgcttaagcattgggaataaacgtggctgccaacaacagaaaacttgactggcaggtgtaaagaaatagtggtttctttgtctcccagaataaaaaatctggaagtgggcagggctggcatctgtggggttcacttggcctttccccatggaaataagactgcagcagtttccgtatcaggagtcttttcaaagcaggaagaaggcggtctgtcctaggcaccctccttccacacaggtcccttggccagaacaggtcacgtggtttctcccagttgcaaggtaggccggggaagcacagggcagttgccatgatccgtggctcaccctggctgaccactctgttatgccccaaacaaaagcagtttcattagtaaggaagaaggggacatgaatatcgggaagccagtcatgccacacgagaccctggggagcaaacatttttccttttgttgttgttgtagagctgaggtctcacaatgtcacccaggctggtctcaaactcctggcctcaagcgatccccctgactctcaaaatgctgagattacatgcatgagccaccacacctggctgataaacattttcaataaaggctaaattcaggtaatataatctcctgccctgcccactgcacagacaaatcaatctcgaaagctcagaggtatttcaagaatagtttggtggctggatgcggtggttcacgcctgtaatcccagcactttgggaggccgaggcgggtggatcacctgaggtcaggagtttgagaccagcctgaccaacgtgatgaaaccccgtctctactaaaaatacaaaattagctggaggtggtagcggtggtgggcgcctgtaatcccagctactcaggagggtgacacaggagaatcgcttgaacccgggaggcggaggttgcaatgagccgagatcgtgcactccagcctcggtgacagagtgagactcagtctcaaaaaaaaaaaaaaaaaaagaatagtgaatagtttggtggacaggggctataggaaacggggaatgttggttggttgggaatgaaaccatacgggtgtggaacccggtcctctgtgtgtgtgtgtgtagactgcctctgtgtgggggccacaggaccaactgagtcatgagtctcaggttgagtggagtcagccagtcagaaatgcgaaaagtctgaaaagacatctcaaaacaccagtcttaggttttacaatggtgatgttagctacaggaacaattggggaaattgaaaatctcatgacctccagaacaatggctggttaccctttatgcctacatctcagcagaatccaggctcttctcataatcctgatcttgtgtgctttcattcattttataagggtggtttagtttggggaagggctattatcatccttgttttaaggttaaacaataaacaaaattcctctcaaagttaccttggcctaaacccggcaggaatgacccaggttggagactggaggtaagacagccaactatgtcaaatttctcttactgtcataattttattttattttatttatttattcatttatttattttgagacagagttttgctcttgttgcccaggctggagtgcaatggtgcaatctcagctcaccgcaacctctgcctctcgggttcaagtgattctcctgcctcagcctcccaagcagctgggattacaggcccgcgccaccacacctggctaattttgtatttttagtagagatggggtttctccatgttggtctccaggctggtctccaactcccgacctcaggtgatttgcccaccttggcctcccaaaatgctgggattacaggcatgagccactgcgcctggcctttatttatttatttatttatttatttttaattgaaagagacagggtctcactatgttacccaggctggtctcaaacacctgggcttaatcaatcctcctgcctcagcctctcaaagtgctgggattacaggcatgagccaccattcagccattggtttcaataatattccaaagttgatctgaaagagcctccagaaagctgtgaggccccacattgggaatgcgacccaaaaccccaaggtcggggtcctgacccatttgtgcgatcatctcagtcaacattaattgtcttggtcttcttagcaacctcacgatgacagaaatgctattatttcccttgctacagatgaaaaaggaggggctcagacaagttcagaaactaggtcaatggccgggcgtggtggctcacgtctgtaatcccagcactttgggaggccaaggcgggcagatcacctgaggtcaggagatcgagaccagcctggccaacatggtgaaaccccatctctactaaaaagacaaaaactagccaggcatggtggcctacgcctgtaaccccagctactctggaggctgaggcaggaggatcacttgaacccaggaggcagtggttgcagtgagctgaggtcacaccactgcactccagcctgggcaacagagggagactccatctcaaaaaaaaaaaaaaaagaaaaagaaaaaagaaactaggccaaggtcacaccggctgtgagtggcagagcaaggggtgctgtccgcagaatcctctcttttcaccacgtcaccctttgcaggaggagcacatatgggtcaagatgttacgggctcaaccagcgtggtggctcacacctggaatcccagcactttgggaggctgaggcaggtggatcacctgaggtcaggagttcaagaccagcgtggccaacatggtgaaaccctgtctctacaaaaaatacaaaaattagccgggcaataataataataataataataatgaagtgatgggctctaatccagaccctcctcgggttttcagtcctaaactctttggctactccttacaggaagttgtccagttacacatctctgatccttccccaggatcaaaacccaggaaggaggccttgaagccagacagaaccatgttcaaattcccactctactacttggcagtgtgtggccttgggcaagttacttggctctgagcctcctaagcaggggtaacccctttgagaggttgtaggattcaatgggagaccatggattagcgccaagaaatagcaggtgctccataaatatccgtgcctttctggggatacagccaagtggaaactcagccatggacgatacctgggctcctgggagccaacatcactttatttcccacattctgctaacaaaatccaattcgttataatcaggggtcatctgttttgctttcctttgccaataaaaaattgacttggcatgaagtcttcagtagttacttcagctaacatttgttgaacaccgtccaggagccaggcaccctgctgctcagaggctggccctggccctctgggagttcagagtctcactgcagaatggcacctgcaggcaaagaactctaaaacaaggcagggtagtgagagatgtgagccatacgttcaaaatgctgggacttcagagacagcagaggccacctgggtgtggcatgggcttggcatgcagtcctctggggctactgcggaaggggtgtcaccaggaccagctacagaacttatggggcccctttttcaaaaagttattaagaatcttggtaataggccaggcgcggcggctcacgcctgtaatcccagcactttgggaggccgaggccggctgatcacctgaggtcacgagttcgagaccagcctgaccaacatggagaaaccccgtctctactaaaaatacaaaattagctgggcgtggtggtgcatgcctgtaatcccagctacttgggaggctgaggcaggagaatcgcttgaacccgggaggcgcaggttgccatgagccgagattgcgccactgcactccagcctgggcaacgagagcgaaactccttatcaaaaaaataataataataataatttcagtgatagtagggcattaagccaaatgtagggccctctgagcatggcgccctgtaccaccacacaggccactgacccatgcagctggccctgggtgccgctattccatgaccccaggaggtcaggtgctgtccctctgggagaggcaggctcagggcagaccctgtgggagttgggccctcaggcctcatccaagctgctgaccatgcgtcacggctccctatttctgtgtgaggagaattgttcctgtctggtgactgtcatcaggagggtgactgtggatttccacaagccaggatggacggcaacttccccagcatgagaaagagccacccaggattggcttggggctgttgacagtggcctgtccctcgctatgtcatctgcctcaccacaaaccaccagcagaaggttcagaggccagggaaagagaggggagccactgggccaggcctgatggtgcacacctgtcatcccagcactttaggaggctgaggcaggaggacggcttggacccaggagttggagactagcctgggcaatgcaatgagaacctgtctctccaaaaaaaaaaaaaaaaaaaattaaaaacttagccagacatagtggtgcatgcctggagtcccagttactccgaaggctgaagtgggaggatcgtttgggcctgagagtttgaggctgcagtgagctctgatcacaccaccgcactccagcctgggcaacagagcaagaccctgtcgcaaaataaataaataattttttttttttttgagacagggtctcacgctgtcaccaaggctggagtgcggtggcgcgatctcggctcactccaacctctccctcctgggttcaagcgattctcctgcctcagcctcctgagtagctgggattacaggcgcccgccaccacactcgctcatttttttgtatttttagtagagatggggttttgccttgttggtcaggctaatctcaaactcctgacctcaaatgatccacccgcctcggcctcccaaagtgctgggattaaaggtgtgagccaccactcctggccataaaaatttttaaatgacattttttggctactgttaaaacaacaacaaaaacaggaactaagaagtatcggggaggatgcggagaaactgcgcccggtgcatcgctggtgcagaatcaaatggcgcagccgctgtggaaaccagtgtggtgggaggctcctcaaaacattaaacagacaattaccaaacaatctcgcaatcccgcttccgggtatatgccccaaacaactgaaagcagagtctcagagcagtatttgcacgcccacactcacacagcattaccacaagagcaaaaagatggaagcaactcaagcttcacggacggacaaacggatgaaccaaatgggttatatgcacaaaatggaatattatgcagccttaaaaaggaaggatattctgacacatgctgcaacgtggataagccttgagaacattatgctaagcgaaataagccagctacaaaaaagacaaatattgtatgattccacttatacgagtaatcaaattcccacaaacagaaagaaaaaagtggttgtcagggctgggaggagagggaaacaaggagttattgttcaatgggtgtaacatggcagtttttttgtttttggggggtggttttgagacagagcctccctctgtcacccaggccggagagcagtggtgcgatctcagctcgctgaaacctctgcctcacaggttggagcggttctcctgcctcagcctcccgagtagctggaattacaggcacgcaccaccacgcctggctaatttttgtatttttactagagatgggggagttccaccatgttggccaggctggtctcgaactcccaacctcaggtgatccgcccgcctcagcctcacaaagtgctgggattacaggcgtgagccaccgcacctggcccacattgcagttttgcaagagcgagacttctggagatggatggggtgatggttacacaacaatgtgaatgagcttaatgctactgatctgtacacttagaaatgactaagatagtacattttatgttatgtgtattttaccgcagttaaaaatgttgtaagtttaatgacttttgttttctgtatataaaaaaatatttattaaaaatcgtgagcccaggcacagtgactcatgcctgtaaactcagcactttaggaggccaaggggggaggatcacctgaggccaggagtttgagaccagcctaggcaacatagcaagaccctgcctctacaaaaaataaaacataaaaattagctgggcatggtagtgcacgcctgtagtcccagctactagggaagctgaagtggaaggaccgcctgagcccaggaggtcaaggacgcagtgagctgtaattgcaccactgcactccagcctgggaaaataaataaatataaataaatggcccaggcgcagtagctaatgcctgtaatcccaacactgggaggccaaggcaggcagattccttgaggccaggagttcgagaccagcctggccaacatggtaaaaccctgtctctactaaaaatacaaaaattagacaagcatggtggcacatgcctgtaatcccagctactcaggaggatgaggcacgagaattgcgtgagccggggaggcagaggttgcagtgagctgagatcctgccactgcactccagcctgggcaacagtgggaacctgtctcaaaaaaaaaaaaaataaatataataattaataaataaaaatcttgaatgtataggaaaaccgaaagagggctgggtgtgatggctcacacctgtaatcccagcactttgggaggctgaggcgggcggatcacctgaggtcgggagttcgagaccagcctgattgacatgagaaaccctgtctctactaaaaatacaaaattagccagctgtaatcccagctactcgggaggctgaggcaggagaatcgcttgaacttgggaggtggaggttgcggtgagctgagatcgcgccactgcactccagcctgggcaagaagagcgaaactccatctcaaaagaaaagaaaagaaaagaaaaatccaaagaggcaaagatgtaatatctctcttatattatacataaatactcataaagaaataaaagtacctgtaactctactacccagagacaactgctgctaaagacatgatctacttcctcctgtatttggaacacacacaggtgtgtacctctctccagccatctataattcagatcagttcaacagctatagttatgtatactctatttcctcctgtatttggaacacacacaggtgtgtacctctctccagccatctataatttagatcagttcaacagctatagttatgtatactctatttcctcctgtatttggaacacacacaggtgtgtacctatctccagccatctataattcagatcagttcaatagctatagttatgtatactctatttcctcctgtatttggaacacacacaggtgtgtacctatctccagccatctataattcagatcagttcaataactacagttatgtacactactttctcacttcatgtattataagtatttctaaaatctcctgtaatatgatttttagtggcttcctggtatttgatcatatggacataatgttcaactaatcttctatttctgaacatttaggtcgtttaaagtttttccgtgttttaaacaatactgtgatgtacatccttatgtatatactgttatccatatttctcgaactcctgacctcaggtgattcgcccgccttggcctccaaaagcgctggggttacaggtgtgagccaccacaccccgccctgttatccatatttctgatcatttccttagggtgatttcccacaagacatttcaccgagtcaaagactgagtgtcttgaggccaggggcacgtacggatcgggccctcctgatgacagggccgcgtctggcccagtgctctgtgctctgtgctctgtcccctccaggcttctaaggccccagactttctctcctttgactttggctagattcgactcccgtaagtgctggcgaacgaaaagttctggaatgtaagcaaaatggggcccccgtgtccatatgggctaactctgtaggctcaaatgaaatcttttttttttttttttttttgagacagagtttcgcccttgtcactcaggatggagtacaatggcgtgatctcggctcactgcaacctccacctcctgtgttcaagcaattctcctgcctcagcctcccaagtaactgggattacaggcatgcaccaccacatccagctaatttttgtatttttagtagcgatggggtttcaccatgttggccaggctggtctcaaactcctgacctcaagtgatccacctgccttggcctcccaaagggctgggattacaggcttgagccacctcgcccggccctcaaatgacatcttaaggccgggtatagcagcttacacctataatcccagaactctggggggctgaggcaggtggatcacttgagcccaggagttcaagaccagcctaggcaacatggtgaaatcttgtctctacaaaaaatacaaaaattcactgggcatggtggcatgcgcctgtagtaccacctacttgggaggctgaggtgggaggatcacctgagcccgtgaggttgaggctgcagtgagctgtgattgcaccactgcactctagcctaggtgacagagagagactctgttgaaaggaagagagagagagagagaggcagagagagagaaagaaagaacaaaaagaaaagaaagagagagaaagaaaatttacaaaaaaactcaatttctgttgcaggaagaggcttagagattgcctcctcccactctttcattttatgaagcagaaaaatgagggccacacatggcatcagctattcccgtttcttgatggacagactgagctggaactggcttggtccatcaccccagggagtaatggctggcttaacagcccacagcaaattctgtggttcactggaccaagcagcaggttccaggacagctgtggggtcagttggggccatctttggactcagcctgagtgtcagctgtctcatgcccacatcctggcactcacaggagccagtaaaactctctccagggcagtggctgcgaccctgtctcctaaactcagaaaaccaggtcctaactttggggacttgcggggaagggtgggagggggtcgggggataaaagactacaaatagagtgcagcgtatagtgcttgggtgatggttgcacccaaatctcacaaatcaccacgaaagaacttactcatgtgaccaaatagcacccgtaccccaataacctatgggaacattcaaaagaaaaagaaaaccgtgtcctagtctcctcagccagtggggcggtgtgtggtgggtggtctgcacttggtcccagagaggtcaatgagacccagacttgcctgtgaaagaaacggagtggtggcggggcccgggaaaaacccctgcgttcactcgttcactcggcgcctgctgtgtggcaggcagcccccctgctgggctcgctcagtcctcggtaccatcctgggagcaggcattagcccccttttgcagatgagcctccgaaaaggtgaagaacttgaccaagggtcaaactgagcaaatggcagagtcaggcccctaccccggctgaccacccaatgcccagtggctgcagcgttcccgttacacagcacgatagctctgcaacacacataagcatgcattaaaccagagatgcgccatcactcccacttctggaagctgatctcatagcacagcaagagacgagcaagaaggatgttctaacaagtgtgttgaggggtcacagggtgggcctttctcactccaaggctctgggactcttggagctctggtaggagcaggggagaccaaccctacctcggatgcaggggcagcatccgatgaccctgataatgaccacaagaaagaggcagcacctctagggcaggaaagtgctgggggtcagaggcatgggtgccattccaggctgagccaggctggctgtgtgagcctgcgtgagtcacttaacctctgaacctagtgcttcacgtgcaaaagagggaagcttccctcatcctcctccagccgtcacccgctgccttccttctctctgcagcaaaatggctccgaagcgttgtctacacttcttttctctgattctttatttaaatttgcacttattaggctgagcgcagtggctcatgcctgtaatcccagcactttgggaggccgaagcgagcagatcacttgaggttaggagttcaagaccagcctggccaacatggtgaaaccctgtctctactaaaacacaaaaattcgctgggcatggtggcaggcacctgtaatcgcagctactcaggaggctgaggcaggagaatcacttgaacccgggaggcagaggttgcagtgagccgagatcgtgccactgcactccagcctgggccacagagcaagactctgtctcaaaaataataaataaataaataaataaataaatcttcacttataaattactccctaaataaaaataacacgttatatacatatatatacccatctcagcctcccaaagtgctgagattacaggtgtgagccatcgtgctttgccataacgtggtttttttaatgttttattttaaaaatgtttttataacttttatctatttatttattttttgagatgaagtcccgctctgttgcccaggctggagtgcagtggcaccatctcagctcactgcaagctctacctcctgggttcaagcgattctccggcctcagcctcccaagtagctgggattgcaggcatgtgccaccgcacctggttaatttttctatttttagtagagacaaatttttgccatgttggccaggctggtctcaaatccctgacctcaggtgatccgcccgcctcggcctcccaaagtgctgggtttacaggcgtgagccaccgcgcctggacaaaatttttttataccttttaaattccagacccaccaccaggttgaatcctccgggctgactgtgcagaccccccactatgccccctactttccattaactggtatgttttatgttatcaagaatattaaaacaaacctatgcatctgccattgagcttaagaaatagatggccggacgcggtggctcacgcctgtaatcccagcactttgggaggccgaggcgggcggatcatgaggtcaggagatcgagaccatcctggctaacacggtgaaaccacgtctctactaaaaatacaaaaattagccgggcgtggtggcaggcgcctgtagtcccagctacccgggaggctgaggcagaagaatggcgtgaacccgggaggcggtgcttgcagtgagctgagatcgcaccactgcactccagcctgggcgacagagtgagaccctgtcttggggaaaaaaaaaaaaagaactagacgaatgcccaggcatgggaagccccagtcacctttccctccctcaacccgagaggagtcacattccaaacctagcctttatcattcccttccttttcattagacggttatgtatgtacgtatccttaaactttatgctaatggtatcacattttgtgtattctactacttttaaacatttatggattaaattctgtccctccaaaaaagatatgttggagtcttaacccctaatactttaagccgtgaccccgtttgcagacaccgtctttacagaggtgctcaaggtgagaggcactcattagagtggaccctcattcgatacgactggtgtccttataacaagcagaacacaggacagaggcagagccaccagcagggagaacaccacatgaagcctggagtcaggcttccggacgaagccgggagagaggcggggaacaggtcctcctcccacgccttcccagggaacgtggccctgtcggcaccctgatctcctcgcccctagaactgggagacaacacgtttctgctgtccagccacccagtgtgcggtactttgttacagcagccccaaaaaataaagacaccattccatgtcatgttcttgaaattcatttgttaatgagtgaagccgaggctcattcattttctctgtcatgttctattatatgatatcccacaatttatccattttactttgaaaagttatatggtttgcttacaggttttattgttgttttgaaattgcaaactgtgctgccccgaacctccctgcaaactgtgccgtaggagtggagctgcacttgggtcaaagagggcaaaggtaagtcttaactgtgcagcccagatcagagcaataacaactcatcaagataagtctaattgctactcaacggggtggaacttacacgcttgccagtgggcaggcagagttccctgtgtcctacattcttgttaacacttgaaactccagtcttttttttttttttttttttttttttgagagatggagtctcaccctgttgcccaggctggagtgcagtggtgtgatcttggctcactgaaacctctgcctcccgggttcaagcgattctcctgcctcagcctcccaagcagctgggactacgggctcccgccaccacgcccagctaatttttgtgtttttagtagagacgaggtttaaccatgttggccaggatggtctcaatctcttgacctcatgatccgcccacctcggcctcccgaagtgctgggattacaggcgcaagccactgcaccccgccctgcagttttgttttgtttttttaatttattattttaaaaaaatgtttttgagacaggatctcactctgccacccaggctggatcatggtggcatgatcttggctcactgcagcctcgtcctcccaggctcaagtgatcctcccgcctcagcctcccaagtagctgggaccacaggtatgtgccaccatgcctgactaatttttgtgctttttgtagagatgagttctcactgtgttgcccagggtggtctcaaactcctgggctcaagcgatcttcctgcctcagcctcccaaattgctgggattacaggcatgagccaacacacccagcccgaaggaactgccattctttttatctttgccaatctgatggttatagaatggtatttcctagtggctttattttgcgttttctttatttctaataaagttaagcatcttttacatgttgatggacaatgtatatttcctgttttgcaaaacacctggtcgggttttcctggtcttttttcttatttatttctaggagttctttatgtactctggactctgatcctgcattggtctttctaaagctttattcgtcgcatcctctgatgaacagagcttttcttttttcttttcccttttaaaattagtagaatttattcatctttttcttaacaattagtgctttcaagaaattctttgtacccccaaggtcaagagatattatcctatactcgctttgtaagggttggtattctgcctgtcaggtcgttaatggacctggcattgattttggagcctgctgtgtagtcagatctaaactgggaaaggaacaattgcctgcttttctcacaggggcgttctgaagctcaaaggagaaaatgcgtgtgaaagtgtccagaactgtgaaacaatgtacaagtaagagagtctgcgatgctgatttgctggagggtgacaaagccgtttaagagaaggctgctttggcctttgatttgctaatcagttggtagcgtcataggctgccagtaggccaggcagaaacccaacctccattctgcctccggaggctggagaacacagccaaaaagaccagctgaagcatgtggtctttgcaggaaagtaagttccagtggcactgctggggctggccccgtccacccacactgttcactccatctgccacctgacattagcaaattaggctgcaaatacagccctgagtcatagagaaaagatgaaattacactcaggaaactctgctcactgaagtgcatgagtaacaggatgcagaaagacacccattaaaagcggctaaaaacgagtcaggtgctccaaggcagcctgctgcacaccccaacacgcgggcaggctccgccccagctccaactccacctggaggggcaacacgcacccattatacgagccacacgggggccccagcaactggcccagacaaggctgcagagcccactcagggtggaaccccctttagcgaactggaaggttccatgacggggctgcggggaaggaagccgactcgtggggagttagctgagctgccggaggaaactgacaaaatcaaacgcaccctttggcctgcacaaggcgatattgttggttctccctgaagcacatcctggccaggagacagagcttaggccagcccccgggccaggtgcctgctacccagacctgtgatcctagccaaaagtctctgagttctggatgtccacactgggaagggagagcagcgagggaagggttaccaaaggggcctgaggagacattcgggggtgacagattgtcagcatctttttgtttggtttttcttttaagcgatgggggcggggggtgggggggggtctcactatgttgctgaggctggtctcgaactcctggcctcaagcaatcctcctgcctcagcccccgagtaactggaattcaagacgtcagccacggcccccagcttagcttcagcatcttgattgcagtggtggcttcacagatgtatacatatgtcagaacttatcaaattgtatattttcaatatctattttagacaattagatctcaataaggctgtttaaaaattacagaatggtgtgatggcgacttttactaaatatgcatgttgacagcaagaggaacgactagaaggaggtccccagatgttaacagtgcttagttctgggctgtgggattacagaggattttacttttcctctttgtgtttttctgtactttaaaaaatttctgaaatatatgtgttttactttttttttttttttaagatggaatcttgctctgtcgcccggagtggagtgcagtggcgcgatcttggctcattgcaacatctgcctcctgggttcaagcaattctcctgcctcagtctctcaagtagctgggattacaggcatgtgccaccacacctagctaatttttgtatttttaatagagacaaggtctcgccacgttagccaggctggtctcgaactcctcacctcaggtgatccatccacctcggcctcccaaagtgctgggattacaggcgtgggccaatgcgaccagccgtgttttacttgtataaatcaggaaaaaaaaaagtatctatttcaaaataaaagcaaactttaggtcgcaggggtcttctgaaggtcggcagccatgacctcacagaggcacactctgggcttagcacggtggagctgtgcccaggggaagcagcttgggctttacaaccaggtctgcagcaaactgcccaggccaaacctcagctctgccgcccatctcctcagcggccttcagctagttacttgagtgcttggtgccaattttaatccccaattatatttcggagacaatcgtcaaagcctctgcaggtggctgagagattcaatgagccaatacaggtggctcttagcagtgttctcacagcacagcacagactgggtgaattacagctactattccctcctattaaaaagaatagaagtggccggacacaatggctcatgcctgcaatcccagcactttgggaggccgaggcgggtggatcacctgaggtcaggagttcgagaccagcctggccaatatggtgaaaccccatctctactaaaaatacaaaaattagccgggcgtggtggtgggtgcctgtagtcccagctactctgaaggctgacatgggagaattgcttgaacccaggaggcagtggtttcagtgagccgagatcgcgccatcgcactccagcctggatgacacggcaaggctctgtcccaaaaaaaaaaaaaaaagaatagaattgacttgagaaactctttgcttctttttcccccatgaggttagaaaagataattgaatcatctctagaacaggacgccagtttctggaactgaagggttttgaggtttctcttaacgaatatcagaaatctttatctctcaaccaactgtaaccaccatctgtggcctcctccagccctcaccaatacgggtacccctcccaggcttcctctccctccctgagcctctgctgtgaattatctgagtccacttcttctgaggctgcttttatgggacagagacaagaccctactctttccttctcttacttgttccttttctgttgtctgccagaagtaaccacccgttgcccaaaccaatctttagcttggcctcctttcaggggtctggatgccatctttaactgccttagtctggtggcctgagcagcttacctgagcctcagcttcttttttctttttctttccttttttttttttttttttgtttgtttgtttatttgtttcttgttttttctgacaggatttcacgccatcgggcaggctggagtgcagtggtgcaatcacagctcactgtagcctcaacttccagagctcaggtgagcctcccacctcagcctcctgagtagctgggactccaggcacgcactcaatgcctggctaatttttgtgtttttggtagagatggggtttctccatgttgtccagcctggcctcaaactcctgggctcaagtgatccgcccaccttgacttctcaacatgctaagattacaggtgggatcctaccaggtggggcaggagtaatcaaccctactagacagatggggaaaatgagaggccgggcgcagtggctcacatctgtaatcccagcactttgggaggccaaggcaggcagatcacttgaggccaagagttcgagaccagcctggccaacatggcaaaaccccatctctactaaaatacaaaaattagctgggcatggtcgtgggcacctgtaatcccagctactcgggaggccgaggcaggagaattgcttgagcccgggaggcagaggttgcagtgagccgagatcgcaccactacacactctagtctggatgacagagcgagacttagcctcaaaacaaacaaacaaacaagtgcacctttgttagttttatttgaaccaatgtttacatctctggcaaccacaggctcatatgaaacttcatgctattaaactttatgggtgacatggccaggcacggtggctcacgcctgtaaccccagcactttgggaggccgaggcaggtggatcacgaggtcaggagatcgagaccatcctggctaatacggtgaaaccccgtctctactaaaaatacaaaaattagctgggcgtggtagcacatgcctgtagtcccagctacttgggaggctgaggcaggagaatggcgtgaacccaggaggcggaggttgcagtgagccgagatcatgccactgcactccagcctaggcgacagggcgagactctgtctcaaaaaaaaaaaaaaaatttatgggtgacaatagaacaaaggcagagggacaggacagaacaatgagtcactccaacacaccctgtgtgttctaaaagaggccccgggacaaacacctgcctcagtaggaaggtccagcattcgtggcggtgtgtgctgggcggttgtggtgaggactgtgtctgtgtctgggcgggtgtgtgtagttgtggagtttatagctttcctttgactcaaatccttcttccctatcaccggcttacatgttagaggcctgtaacaggagaccagttccaggccaacctgtggttaaaagaacctcagcctgtgagcaaatgttactcctcctccgcactcgaggaccctgtggcagcccagcctgtcaggcctctgcagacatgagttggcctggttctccctgctgccatccctcacccgccaatccccaatcagtcttcactgtataaacaagtgcttcactgaacagcccagcgcatctgcgaaagatccaacacgcagcccttctcgttcctttgagtggatccatttgaaaagctcctgtctcctggctgggtgtggtggctcacgcctgtaatcccagcactttgggaggccgaggcgggtggatcacgaggtcaggagtttgagaccagcctggccaacatggcgaaaccccgtctctactaaaaatacaaaaattagccaggcgtggtggcgggtgcctgtaatcccagctactcaggagactgaggcaaaagaatggcttgaacccgggaggcggaggttgcagtgagccgagattgagccactgcactccagcctgggcgacagagcaagacaccatcaaaaacaaaacaaaacaaaacaaaacaaaacaaaaatctcctgtctctaggaccaggcacaatggcctaggcctgtaattccagcactttgggaggtcaaagtggaaggattgcttgaggccaggagttcaagactggcctgggcaacatgatgaaaaccccctctctacaaaaaaattaaaattaaacaaatcagttgggcagggtggtgcacctgtagtcctagttgctctggaggctgagacaggaggatggcttgagcctgggaggtggaggctgcagggagccatggtctctccttcacattccggcctgggagcaagcccttcatctctaaaataataataataataaaataaataaataaataaataaataaataaataaataaactgtctccaaatccttccattctagtccaggcctcttttgagttagctctattttttcctaatactcattaaataaatgcttaactattaaaatagaaagtcctctgggcggggaatggggtggggggcggctgccaggccatggccagaggctattatgcactggaaaccccgcatagcagaggggcagccctgcacctgcccctgtccaaggtaggtgggtggtgactgcaggccatgggaaacgtccatcctaggggagtcaccagccacctgggaagccaggatcaaggccctccacccccagagtacaggagacaaagggaggaacaccagggacaaggaaccctaggacccgaagcaaagtggcgttcgctcacccgggagtgccacgttcgtgccaccgtcacagccctcacctcccgcccgccagcacctgagaccggagtgctggggggctggctgcaggcgaaggaggtgagggcggattcgtttctcactgcaactgcagcctctagagctgggtgggcagggtctggctccatgagctcagagctgaccctctacaaagattccaggacttgggggctggagacatctctcttcgaaaacagattaatccagaggagctgtgggccctgtgtttagtaaattgtactctgtgtcttcagcatagaaagtccttcccactccctgctcagtatctcccagccctcctaggaggcaggcaaggcaactccaggacagtcaccctagttcacagatgaggaaactggggtttcaagactgagacatgagcgctcagcacagtccggggtggggggcagcaagggggtattactgagcacctctcatgcactgccacagccccagaccttaccccacttcatgcctgggacagcccgtaagctgcggactactggccaggtaaacaaggggaagaatcctacccaagatgtagctgatttgaatttgttaagaattaaggccaggtgtggtggctcacgcctgtaatcccagcactttgggaggcagaggcagacgggtcacctgaggtcaggagttcgagaccagcctggccaacatggtgaaaccccatctctactaaaaatacaagaaattagccggacgtggtggcagacgcctgtaattccagctactcgggaggctgaggcaggagaatcgcttgaacctgggaggtggaggttgcagtgagccgagatcatgccactgcactccagcctgggcaacaaagggaaactctatctcaaaaatataaaaaaattttaaaaatgtaaaaattatggcagccccaatttccaactaagttatattccaaggtatagtcaaaacacattttcccactgcaacaatgttattttatttagatattggggcttgtccatcaagggccagttaacccacaacactccagaatttctgaacaagtgtaatgaacagctgacaaatattattacaacatcaatggtcaaaatagaaaagcaatagcatttgataagaaattactttttttttttttgagacagagtcttgctctgtcacccaggctggagcacagtggcacgatctcggctcactgcaacctccacctcccaggttcaagcgattctcctgcctcagcctcccaagcagctgggactacaagcacctgtcacgacgcccggctaatttttgtacttttagcagagacagggtttcaccatgttggccaagctggtctcaagctcctggccttaaatggtccacctgccttggcctcccaaagtgctgggattacaggtgtgagccactgcatccggctgactttttatttaatatcttgaatacctgcctgaaaatctgaggccggatggaagaatggacagaattgcccccactctcctgttctggaatttaaagaagaaaaaagaggggaggaggcatcacctagttgggaccaggcttggggaaaaaaggacagaatttgcagaccaaacagggaagctgtgaaagaaaaaagcaagtccctggcaagcagctcagcagctggaaatccccctcggtccttgggagagacaatgagctccagctgctctcaactgcgatgcagagagagctggttcccaccctgcagccgtccccgtgtccttctcctcgctgagcctcacctcctccgcctgccacagaggcgagcatcccgcttcctgcccagggatgcagcggagaatgaatatcacctaggtaacaactcacaagcacagtgtctggcttcggggcgtaggggcggggacacatgtaatcaatacaagccgcctgcctgggtggcttcccccttccctgatgaagacctccaggccgcagagaatgctctgttcctggtcacaaggctgcagctgaagggcgggggaggcctctcagattcaaaacagagcagagatgagaggcctaattctaatttgagatcagagcctgacagctgggcaggtggcaggcggccgcttcctcccctccgtggagcctgccaggagaggggctgtggtcgtattaagggtgtgagtggcaaggcccgcagcgggatgggcagtccccgccatgccagtgcagctctgtgtaaatccttagtcccgagtatcctcgtgtaactcagagctggaaagagccgtagatcttctggttccatgctttcattttacacataaggaaacaggcccacagaggaaaagggctttttgtagtcacgtggcgaggcaggggaagctgggcccagaatgcaggggacctgccacccagacccacagccaggaccccccaacgggaaaacgctcgctcggccaccaagagcatttgatgaatttgcctctagtcttttaaaaatacatatatgcaattttattttaaaatgttttatttttattttattttattttttttgaaacagggtctcactctgtcagccaggctggagtgcagtggcatgatcatggctcactgcaacctccacctcctgggctcaagcgattctcctgcctcagcctcccaagtagctgggactactacaggcaggcatgtgccaccatacttagctaatatgattttttgtagaaatggggtcttgctcacaacaaagcccaggctgctttaaaattcccttgctcaaatgatcctcccacctcagcctcccaaagagttgggattgcaggtgtgagccactgcacccagcctacatgcaattctattttattttttttattttttcattttatttttgagacggggtttcgttctgttgtccaggctggagtgtagtggcgaaattaaagctcactgcagcctctacttcctgggctcaagtgatcctcccccctcagcctcctgaatagctgggactataggtgtgcatccccatgcctggctaacttttttctatttttttgtagagatagggcgagccactgtgttgcccaggcaggtctcaaactcctgggctcaagcaatcctttcatctcggcttcccaaagtgctgggatcacaggtgtgagccattgtgcctggctgtaattttaaattaatacctaattatactatgcatgaatacattctctttaaaaagttatttccttgcctcttggatatggtgtggctacttagtgtttgttaaatgtgtgaacaggtgaattcttatttctatcatcccattcaggccccaatcttattaccagctcctccctggatgccagcacctctcaacgccccctcccctaggaccctcctaccaggaccactggatcagggcacccaggggcaaggaggccagtgaggctgcttgagggcccctctaattcctgccccgctcttggttggggctagctttggggcacactttggacttttttttttttttttccagatggagtctcactctgttgcccaggctggagtatagtagtgtaattttggctcaacctctgcctcctgggtccaagcgattctcctgcctcagcctcccaagtagctgggactacaggcacgtgccaccacgcccggctaatttttgtatctttagtagagacggggtttcaccatgttggccaggctggtctcgaactcctgacctcaggggatccgcccgccttggcctcccaaagtgctgggattacaggcgtgagccaccacgcccagccctttggaattttttatcccagccccaagcttgggacgggtctggggcacccagataccctccctgtgaagccagggccccccgccctgctcaactgcctgcacacaagcaggtgttcctccttctctgtggctcctctcacctttgcttcctctctcccggtattgggacgtggaaagacattaaacacctgggagcccccagggaataattcaaattcaatcatagaaaatgaaggcacaaggcctgggctgctgggagggcccgagggcctggagatggaggcttggcaggcccagcactgctgaagccaagggaatgagtgacttctccaaaagcaggttgagtcatgctgaacctcactggttccccagtagcaggagcatgaggaccaaggacggacctagaagattcatggtaggggctgaggggaagagcagccaagagtcaggagggtcagaagtgtgtctgatcccttggcagggtgcggtggctcacgcctgtaatcccagcactttggaagtccgaggcgggcggatcacctgaggtcaggagttcaagagcagcctggccaacatggtgaaaacccgtctctacttaaaatacaaaaattagccgggtgtggtggcgggcgcctgtaatcccagcaactcagaaggctgaggcaggagaatcgcttgaacccgggaggcggaggctgcagtgagccgagatcgcgccaccgcactccagccagggtgacagagcgagactctgtctcaaaaacagcaataacaacaaaagaagtatgtctgattcctcaggccagagtaaaagaggtttcaagaaagagggtgtggtcaacagtgccaggtgcagctaatgtaaaggaaaagtggcctcctttttcccttgacgtggatgcgtacaaaccctcccctgggaccaagctcagggccgggccacgaccaggggccctcaggctagatctggtgccggaggagacctgctgccgaggctggacgggtgagcctggaagggcgtggaccctccacccaacctcagggacaagtgcctgacacccccctgagcagaaacagggtgggacggaaaccaaacaaattgctcctgaaatccatgttttaggaatgtttggttttcagcttctctttcctgcagcaggatgtttaaagaaaacaaatctttaaagtcttctactccaaagcaaagagcgctgtgtgtgcctacttctggtctccgcttcaggaacaaaccccctttactctctggcctggattgggcgcaaggcagccggagcttcctggccaagctgggccagcagcccaggcccccaccaaaggctcagagtgagctgggcaccaccaggccttgaggccttccagaggcttctactccagggcactctgaggccgggggctgtgggtggctaacagactatgccgccagctgggagcagagggggccccatctctgccccaaatccaagtctggccagctccttcccctagggatagatacttggtggggaagagagggagctgagaaggtcacccaagaaaggtgagccgggccgtctgcctgggagtcagaatgaggtggcccatcctcggacttgaccatttcccaatgccctgtttaatttaattttttattttattatatagggacagggtctcaatatattgcccaggctagtctcgaactcctggactcacatgacccacttgcctcggcctcccaaagtgctgggactacaggcatgagccaccacccccaccccccagataatctaaattcagagcctgcaaaaggctcagggcccaaggagagaaaatggagacagaagagaaagggaatttctccctccaggtccccacgcctgagtcagaccctctcactgtttcctttacaaccaccgcacacccacctggacctggcctaagaaaaggaatacaagtccatgaaggttctcccttctttttcttctttttcttcttctttttcgtcttttcttcttcttctttttcctcctcctcctcttcttcttcttctttcttcttctgtcgcccaggctggagtgtaatgacgcgatcttggctcacggcaacctccacttccgtatctcaaggaattctcctgcctcagcctctgggactacaggtgtgcgccaccacacccggctaatttttgtattttttgtagagacagggtttcgctatgttggccgggctggtcttgaactcctgacctcaggtgatccgcccacctcggcctcccaaagcgctgggattacaggcatgagccaccatgcccggcccatcatgtacccttctgatcctacaagcgcactgtgaggtcggccgggcatggagtttggtttcaacttcacgttgagatcggagcagctctgagaggtcggggcttcatccagggccacacatccagctggcagcagagccacctgtccacccagctctccggatgcccggcctgtgctccctacacagccgcttactgccctgccaggaaaaggcaggcaggagggatctttccactcccattaggggctgaggaacaggcatctaggagctaaatctgactgggggagtctcccagcccagacagcccagggccctgcccaggggtcagtgctttcacttgctgacctcatgcctccaccactactcggggacagatgaggttcagcatgactcaggttcagccaaaggatactaatgggccatggaataaatcctgcctggagccctgttcacctcaggacttgtcctcagaccatggaccttcctccctggtcactcagtcaaggaatcgcaggagatcagtgcaagagtagctctgaatgggccgggcgcggcggctcacgcctgtaatcccagcactttgggaggccgaggcgggtggatcacgaggtcaggagatcgagaccatcctggccaacacggtgaaaccccgtctctactaaaaatacaaaagattgtccgggcgtggtggcgggcgcctgtagtcccagctactcgggaggccgaggcaggagaatggcgtgaacccgggaggcagaggctgcagtgagccgagatcgcaccaccgcactccagcctgggcgacagagcgagactccgtctcaaaaaaataaaaaaataaaaataaaaaacagtagtcctgaagcccccagcccagcacacctggtctttgcaggcccgagacacccacaagagtaacagcagcgcctcattcaggaggctgaggactaagtgagcaaacgcaggccgagtgcttccccaggcctggacctccattagcattcaactgtgttgtcattgctgtcattgctacactggagtcagatcactaggcctttaggaggaagaacgtgcccttcctgttgacaggccgggcctctgacccaggcgtctcctctccgtggggtggcaggaagggcccaggactcaggtggcagatcagggaccccctggcctggcctctgctcagctgtgtgatcttggggaagccccgccttgcgtcccccaccgccttggttttcttcttgctgagaagtgagggaggtggctggctgttcagcagggccccttccactttgggaatccccagtttcagcagcagaacttccccaagcagaaagctgctgggaaagtgggtgcccaggtgggaggcggaagccccagggagaggcagacgaaggtgccctgtgcgggccccgcctccagcctggtggacagtgccctgggtttccatgcccagaccagggccttcctggaaccgcagccaggacgtgagaagctgtcagacagctgcctctgtgttcctggaagctgtggttcaggaaaagtgggagggagagaaggagggagagagcaatcgagggagagcagaagagtgtgaagagaaagagaaagacaggaggaggagcaaggggaagggaggaggcaagcgtggaaaggtgagaagaggtgaggcagaggcctacgtggagaggcagagcctgggacgctgcctgcgggggaggtcaggtgaggagcagggagggcggaggctgtgagcagccaccctggaacagagctcggaacaccattgcttttgccttccttcagcctgaaacactgcctggccacaaagcagaagcagcagttgctttcttaacaggaggcagagccgttgttgggtgaccctcttctcattcccttgaagaatctcagcccatgcccccatcccttctggcctggagacaccagtgttggggagttttgtgtaaaacagtaacaaagacctcgtgtccgaagcagcaccctttacctctgttgtcagggccacagggaaacccgcacccagccggacaggagtcagaggctgttgtcatggtaactggcatcccaaggcctggtctgcctcctgcctcctttatcgggctatgatggtcactgcttcctctgcgaagcacctgtcatgtgtgggggtttgtgccaagctctttccatgcactaggtaagccatgtcataaccacacgatgagatacgacttgtgtgtgtgtgtgtgtgtgtgttttcttctagagatacaattattaatcttacattacagggggagaaaccaggcagcccaccttcagagcccgcgtcttaactgtgaccccacgttgaaataaaatgtggaaactgcccacagacacacctcgtggtggctacgagtcacaggggctgcacttctgcctcttggggagttgcttgtttgctccatgctggtttcctcacctcagaaactagaataacagttccatagagcagtcgtgaggattgaaggaggcagcctggacactgagcacaggccctggcccaggcagggctccatcgagggtttgttagtacaggagttctggcgagccctcagccgctgggctgcttccctccagccattcctctgcatgctaagaactaaagagaagggagtcagacccagatggagcatgggtgtcaggcactgtgcccagctgcccatgagagccagcaaggtgcctgtgtcctttgaggtactaggattctgggccctggatcctgcagtgcggtgacctccccttcccccatctgtccctgccctgctccaccctcagccacctgcagggcccccacccaagggtcagggcagagcagggcagagcagggcagagcagggcagggctgagtgggaggcagcggagggggtcattatcaccggcagcacagggctgaagagagttaaaccttcttatcagttccctgggcctgtgcccagcccagcccagctctgaggcacaggggctggagagcagagccctggggttgccagccaagcctgtctcctctggaatggcccaggaccagggatggggcagcggcctgggaacccgagagtcaccagactggctgcaccgtgtgatctgatgcaaccacttccctctccgggccccagagtccctgcttatgaaattgggggtcgggggcagctggatgaggcagcccgggtcccttcctctcctagagagttaggatcctgtgatccctgggaggtggctatgactgtcagtcctacagacgaggaagctgaggctacgcacaggacagtgacttctccacagcacactagttgggcacagagaggaatgatggggctgagccccaccccacatgcccatgaagcttgtgagccttccagaaggcccatggaggaaaggcgtggagatgggaggtcgctgccctgggcaccccatcccagggtctaacccctttcttcaggtcctaggggccagctggggacctctcagaggagccctagacagtcaggcacctggcggctttgcaggcctggggtcactccttggctccagcccacagaaggcagagatggcagggcttcctgggcgtatagacagtaggccctgtaactgggctctgataacacccctccccttatcagtgggtcaaggactgggtggggtgcatctgagaatcaagggtacattccacagaaacaaggaaggggcagaaaggaaaagtgggtgcagctgaaccgaggcctctcagcccggctgcaaagaatcccggaggggtcccctggcttaggggggagagtgtggagtggtggggagtcaaaggaagggacagtctaagtctcacttaaccctccaggagccaaggggcctgatccaagtgactttcctgaagaaaccttagaaatcctaggctggggccgggcgccgtggcttatgcctgtattcccagccctttgggaggctgaggtgggcttatcacttgaacccaggagtttgagaccagcttggctaacatggtgaaactctgtctctactacaactacaaaaattagctggatatggtggtgcacacctgtaattccagctactcaggaagctgaggcacgagaatcagttgaatccaggaggaggaggctgcggtgagccgagatcgcaccactgcactccagcctgggcgacagagcaagactccgtctccaaaaaaaaaaaaagaaatcccaggctgggagggacagagagacctagaatccacatttagagcaggaggccattgccctcagagggttcatggtctcctttgacactatgaggaaaattatgtctgcccagtggggaaattgaggcccagcgtgtgaggggaaatgactcacagctggcttaaggcttgaaaggcccctgcctgaggctgagtgtgtcccctgcatacctggaggcgaggaccagtaggtgccgtcctgaactaagggacagggtggcagaggaaggtcagggcctccccagatactgggcctgggcttctttgcccctgtgggctgggactccaggcaggcaccacttcttcaaccagccagttccataattcacatcccggccttggcccaggctcctggaccccctcccccgtggcccatgccaggcaggtgggtgaggctgggcctgcacagggaagggtctgaagcctgcagggtcggttgtggcaggacccattgggctggagatctggagggacgtcctgcatcaccagcggtagagaggacaggggctgggccagcgtccccctgagaatgcgctcacaccccagcacacagacacacacacctccgcggcacctgggggtggctcatctgaacccttgggtgacatccttctgcccccaccctcctccacaccctggtttcacccggatacgaaggtggcaggaagcaaacagtgtgacttgggcccattttgacgctccaggtggcagaatcactggaacacctgataaaaattcccaccctcccctgacacggaaaggctgagccagaagagcctggcagaagggacttccctgaagaaaggggcccaggtcagtctcgaaggtggtccttggagaagctctgggtggtgtgtcagctgcgtggtggagaaaatcatcatgatgacactgaccgcgctcactgtgtgcctaccgtgtacctgtgtcccgatgttttgcatgaaacacctcattccggcctctgccagccttccagaaagatgcattattcccagtcccacggtcacattctggccgctagcagagccacagttagatgtgtccccccgacccccccaaccccaggggcctgaagacttgtggggcctgggaccaccccaggggcaagaccagaaccagctcctgacctcccaccaggaaagagggaccagggtgagacacagctgcaggaaagatgcaaggctgggccgtggtggagaacgcccccacccctccacttccccaggacgcggcaggcaggagggggccactcccagcctcagggccccagaaatggtaaggccagccctaaccccaccccagaggctccagagaggcagggctggaccaggccaggcctggtgaatccctgggctgcgagcgccccctgcagccagacaaaggtgtggccgggcagaggccaggtgctccccaacctcggacaccccgacattggtggattttcctcttccatcatctccagccctagctgggagctaggccagtcaactgctgcaattattattattattattattgtctgttgttgttgttgccctttttttttttttgagacagagtctcactctgtcacccaggctggagtgcaatggtgtggtcttggctcactgcatcctccaactgccgggttcaagcaattctcctgcctcagcctccctagtagctgggactacaggcatgtaccaccaagcccagctagtttctgtattttttactagagacagggtttcactatgttggccaggctggtctcgaactcctgacctcaggtggcctccggcctcccaaagtgctgggattacaggcgtgagccaccacgcccagcctattgttgcccaattttaaggaggagagaaatgttaggtgtcttgtccaaggtcacagagccaggtggtgtcaggtcctgaactcaggcctccacagatcctgggtcctccatcccggaaggtctttgtcccggcccattagagcctcctccaagccctcacccaggacggacatgcgcagcgtgacagttgtaagaggcaggcaagagtatttaatgggcattgagggtcttggcagtcccaccaggggagtgggcaaagggcaaggcacagaaaggcttccactcagggctcaggaagtgggaggtaaggaggcaggttcaggaggcgggttcaggaggcgggttcggaggtgagctcaggtgctggtgctgtgggcatctccgggtgcacaggggcgagaggaaggccgaacctcgcctgggggctcctgcagcagcaggggcagcactgggcccgtgtggaactaaacacagaacaggggcatgagtgctctcaacaagaccccgccccgcagctcgtgccaggtctcctgctcctggaggcaaagggagcgggctggccccacagaatgtgctgcagaggccccggggcgcaggggttgcccagccccacggtggcctcctgatgctccacctccatgtctcacggggcttcgagtcaatgtttcctttaaataaaagagtctcccgccacccgcaccccctggccaaattataaaccacgagactcatctcagtcctgcgagtaggtgactggcctgaggcccatcagcacatgtagtgggggagtcatcctccatttgtctttgtgactccagggactcctgggtgtattctagaggcctgggccctgcttccaacgcccctccagtgtagaaccctcctccccccaagctcggagcgctccagcttcagggtcagccaaacctcaggggcctccccccacaccctcacaacctgcagacacccccctcccgacacgcacagacacccacgcacacacacgcttcttacctcctggagagctgcagcctcaccacgccccgggggtcccttccctgctttgtagggacccagaggttggggctggggggttgagagcagagggggacattggagggtgcagattcggcatggatgtccagtcaggccccaccactctctgcagctggacagcttcagccatgtacctggggagcagcaggccagatgcaggggccaccgtcctccctggtccggctcccctgcccgcctcagcttgggaagcacacggcccagggcttagctctgcaggaagctgaggccagcctcatccaggatgcagcagccctgtatgccatagtggggcaggaacacacagagccaaggacgtagggaggccccagagctcccagtgccctggagaaaaccccagaggagcaggaacagtgagtgtaagggcctggggctgtggtaaggagccagggtgaacccacctctgccccacccccagggttcaccagttgggcctctggcttgccaactcacttgggtcccagtggtgcacaaattgttaaataccagttgctggcacagccctggtcgaaggggttgtatccctgaaggtgtctgcactggtcggggatggaaaccggaagaggagctcagaaccagcaggaatggctgggccatcgcccagtggccctccctgagctggtcagctagccagggctcagcccagggcaccagcaagctggaggccaggagactgaaggacctccccaccactgccccatcctcctcctcttggtctccactggccacacacatcctcctgctacctccttccagatactgaatgtcactgtctggaaggtcagttgagcaaggcccagtcgtatttccctaaccatgatcacatggcccaggaaaatctgggctaaaagccttgaacacgcaatgcggtaaaggccaagtcgtcccctgggcactcttgaccttgatcaggttctctccctcctctctccccttcgcccactcactctacccatccacctcaccccctcccaaactccctctccgccacagggcaggctgggcctcacctgacttcaagagcctttgctgtcatgttttgtcactgaaagtggcccagcagcatctctgcccaccaccaactcccctgtgtcccatgtccccgctctccgccgcaaaggctgagattttcaacaccattctccaccaaaggaaccaggactccatgcaaggacagctggcactcactggagggaggaaaagtctggacagctccataacagctcactgtcgccactcactgttgccatagggcaatacgcatccttgcactatttgagattctgcctactttaaggtatttaaagcatgtaaaagaaacgtattggccgggtgagatggctcacgcctgtaatccctgcactttgggaggccgaggcaggtggatcacttgaggtcaggagtttgagaccagcctggccaacatggtgaaaccccatctctactaaaaatacaaaaaattagccaggcgtggtggcgggtgcctgtgatcccagctactcgggaggctgagacagaagaatcgcttgaacccgggaggcggaggttgcagtgagccgagatcatgccactgcactccagcctgggcgacagagcgacactctggctcagaaaaaagaaactggtattgtattagtcatttagaagattttgattaaatttatggaatttgggccaggcatggtgattggcacctgtaatccgagtgttttgggaggtggagaagggaggatctcttgaccccagaagttcaagaccagcctgagactttcatctctaaaaaaataaaaataggtggctgtggcattgtgcacctgtagtctcagcttcttgggaggctgggatgagaggatcccttgagcctaggagttcgaggctgcagtgagctatgattacgccactgcactccagcctgaatgacagagtgggaccctgtctctagaaaaactaaaatctaataaaaatatattgacagaattttaaaatttagggatatatatatatatatgtatatatatatataatttttttttttttgagatggagtcttgctctgtcacccaggctggagtgcagtggcgcgatctcagctcactgcaagctccgcctcccaggttcacgccattctcctgcctcagcctcccaagtagctgggattacaggtgctcgccaccacgcccagctaattttttgtatttttagtagagacggggtttcaccgtgttagccaggatggtctcgatctcctgacctcgtgatccgcccaccttggcctcccaaagtgctgggattacaagcgtgagccaccacgcctggccttttttttttttttttttagacgcagttttgctcttgttgcccaggctggagtgcagtgatcataggtcctcacaaattcaaactcctgggctcaagggatcctcccacctctgtctcccaagtagctgagactacaggcatgcaccactatgcccagccaatttttaattttttttgcaggaatggggtctggctatgttgcccaggctggtcttgaactcctggcctcaagcgatcttcccacctcagcctttcaaagggctgggattacaggtgtgagtcactgtacccggcattagggaaataaatttttatttattagatgtatataaggtatagaaaaatgttgattgtatatgaggcatagaaaaatgcttaaaggaatgatgatctttaataaattcataagactgacccatacatttttcttttttttgagacggagtctcactgtgtcgcccaggctggagtgcagtggcacgatcttggctcactgcaacctccgcctcccgggttcaagcgattcttctgcttcagcctcccaagtagctgggattacaggcacccaccatcacgcccagctaatttttgtatttttagtagagacggggtttcactgtgttggccagtctcgaactcctgacctcatgatccgcccacctcggcctcccaaagtgctgggattacagccgtgagccaccgcaccgggccaaaactgaccaatacatttgtacctgcctctcccacgcaagatgctttcagatatgaatgaaaccaacagctcttggccgggcaccgtggctcacacctgtaatcccagcactttggaaggccaaggcgggtggatcacttgaggccaggagttcgagaccagcctggccaacatggaagaacccggtctactaaaaatgcaaaaattagtcgggcatggtggcatgtgcctgtaatcccaactactcaggaggctgaggcaggagaatcgcttgaacctaggaggtggaggttgcagtgagccgagatagcaccactgcactccagcctggacgacagagtgagactctgtctcaaaaaataaaaaaagaaaaagaaaccaacagctctgaagcactcagactgtccacctcactgtctccagacctggggctcctgctccgattctgtgtctgaaactgcctgacactccacgggaccaaagccagggtgagctgcttcttgctccgtctcccacccaacccccctctccccattccccgccagggatcagggcatctggcttctctctctttttgtcttttcgtccctcccaaagtgctatggattcctttgttggttggttcactcactgtttcaggaatattttggggccttaaaaatgttccaggggccgggcgtggtggctcatgcctgtaatcccagcactttgggaggccaagatgggtggagcatttgaggtcacaagttcaagaccagcctggccaacatagtgaaatcccgtctctaataaaatacgaaaatttttagtagggtgtggtggtgcacgcccgtagttccagctgcttgggaggctgaggccggagaatcacttgaacccaggaggtggaggctgcggtcagccgaggtgacgccattgcactccagccgggacaacagcgtgagagactccgtctcaaaaaggaaaaaaaaaaagttccaagggctggtctgaaagcagtggtttatctcgcctgttcagtaagttacagacccaattccttgttctactctttcctcgctgctcactactgtccttgccgtcaagaaaaaataaaaataaaaaaaggaaagttccagtcactgtgctgggggttgaggacgcactgcacacgacatatcccgggccagcctcaaccttcagggtggcgagggcagcaccgagggaaggagcaggaacccaggcagaggcgcccaggcacacgcagaggagccgcgcaggaggccagaggctgagccctgaggggcggggacaggccgcttccctgcgtgcagtttcacaagctcaagctgctgtgtgcggtccggaaagagtagtatgaggcctgaccactggctttggccgcctggtgagagcagcatccgtgtgacagtgagcacagcggccggctgaagctgccggggaagggggagagtggggcaagtgagcactgccggccctgtcaggagacttggctgctggagagcagagtagagcagcgggagtggaggctggcgatgttaagggagggttttgctttgcttttaagatgagagagacaggagcatgtgtaaatggtgatgaaaatgaatggtgccaggcgcagtggctcagcctgtaatcccagcactttgggaggccgaggcgagtggctcacctgaggtcaggagttcgagaccagcctggccaacatggtgaaaccccgtctctactaaaaatacaaaaaatcaggtgggcatggtgacgtgcacctgtaattccagctactcgggaggctgaggcaggagaatcgcttgaacccaggaggccaagatcacaccactgcactccagcctgagtgacagagaaatactctgtctcaaaaaagaaaaaaaaagaaagaaagaagaaagaaagagagagagaaattgaacggtattaatagtagcgacatctagagcactcacttgtaccagctgctactctatgtcttaaactcacccatgctgcccattttacagttggggaaagtggacgcctaggtggctaagtaatatacccaggatctctctgctggtatgctgtggagctgtgatgtgaacatgtgtgaactggatccagagaccttgctatcaaccacaggcagagttgcagcccagggatggaggaggaagggaatgagatttggggcatgtgaagaaggcctgaggcaggtgctgcgggctgcgggaaggagccctgcctggtgaatcgcaggccacgttagggtccctggaggctggagatcctggatcaggagggcagcattctgggcaggggagggagggcaggaagaaccacaggatgtgagaagggcgaaggctgcccagaaaaggctgaaacgatgcactgaggctggggagggtccacatgcagaccagagcgggctgatgaggaagggcggagctggggagtcacaggtgggggagccaaatatgggtgtggtggagtgattgaagggtgactgggatgggaggtggtgggcagagagggcgcctgtgtccttccagctgtctgatacctgcagctcctccctcatcaatgctgcccatcagttttcctagaacagccagtgacctgctgaaggagtctcatggcgcggatgtccaccctcaccactcctgctccacattgtgctagaggtccaagacagtgcaataagaagagaaaaaaataaagccatacagattggaaaagaagaagtgaaactgtcctttttcacagacaacaggatttcctatgtagaatcaacaaaaaagctattggaactaataaatgggtctagcaaaatggcaggattcaacaccaattcaaaaaaatccattgtatttccttataataatgaacaaatggaaattgaaattttaaaaaacatgcttacaatagcacaaaaaaagaaatacatataaatctaacaaaatggatacaaaatctatatgctgaaaaacacaaaataaggatgaaagacatcgaagaagacgtaaataaatggagaggtgtggcatgttcatgaattcactcaatcttgttagaatgtcaattctccccaaactgatctataggctcaatgaaattccagtgaaaatcctagcagatttttttgtaacaaataataaggaaacaatacaattttttaaatggacaaaagattggaacagacacttcaccatagttacacagatggcaaagaagaacatgaaaatatgcttaaaccattagtcattaggaaaatacaaactgaagccacactgagatgccactacacatgtcttataccggcttaaacaaaaaacaactgacaacatcaaacgttcgtaaggatgcaaagcaattggaattcttatatattacgggtaggaatgcaaaatagtaccactattttggaagacaatttggcaatttattatgaaattaaacattcaggccggacacagtggctcacgcctataatcccagcactttgggaggctgaggcaggcagatcacttgaggtcaggagttccagaccagcctggccaacatggtgaaccccatctctactaaaaatgcaaaaattagcccggcgtggtggctcacacctgttgtcttagctacctgggaggctgaggtgggaggatcacttgaatctgggaggtggaggttgcagtgagccaagatcgagccactgcactccatcctgggtgacagagtgagactccatctcaaacgaacaaacaaaaaaccacattcaattaccatatgaccccttcaagtatttaccccaaagaaatgaaaacttatgttcacatgcctgtacaccagtgtttatagcagctttatttattataatcccccaaactagaaataacacaaacatcttcaattggtaaatggataatctattgaacatccatacaatgcaataccgtacggcaatcaaaaggaataaacgactgctatgagcaacaacatgaatgaatctcgaatgtattgtgctaagtgaaagaagccagactcacaagccaacaatttcagttattctggaaaaggaaagtgataaggacagaggacagatcagtggttgccaaaagccacaggtagggggagaaattgactacaaaagaccatgatctctgatttttgggtgggatggacctgttctaaatattgattgtggtggtggctgcaggactgtatccgtgtgtcagaactcatactgtatactagaaaaggatgagtattacataggtagattattgctcaataaacgactttttgttttggtttttgtttgttttgagacagagtctggctctgtctcccaagctggagtgcagtggcatgatctcagctcactgcagcttctgcctcccaggttcaagagattctctgcctcagcctccaaatagctgggattacaggcacatgccaccatgcctggctaatttttgtattttttgtagagacagggtttcgccatgttggccaggctggtctcgaactcctgacctggcctcaagtgatccacccacctcggcctcccaaagtgctgggattgcaggtgtgggccatgcacccgtccaataaacttggcttttaagaaattctaccctggctctcataccatgatttcatcatcaagcctaaattctccacctgactttctggggttgttttgttttgtttttgagacagagtctcaatctgtcacccaggctggagtgcaatgacacaatctcggctcactgcaacttctgcttcccaggttcaagcgattcttgtgcctcagtctcccgagtagctgggactacaggtgtgccccaccacacctggctaatttttgtatttttagtagaaacagggtttcaccttgttggccaggctggtctcgaactcccagtctcaggtcatctggccacctcggcctcccaaagtgctgggattacaggtgtgagccactgcacccagcctgggcatttttttttaagacagggtcttgctctattgcccaggctggagtgcagtggtgcaatcacagctcactgactgcagcctccatctcccgggctcaaacaatcctcccacctcagcctctggagtagctgggactaaaggcacgtgccaccgtgcctggctaattttttaattttttgtagagatgaagtctcgttttgttgcccaggctggtctcaaactccggggctcaagtgatcctcctgcctcagcctcccaaagcgctagaattacaggcatgagccacggggcacagcttggaactttttcttttcttttcttttctttttttttttttttttttggaggcagagtctcgctctgctgcccaggctggagtgcatggtacgatctgggctcactgcaagctccgcctctccggttcacgccattccccagcctggacctttttaatgtggccaacagaagcagtcgacttggttgcccacaccaccttcttgccccagttagaattgtttcctctccatcctatcaacattccacagactttcaggcttccctgagtttttgcaaaggtgtcccctcacccgcaatgccctcctctccgtcttctgtctctcccgaacccctaagctgcacgtcctaccctaccatgtggtcctccctcaaccctcaatgcctgagtctgcgccacacagctcaggaccggccccctctctgagtgttcgtgggtatctggtgggtgttactctgatttcaggttcctcatcaacacgagtgtggaatgtagccttactcacctctattcccatcgctcaaagaatccaaaccgcctagcacacagtaggcccccaggaaggacagggaccactgagctcccggaggaggcgagattggagcctcttaagagctgggtctggagggacctaacgaggcaccatcgcgggtgggggtcaggctatcagggccaagggcagtggagaaagcgcgggaagcgcggaggtccccgaggtgcaagctgaccacccgcggccccgcgtaccttgcccttgtaggtgcggtcggccgagctcacggacagtgcctggatcagcagcaggagggacagcggcaccaggaggcccgcggcggacacggccaccacgatgctgcgcgggttaaggaaccgggctgcgggacccccacgcctggccccgccccccaggcccgactccgccccgagccccgccccgcccccggacgcccgcccctcaggcccgactccgccccgagccccgccccgcccctggccccgcccccaggcccgactccgccccgagccccgccccgcccccggacgcccgcccctcaggcccgactccgccccgagccccgccccgcccctggccccgcccctcaggcccgactccgccccgagccccgccccgccccccggacgcccgcccacccgccccgtcccctggctccaccctcatcccgcccacccccttgaaagcctgactccaccccgctgtccccgcccgtccagatctgcggtgcacctttagcacccgctccgtgaccccgccagattcctttttcttttcttttcttttcttttgaggcacaatcaccgctcactgcagcctcgacctccctccccggttcaagcggtcctaccacctcagccttccaggtagctgggactataggcgcgagccatcacgcccggctaatttttctatttttttgtagagacggggtctatgttgcccaggctggtctgggtctcgggctgaagcgatcctcccgcctcggcctcccaaagtgccggaattacaggcgtgagccaccgcgccggcccgggggaggcttaacgctccgccccttctcctagccccgcccatcccccgaccccgcccacctcacctcgtcccagactggtcctcccaggcggcttctccctctagccccgcccccatagccccgccctctgcagccccctccttggctgtccccgcctcctctcctgcttccccacgtgggcggatacgcgatggccttgtcggtggagaagggcaggtgggttgtgcgcaccaggaagatgagacaggtgaccagcatggcgcccgagtagaggcacagggacaggacaagcagcatgaagaagcggaagttgcggtgaccgatgcagttattgacccacttgcagtggtggtcaaagtcctgggcgacagggagaggggccaggcttgaggacttctcctctggcccaaattccatcaccccaaatcctgaggccctccccctgccttctaggccacctgcccttggcccatgcactggcttccacccccagggagaaactgagccacagaatgcctcatgctggcatttcccttgttagagcacagttaggactctggtatatacggtcacctgtcagaagacctttagagagaagactggcctggccttctgtgagacacatcctactgtaactctgggcagaacgtaaaccatctctggacctccactttctcatccattcgatgaagatgacagtaacagtaacacccttgcccagccagcctcctgcacttgtaaacctatgcaagccgtgctctcgagagagatggtcactcagagccaggagaccctccaacttggacacccaggcgaggacaggcaaggcctcccagaccaggcgggcagccagcctgaggggcttgggtatctcgtgttagcgagcccaggggtgggacagagggctgcctctcctcccctggcctgacccagcccaggacagatgcggatgccctgtgcatgtcagcacctctgcaggcaacggccagcctcccaggacaggtgcaggtggagaacacatgagtgaccaagggtggctgggagttactgccacccttggcctttagcagtcctgaaaacagcttcacacccagccctggcccctgtatgagggaggctcctggtcccagccagatgtggggcgatggctggtggacaggtagaggggcactcacctccacacagatgttgcaccaggggcagtggtaagtccggggcgggcggtggaagcagcactttggacaccattgcaggcggaaggccccgtggttcacccacaccacgtgcaccgtcaaggggccctgctcagcggagcctggcgtgggaagaggattgggcacagcagaaggccctgcggtcaccccgcggcgggggcagctccacggcatcacagggcacaaggaagggtggggacaaggtgggcaggggaacccctgtccccactgagcaagctgtccaagctcagagaggatggcagtcaaagggaagacgggtttccagccaggagagttttgtatgaaactcaggcgtttggaacagtgagtgctgctttgagtgtcattgtgtagtgaagggaggaagtgcatacagtggtttggaagagcccactggcttctggccctggcctgcccggtcctcccatctaaggcaactgggaaacctcaacaattctgtttttccacaccttggtggcttaagaaacggggtagggccgggcgcgggggctcacgcctgtaatcccagcactttgggaggccgaggtgggctgatcatgaggtcaggagttcgagaccagcctggccaatatggtgaaaccccatctctactaaaaatacaaaaaattagctgggcgtggtagcatgctcctgtagccccagctacttgggaggctgaggcagacgaatcgcttgaacctgggaggtggagcttgcagtgagcggagattgcgccactgcactcccgcctgggcagcaaagcgagactctgtctcaacaaaaagaaaaggaaagagagaaagaaagaagaaaggaaagaaggaaagaaagaaagaaaaagaaagaaagaaaagagaaagaaagaaagaaagaaggaaggaaggaaagagagaggaagaaaggaaagaaggaaagaaagaaagaaagaaaagagaaagaaagaaagaaggaaggaaggaaagagagaggaaggaaggaaagaaagagggagagagagaggaaggaaggaaagaaagaaagagaaagaaagaaagaaaagagaagagaagaaagagtgagcgagggccagagcaatgaagacgtggggtgaaggggtccagaggctggaggagggtcagtaggaagagcactttaggaatcccccctgcaggttcccagcccttgagtgacacctccttttcccagggggctgatgcctcaccttgatgtaagatgccagggtctgagaagttgagtgaaacaagactgaagaaggtaaggacaaagagggagcctgtgataacaggaaaggcccactccccgttctgagccagccacctgcaactgagaccagaggcaggctcggtcctgagcaggggcagcccaaagcccccggcccaaggcctgtggcttgctcaggtcaggacccacagaccttcaagccagatctaaaaatccaggctccaaatacccaggcagactcataatggctccaccaaatgtcaccagcatgaccagccacccaaagctcccaaaatgcacaggcacccttgacctctgcgcctttgcacgtcggttcctggaacagaatatccccttttccctgcccgcacccttgacctctgcacctttgcacgtcggttccctcgaacagaatatccccttttccctgacctctcccccggtcttctgcactcccctgcctccatcctatcatcttctgtttccctggctgtctctttgtgggaaacctaacggcttgcctggaaaactcacgggaatgcgaagaagaggccactgaaaaagaccagcagcaccacattgaaggcagcaaagaggctagggaggaaccagggacgtgggaccagaggcaggggatggggctccttcaccagcggcgtggcatccgttaagagtgtcatggctgggcctccttcgcctccaggggaggtcagagccaccaggcttcctcccccagcccagcttccagagctccatggccacggcagcctcagagccgcagcccagggtgaaaggaaagaaggcccagtgtgacatcacagaggctgggggacctcagcagaactgtctgcagccctgctctagctgcctccggtgacaggcacttccaacagcaaaccccacccccaccccgacatgtgctggggaaccgggagttcctgcccctgagaggctgatgttgttggagaaaatatgacctggagaaacacatgggaagaaagttggtaattttcagccggcgctgtaatccctgtaatcccagcactgtgggagaccgaggcaggcagatcactcgaggtcaggagttcgagaccagcctggccaacatggtgaaaccccatctccactaaacatacaaaactagccaggagtggtggtgcacgcctgtagtcccagctactcagaaggctgaggcaggagaatcacttgaacctggaaggtggacgttgcagcgagccaagatcgcgccattgcactccaacctgggtggcagagtaaactccatctcaaaaaaaaaaaaaaaaaaagaaagaaagttgctgggtttttttgttggtttgttttgtttgtttgtttgtttttgagatagtttcgctcttgttgcccaggctggagtgtaatggcgcaatctcggctcactgcaacctctgcctcctgggttcaagcggttctcctgcctcagcctcccaagtagctgggattacaggcatgcatcaccatgcccggctcattttgtattttgtagtagagacggggtttagtcatgttggccaggctggtctcgaactcctgaccacaggtgatccacccacctcagcctcctaaagtgctgggattacaagcatgagccatattaaacttcctttataaaaggcctcaaaaagaagaaactgaggcagaaatttaaaaataaatatgcattcattcactccaagacaagtaacaagcaaggcaaaagttaaaaagaaaagaacaagttttcctctgcccagcaagctcacttcaaggacagttataagataacgctgtttaagaggccaaggccaaaagaataagctccagacacccctcgcctccagagcaaagttgaagaaaaaaaagaaagacaaattctttgactgttactcctttcccaggtttcttaagcatgattatgttttacaaatgtctgtatttagccagttcttgtttttctttcaatgcagctacaaagtcaccagctatgcaaggccacaagttatgctatagatgatgtgacctgtcatatgattaactacttttatttattggaagtctgcttataaaaaccccgctctgtctttgttcgatgctcagctttttagatgacagtccactaagccagtgcgtacctgaaataaacagtcctctcgttctctgtctcagtcttgccagtcctcagtttcctgcaacatctctactaaaaatacaaaaattagccaggtgtggtggtgcgcacctgtaatcccagctactcgggagcctgaggcacgagaatcgcttgaacctgggaggcggaggttgcagtgagccgagatctcaccattgcactccagcctgggaaacaagagtgaaactatgtctcaaaaacacagaataaaagaaaagaaaagattatgcaaaatggaagaaactaggcacaaaaagccacatattgtatggttccacttacatgaaatatccagagtagccaaatccatagagatcaaaagcagattcacagttgccagggtgtgggaggagggggactggaagagatgaggtttgttgttgttgttttgagactgagtctcactctgtcgcccgggctggagtgcaatggcaccatctcagctcactgcaatctctgcctcccgggttcaagcaattctcttgcctcagcctcccaagtagctaggattataggcacctgccaccatgcccagctaattttttttttgtagttttagtagagacggagtttcaccatgttggccagcctggtctcgaactcctgacctcaggtgatccacccacctcagcctcccaaagtacgggcattacaggagtgagccactgcactcggcctaatttttgtatttttaagagatggggtttcaccatgttggtcaggctggtctcgaattcctgacctcaagtgagccacctgcctcggcctcacaaagtgctgggattacaggtgtgagccacggcgcccagcctcttttttgatttttcaaaactgactctcatattaaggaagccaaaacttaagtgataactgaaatgatcgtgttactgaccacaggttctttaggctccgataaaaattgacacgaggccaagcaaatttcccagacaaggctttattaggggcttccgttccaccacgggggagacagcaccgcagggagaggtctccggctggctccccaggggactgcgttgtggcgtctcgaggagggcgacacgcgtaattcatgaggtaggtgagcgtccctgcaggagtgacagaacgcacagggatagttaggaatcgcggtaacacatacatcgcaggatcagaacacgacgagaaagcctctccctggcagaggcttttgttttgtttctgtctgtcacccagtctggagtgcagtgacaagatctcggctccctgcaacctccgcctcccaggttcaagcgattctcgtgcctcagcctcccgagtagctgggattacaccaccacacctggctaatttttgtatttttagtagagacggggtttcaccttgttggccaggctggtctcaaactcctgacacctcaggtgatccgtccgcttcggcctcccaaagtgctgggattccaggtgagagctgccgcgccgaggcagaggtcttggtcttgtaatgaggccgagggtaaagagtggtcgtgcttccggcttcctgcacacaaaggcaatggagttcattccctgaagtacaagattggaagtgcgacgctgcctatcttcatttttcaaggtcgtgtgatcagtggatgtggcattttgtgtaagatttacagtggaatgctgcttatcttaatgctttcactgtccttcaatgagcaggtaagaaaaaaaaaggaagaaagaaaaatgttgggggggggaatgcattagcgaatgcattagtggagttggcagccgagtcccatccctcctctgtctcaataagtgtcagatgatgctatcatataattttgtgggaaaaaataggccaaagaaatgaaattcagaaggacttattctttttggttctaaaatcagtttctgagagctggcaggccccaactgccaagaggagaccctggcggccacagctcatcctctctgaccaagccttagctggggatgggccggcctccaggcagggcctcccgctggctggatcccgggccacactgtacagaagacaaccccgtagagaccttgggtggggcagaagcccccttccctcactgacaccctgccggtctctcctggggtctcccagtctctgctgcccagtggggaagcacccgtctcagcccaaccgcagccccccccggctccctcctgccctttcacctttcctgccattccccactgtgtcctgaagtttctaagaacatccccagcgccctgttgtcagctctgggaagtctaaagttcagggctttgggtaattaaacccaaggcctctcagtgggctgggggtgaatgacctggcgaacgtgcctgcggagatgctgggaggaagctgagtcagtctgcgtctttgtcagggtgggctgaggccagtgaccctctgggggtcagggcccttgcaggcctcttccttccctgacctccaccttaggaggcagctggcccctgagacgcctgcctcacgacattgtcctgtcccaggaactggactttaggaggaggggaagctggagggggatgcagcttgactcttgggagagactttgaggtgtctgggcacaggagtggggagtcctccgggtaccccatcagggactgcttccactgcttgtatggcctcaccagcccagcgcaggaagccccctctcccttcccagaattgaccctctgcaccctctcctgggccctcttctcactacctccatctccaccatgccccaacagagcccctcccccaggcccctttggccgctctccacaccccacagctttctgtctgacctggtttcttagcctctctggacctcagcctccttatctgtaaaatgggaataaggatactacttcccttgtaacgcggtggtaaagtttaaataagctaaggaacacactgcatgtcctgcgggccctggcacaccagacatgctgacagacgctggctgctttcatcagctatgcaaccaaattctaaggggcccttcgtatgtgtcaggctgcgtgccaggaacctagaggtaccaccgtaccacagtacaagatgctgtgtctggcttcgaagagatttcagtctatgtggagagagagaaaagggaagctatcagccaataaaatcgtttgcaagcctgtaattcagcaggttttcaagacctgtcaaatgcccagcaatctcactctgcaactctgcctcttaaatacagcatcttccggcccagcgtgggggtggctaagcccatcatccagatgtgatgaactggggtctgggaaacccacaccggcctcatctggcttttccagcctgtcctcccttccacacatcaggctgacagcaccaaacacggccgaggcctcagccctgagtctccccgctgcagagtgcccaagcctgagttccagcaggttcttcaggggccgctgaccagggaacactgcggtgaggagcgaggacttcgtccccaccccggcccagggcaggggcttcgtggtgagcccaccccaccccagaaggctcctggaagggcagggcagactggcagcaaaatcctataggatgggccgggccagaggcaaggggtggccaaaggcacctgtccaagaggtgggagggaccacacctgggggcagggacgagtcaggcacagggaactccgccagcctagaggatcaaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtaagtgagggcggcgggccctgggccagtcgctgggcagcggtggcccctatcccgcggcctgtcctctctccctcccagagccctttggcggccgcactcagaatgagacaggactggaaatgctctagctgttcctaggtcctcagggacaacgtgggtttgggccagggtgtgacactccagggcctcggccttgccccccagcgtggggagagaaaggtcgcagagcgggggctgtggaaggcattcgcagaggaaatggcagcatccctcagcagcagggggcccgtccgtctgtaaggactcacccttcctctgggatcctgctcttcctctctggtcagtccctgggctgctgcccgacccgcatggagagaatccacggtgggctcttcaggcacggcagccaggcacagcctggctaggtggcagcttgtcttactcccccacctgggccagttctccactccctctaagaaaagggccctgaggccgggcgcctgtaatcccagcactttgggaggctgaggcgggagtccaggagtttaagcccagttccagtttgagtcctggagttcgagaccagtgtctgagcaacatggcgaaatcctgtctctaccaaaaatataaaaaattagccgggcctggtggcgtgcacctgtagtcccagcttactcatggggatgggggttgagtagatcacttgagcccaggaggtcaaggctgcctgtatgagccaagacagaccactgcactccagcctggacaacagagcaagaccctgtctcaaaaagaaaaaaaaagaaagaaaaaggaaggaaggaaggaaggaaagagaaggggaaggaagagagaaagagaaagagagagcagaaggaaggaaggaaggagaaggggaaggggaagggagagagaaagagaaagagagagtgaaaggaaggaaggaaggaaagaaagaaagagagagaaagaggccctgaggggaaatggacaaagtcctgcactcaggagtggttgagggtccagtgtgcaaccctcccccttcccccagcccccatggttctgagcacaggctggtgtctcgccaggtacacagcagatcttctggaggtgctgaagaccaattacggcatcccctccgcctgcttctctcagcctcccacagcagcccaactcctgagaggtgagtggggaccctcctcagagggaactgagaggagggaaaccaggatagctgagtggagctggggagaggcggccctgagctggtgcacctgggcagccggggagaataactggcccggtgtctgtcatcgtggttaaggctctggagaagggcaatgcctcaaggagtcagtgggtcaaaagggtagcatgagagcctggctccggagagcaaccgtcatgttgggcctccacaaaactggcctcaaagctcattcaaactgcggacactgcgacctggggcgctttttcagaccccagagccatctggggacccaagatggtgcccaagtggtccaagccccatcgggtctcctggagggctgcacggcatccgccctggacccatgtcactctagagggtggttacggtgagtgacgtgcttcacacaggtgaaccagttgtatttgttttacgatccagcctttctgaaaaacctttgtcctcactggagcattctgttgtcgggtttttgtgtgtgtgtttgtgggtatttgcctcattccacccctgagctctcaggtggacagatgggattcaaaaacctgttctacagtgtttattgtagtggagtaatttgtttgcaataataagtcataattgtccactgaaggggagggtgtggggatccccgaggccagctcaagttcagctgttggaagaattccttgactggaaattttacctttgcgttttgtcgctctgtttcctgaagataacttggggtgctcctggtcgtccatctactgctttgattccttggatcccacccattctttcactttaagaaaaaacaagtaattgttgcagaggtctctgttttgcagcttcccttttgcaagaagcactttttccaaataaaacagtaattaaaaaaaaaaaaacataggtgaacctgcaaaagtcctcgcagtgttggccaacaagattctattactgaattacttttgaaagtgaaaggcattggctgggagcggtggctcacgcctgtaatccctgcactttgggaggccgaggcaggtggatcacttgaagccagaagttggagaccagcctggccaacatggtgaaaccccgtctctactgaaaatacaaaaattagccaggcgtggtggcgggcacctgtaatcccagctactcgggaggctgaggcaggagagttgcttgaactcgggaggcggaggttgcagtgagccgagatcacgccactgcactgcagcctgggcaacagagtgagtgagactccgtctcaaaaataaaagaaaaaaaaggaaaagaaaaagaaagtgaaaggcataggatggggctcagcttattccccggacaccaaaaacattgagaatcacggcccgagcatgcttagagaaaatgtgactcacgcctgcgttttattttgttttcctgctgcatactgactacctctgaaatgttggatacaagtctgtgtctctgtagcacatttaacacgtttcccaggcaacaggaagctctcagtgtgcgttctgttgcagacgtgggcgtgtccttgggctgtgtagggcttcatttcagatgatctgaaccagagcggttgccaactgccagtgtccggagatgcctggtggccactctgtggttagtggcagtaggtggctgctacatctagttccagtgaacctcctgttgagagagtgcagctggtggtacaagccttcccttacacagcagctgtccccccagggaatatttggcagtgtcgggagacttccggttgccacactggaaggtgctactggcatctcgtggtcagaggccaggaaagctgctaaacttcctacagggcacgggaagagcccccacagaaaagattattcaggccaaagtgtcaatagtgctcaggttgagaaaccttgcctcacgcaatgaaaacggttctcacattgctttgcttcagaatgtgcaaacggaaaccccaaggctgttcagaacaggccattctgagtctgctagtccagcaagcctcgccgcaggcagagtggggaggatttggccagcgggccctcctgggacagggaagctgcgaggatgagttcggggacgccccaggcccaggggagcgaggtctggcaggattcaaggatcctggtggaagagcaggggacaattgagagggccgggcaggagaggtgaggcccgctgcgcgccgggctggcggaggagctgtgctttatcccgcagcgagaaggagctcgtgaaggctctgaggctgggagtggctggatgaaagtcgtgcttctcggccattcgttagtaatcaggatggactgcagaggaagaggcttaagaagcagggatgcggccggacaccgtggctcatgcctgtaatcccagcactttgggaggccgaggcaggcggatcatctgcggtcaagagttcaagatcagcctggccaatgtggtgaaatcctgtctctactgaaaatacaaaaattagccaggtgtggtggcgcgtgcctgtaatcccagctactcaggaggctgaggcaggagaatcgcttgaacccgggaggcagaggttgcagtgagccgagatctcaccattgcactccagcctgggtgacagaacaagactccgtctcaacaacagcaaaaaataggcagggatgtaaatgagaggtcgttgccccggcctgccatgcgggaaaagagtctgaggcagggcagtggcagggaaagaagaggaagggttgggaaacaggcagttcaaagaaagagcaggcaatctaggaaagacctaggcgtgtaagtgctggttctgggcaatggtgacggcacagccagaaataggagaagcaggaagaagtgcctctgggaggctgtggcgaaactccttcctcgcttcatttgtaaactttgttgttccttaatttttctttttttttttttttttgagacagggtctcactgtgtcactcaggctggagtgcagtggtgcgatctcggcttaccccaaccctccacctgctgggctcaggtgatcctcccacctcagcctccctagtagctggggaccacaggcacatgccaccaagcccagctaatttttgtatttttttgtagaggtggagtttctccatgttgcccaggctggtctcgaacttaaaattaaatgctaagaaaactatttcaggccagtcacggtggcccatgctgcaaccccaggaggtcgaggttgcagtgagctatgattgcaccaccagcctcagcctgggcaacagaccgaaaccctgtctcaatttaaaaaaaagagagagagaaaaaaaagctattattctagaagaatgattgaatcaattttttttttttaattttaaaatcacggctcacggcagctcgagctctgggctcaagtgatcctcccacctcatcctctcgagtagctgggactgcaggcacacaccaccatgcctgggctaactttcaatttttgtagagacagagtctgacttcgttgcccaggctgatctcaaacgctccagctcaagcgatcctcctgcctcggcctcctgaagggctgggattacaggcgtgaatcactgcgcccggccttaaagctactttttattgaacaaatactacacgccaggtgctttgctaagaagcttaaggagaggataagtaacctgtctatggccatagagctattagtaagtggcattttactttgtttttgtttgtttgtttgtttggtttggttttttgttttttttttttaagagacagagtctcgctctgtcccccaggctggagtgcagtggtgtgatctcagctcactacaagctccgcctcccaggttcacgccattctcctgcctcagcctcccgagtagctgggactacaggcgcccgccaccacacccggctaattttttgtatattttttagtagagacggggtttcaccgtgttagtcaggatggtctcgatctcctgacctcgtgatccgcccgcctcggcctcccaatgtgctgggatgacaggcgtgagcccccccgcccggcctggcattttgctttgaactcaagtgtctgactccagtgctctacactgtgctcctaagctactggaagcaaatatgcaagcatggaaataatttttggttagaaagctgggattatgggtgattactcttttttcaaattcttatttaatgttcctgttttcattattttaaaaagtagtctttgctattccagagacagtgggaaatttaatagttgctataagtatgattatattcaaaatggtcaactagacaagcatttcccaaagtctcagactcttaatcccaaggagtccttcatggaaacagagttctgtaggaagttaagttttgtgaccaggcacggtggctcacacctgtaatcccagcactttgggaggccgaggcgggtggatcacttgaggtcaggagtttgagaccagcctgcccaacatggtgaaaccctatctctacttaaaatacaaaaattagctgggcatggtggtgggtacctgtaatcccagctacctgggaggcggaggcagaagaattgcttggatccacgaggcggagcttgcagtaagccgagatcgcgccactgcaccccagcctggcgacagagtaaggctccatctcaaaaaaaaaaaaaaagttaagttttgtaaaaggtgcgttctagaccctccttttggaaatttacaatgtaaattagcagattaaaaatgtcagtatgctctgcaggaatcatcacatttaaccttaatgcatttccaaaaattcttcagctgtggaatacttttgtcccatagtgtctatttagatgcccttttggggaaattgagtttaaccagcaaagaagaggccatctcctaagaagatagtttgatggacagacccagtatcgggctatggatgctaaggaacttttcctttcctaattagagtaccaaaggcaacagttagaagacactgcaaaaccatttgtgttgaacagtcagaatctgccccaccctcaccttcataaatggaacggccctcccagggttgcctttgatgatctctcccatatccacgagtacacacacctggagtcactgtgtgtcatggttaataagagtgtgggcttagtcacgaatacctgcgtttaaatctctgctccttcacttccaggctgtgtgaccctgggagatgtgcttccttctctgagcctcgtttcctgaaaaagtctatgaaatgcagatgatgataggaattctcataggttatttctttcattcaacaaatagttacagagccgttactcctccgggcgtttgagaacagagcacaagcttgacaaggtccctgcctccgtggagtgtgcaccacaaggtggagagccgagaataagcgagtaaacagctgtgtaaatacaaatagccctgatgtgggcggaaggaggacataacgttacccggaatggagattttcacggagcagggagcagttagggaaatgaagactgggaaggactgggttggtggcgtgtgaaagggcagtttttacgctctccaagggctgatgagcacacggggctgggggtaagagaggctctagcaatggcccccgcttcccaaccacagaacattggttttggaaaaccacctgcattaatgttggctttttcctatctggactttgcctattgtctgagtttttttaattaaacatttctattataaaaatcattcaggtttagttaaaaaaaaaaaaagaaagaaagaaaatacagaacagtaaaaagagaaaaaaatcatctacagtcccacccagagacaggcacggcaaatatcttagtgtaatttccttttttttaatgccttttttttttttttttttttcagacagagtctggctctgtggcccaggctggagtgcagtggtgtgatctcagctcaatgcaacctccacctcccagttcaagcaattctcctgcctcagcctctccagtaggtgggattacaggtactcgccaccatgcctggctaatttttgtatttttggtagagatggggttccaccatgttggccaggctggtctcaaattcctgacctcaagtgatccacccgcctcggcctcccaaagtgctgggattacaggcatgagccactgtgcctagccctttctctatgtttttatttaacatttgtagaaatcatactattcctaaaattttatgttctgtttttgtaagcatgatacaaaataaatttttcacatcattgtatatttggaaaaatatgttcttttctaaaaaaaggtttatttttgttataaatacatattcattatagaataattggaaaagaaagacactagggattttcacacaccgagaaaaggccatgtggggacacagtagaaacgcggttgtcggctggacccggtggctcacgcctgtaatcccagcactttgggaggccgaggtgggcgggtcagttgaggtcagttcaagaccagcctggccaacatggcgaaaaccgtctctactagctgggcgtggtggcaggtgcctgtaatcccagctacttgggaggctgaggcaggagaatcacttaaacctgggaggtggaggctgcagtaagctaagatcagaccagtgcactccagcctgtgcgacaagagtgaaacttcgttgaaagaagagaagggggcggggcgggggggggaggagatgggaggggaggagaggggaggagaggggagaggggagggaatgggagaggggaggggaggggaggggaggagaggagagttgtctgcaagtggaggagagaggcctcaggagaaatcaaacctgctgacaccttgatcttgaactagcctccaaaactatgagaaaataaatttaagttgtttaatttttaaaaaagtgactactcagaaaagatagaaaaaagtaagtagaaaagaagacacaaatcatccatagtcccatcacccaaacataagcattgctaacttttttcagtattataggtattttcctttttttttttttttcacccaggctggagtgcagcggtgtgatcctggctcactacagccttcacctctcccggagtagctgggaccacaggcaggcgccaccacacccggctaatttctgtatttttagtagaggtggggtttcactatgttggccaggctggtcttggactcctggcctcaagtgatccgcccacctcagcttcccaaagtgctgggactaccagtgtgagccaccgtgcccagccgagggtcagcgtattttttgacaaattcacccatagtcctggttggtcctgtggtgccaccaggtgcgactgaccgagacaagagctccagctcaagtctgtaccgtggccacctttctccctgttttggtttcagcagtcatattgctcccactgagctgccctcatgttccttagtcaccaaaacacagagcagactagctaatcccttcctcgtgctcaccccgcaaggcaacaggacaatgactggagtgtggcagttttctccctttcttcctcttatctagtcaggtagcaggtgcaaaggagggtccaataactagaaaagacacttagataaatgaccacaggttcactaaggacctagaaccctttctttaaaactaacggctgcattaatgaatcacgtttgttcggaaacacatattgtgactatattcatttttttctgttagcaacggtgaggccagatgaggtctaccagtatttgtcaaagtgtctgctatcctccgaccactatcaggtgagcttgttaaaaatgcagatgactgggcccatctcagatctatggacgcacatgtctgaacgtagggcctgggcagctagctgctttttaacaactcccaaaatgactgcaatatccacgaaagtttgaaaaccttggactatagttcatgtaagaccaagcatgaggccagcgtgcgtcaggtgtccttggggtttttatttgatccgtttctcttttgttgaagttctcccctggccgagtgtggtggctcacgtctgtaatcccagcactttgggagaccagggtggaaggactgcttaagcctaggagtttgagaccagtctgggcaacgtagtgagaccccgtctctacagaaaatgttaaaaattagccggccgtggtgggggtgcacacctgtagtcccaggctacttgggaggctgaggttggaggatggtttgaacccggaaggtcaaggttgcagtgagccatgatcacaccactgccctccagcctgggcgacagagtgagaacctgtcctcctccccacaaaaaagttctctgctaatgtcctggtttcaccatataattttggtgaaatcaacttaaacagatccagaatgtcccataaattatattcggcttcaattatgttaattgatctacattcgctagtgcagcacctggcactggagatagaaaagtgaagtggggttgggcacgggggctgaggcctataatcccagcactttgcagggccaaggcgagtggatcacttgaggtgaggagttcgagaccatcctggccaacatggagaaaactatctctactaaaaatataaaaattagccgggcatagtggtgggtgtctgtaatcccagctacttgggaggctgaggcaggagaatcacttaaacccaggagatggaggttgcagtgacccaagttcacaccactgcactccagcctgggcaacagagtgaggctccgtcttaaaaaaaaaaaaaaaagaaaaagaaaaaaaaaagactatttcttaggttgaatactctaggtctaaaaaatcctcattcctgtgcacgggtgggagcctagatccagtaaggcaatttcgatccgaggaacaagcccaggccttctcccgctcagtcccggtcgtcagctctctgccttctcctcctctagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtgaggcccccggggctgccctgtggggggaactgaaaagaaggcagagaccaaggtgagaattcctctaaactcagcacgtcacttcggcaaagagtgtcctgccacgacccgcggagggccgaggtttgcaggccgacctccccttgcagttaggatcctctgcttggaaggctgtgcagtgtttgcattctaagggctgcggagacagctggagatctgctcagcccaccagccgcctcatccttgctccccgctacagtgttgccacttgaagagcttccttcagtggttcctcagagtgtgggggaaagtctcattccacagggtcacactcagctccacccttacgctgaggcttttgaaacaccctcccacaggtccttggtttgcttgacttaattagtgctttttccagctggcaacgtttaaggaacgctgcctcgaatgtgtaggttttgcctcctgtgtccttgccgcaaaaggcttccggagcctcagggtctccctcccgccctcacctgctcctgccccttctgagcaggtggtgtctgtgctgtgctgctttggtctctggatccctcgttccctggtgctggtggaaatgaccatcacctcgtgagtgccctgcctcgccccacctccaagggcccctctgctcccgctcaccaggactcgagtccgtgtccttgatcccagctgaccatgtatctggcccttcccagcttgtgctagttccgggctcttgcgctcctggctctgctcagggaatgcctcattttggcatctggcacattcctcagccagccctctgttcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggtgaggcggggccaaggtgccttccccaggagccggggagcctctcctggacccctggtccccttcaaggctctgggaattaggcgtgaataggccaaagccagtgacggaagggtgggcatcccacggccaggacccacgggcgccaccctcaggggacaggggagcagaggaaggagagctcctcaattgtcatcactgaacttcactgcaccctgcaagccttagccacacagagaaaactggacttggggccattcgcttgccccttctgcccactttggtgaatgaggttgaggtcacactcccagacctcgctccaaagacggaattcttgtctggaggtgagtgggagaccaagagggttcccagcactctcaacattctgcttttttcctctgtccccatccacttaacctggttggtgtttatgacagcagccgagcctcagcccaggagccctgtgaggagccggggcgtcttcctggggcagggggtttgtgggcccatgttcctaaccctcttccccactcaggaagaagcttcagctgctgatgttgggccctttccaatacgccttcttgaagataacgctgaccctggtgggcctgtttctcgtccccgacggcatctatgacccagcagacgtaagccgggagtaagggacagcacagtccaagactcatttagtacctttgtgttctaaaaggaatcaccagagccaacaccccttgacagagggccccagaaaagggtggctgtgggaaaacagaggctcagggactgccagggagagaaccgcaataggccaggcccccgggctttttcattaccgttcctgccgtgggagaggagagctcaaaggaagcaccaggtgccatgatgcatggctcacgaggccgaggtgggaggattgctcaagagtgggagttcaagaccagcctggacaatatagcgagatgccatttctaaaaatgtttttaaaattaggctggacatggtggctcacacctgtaatcccagcactttgggaggctgaggtgggaggatcacttgaagccaggagtttgcgaccagcttgggcaacatagtgagataccatctctttttttttttttttttgagacggagtttctcttttgtcgcccaggctggagtgcagtagcgcatctcggctcactgcaacctccgcctcccgggtttaagtgattctcctacctcagcctcctgagtagctgggattacaggcatgcaccaccacccccggctaattttgtatttttcatagagatggggtttctccatgttggtcaggctggtcttgaacacctgacctcaggtgatccgcccgcctctgcctcccaaagtgctgggattataggcgtgagccaccacgcctggcccatctctattattaaaaaaaaaaaaaagttagctgggaatggtggtgtgcacctgtagtcccagctactcagaagcctgaggcgaggggatcactggagccaggagtgtgatgctgcagtgagctatcattgcacctctgcactttcagctgggtgacagagtgacaccatctcttgaaagagagagagagagagagagagcttgcctgcctcactgactactttctgttgccaccagatttctgaggggagcacagctctatggatcaacactttccttggcgtgtccacactgctggctctctggaccctgggcatcatttcccgtcaagccaggctacacctgggtgagcagaacatgggagccaaatttgctctgttccaggtaactataccctgggagagaaaagatgtttcataaccgagctacagatagttggggttagtaagtgaggccaataaaggctaaagtgggccgggaatctttttcataagcctcacgtctctcatgagatttggaaaatgattcctgtgcttcccgcttttgtctttctgtgctggaattgtttcccagggctgccatgacaaaataccacaaatcagatggcttaaaacaacagacatgtcttgtctcattgtgctggaggctagaagtccacagcgaaggagccagcagggccctgctccctttgagccctgcagggggtcccagcctctccctagtttcctagttgccagcagtcctggaccatccttgaccagcatttgcgtcactcccatttctgcctccattatctcgttatattctccccttgtgtttctgtgtgtcttctatttttttttttttttttgagacagagtcttggtctgttgcccaggctggagtgcagtggtgccatctcaggttaagcaattctcttgcctcagcctcccaagtagctgggattacaggcatgtaccaccacgcccggctaattttgcatttttagtagagacggggtttcgctatgttggccaggctggtctcaaactcctgacctcaggtgatccacccgcctcagcctcccaaagtattgggattataggcgtgagccactgtgcccctccatctcatctatttttaggacaccagtcaaattggattaagggcccaccctattccattatgacctcatcttaactaattacatttgtaacaaactgttcttaaataaggtcacgagtaccggggggcaggacttcaacatagctttttggggacacaatttaacctgtaacacgtgtgttagttaacaaaccttacatttgtctccttgcttcttcctttccttttctacctatgacttcctaaaatcctataacccatcaacaccagcagaagcattagcattagctacaggacctacctacaccatgtgccgggcactttcacacattacacttcaattttcacaaccccaggagtcatttttcccattttacaaaggaagaaacagacccagagatgttcttgctcaaaggcacataaggaacggggctagaatttatacccaggtatgtcttgactcctccacacatctgtcttctccttaccctgcccttcatcttcacaacgcttctgaaaattctctcaaaggcatgttggcccaccttctacgtgctgccttctctaacctcaaagatgacttttccaccaaatgcaatgacttctaacccagtcttgttctccttctctctccatcctgtctccttgctggtcttctactcccaaggcataatgactgccctacagtttaacagagtgagttcacgtacattctcatttgatctacgtacatgcctcccaaatgtgaacttccaggcacataggaggtagaatgaaaggggctatgggaatagagagagaagtccccggaatgagtcagggactgaaggggcagaaaggttctgggtcccagaagtacttgagaccaggccgaaagataaaagccgtgtgatggccgagcctgcccatggttaatgtgggggagcctgggtgagccacgccagccttgaagaagctgaggtttccacacaatgtactcagggagggcaatactaagataaatggtgcttccagggcttctggacagtgatcttcttcttctccccttttgccttctttatttggtgaaatattgataaaatttgccattaatgattttgaagtgtcaggttctgtggcattaagtacattcccatagttgcactaccattaccaccgtccatctccaggcacccattaaacacattccccattgccctctccctgcagtctctgggatggcagagcttccaaagggcattttaatggttaattgtccattattctaggagcagggacctcaggcacttgagctagatggaatgactcttctctaatcacccatctctttatccattgagtgctcattggtagccatggctgagaaagggaattaaaaatgaaccctttaatcagttcttatatcttgtcagaaactctaataaactactgggtagaaaataagaatgtcatttgcctaaagatgaaaatcccacagatttttaatgaagtgagagcctcaaccctctgtgactgcacagatctgacggtgggtggaacctgcccagcggaagggcaaggcccggcagtgggctggctgcgttctgtgccgtgagggcaggcccagtccacccttgcctctcttttatgttccgcaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaataccacctctgtaactcagcataacctacgctgtatttcaccctacactgcagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaactgggcaccttgcctctgtccatgtcactattaacccttcaaggttgtatattgctggctaggtgcgacagctcatgcctgctatcccagcactttgggagcctgaggcgggaggatcacttgagcccaggaggttgaggctgcagtgagcaatggttgtgccatacactccagcctgggtgatacagccagaccctgcctctggaaaaaaaagaaagcttactgagctttcctaaagcagatgaaaagaagagtatatagtattgtgtctggcataagaaaaggagaacttggtgaggtgaaatagcaccagcccagagtcttgaagaagccaggggccctggagaacagatggaaggtgacctttccctgacaggtgtgctactacggcaccaaccacgcggggccctggtggtctgggtcagcctcactttgtgggacaatggcttttgagtcttcagtgacaagctagaaaaggaatctcctgacactgtggtcatggagcttgatttctaaggagagagtcagcacgtggaagcaaaggcaccgagagtccaagtaaaagtcccaaatccataaaatgcaccacacaggtcaaaacacaggacacggccgggcgcgggggctcacgcctgtaatcccagcactttgggaggccgaggcaggtggctcacctgaggtcaggaattcgagaccagcctgctcaacatggagaaaccccatctctactaaaaacactaattagccaggcgtggtggcgcatgcctgtaatcccagctacttggcaggctgaagcaggagaatcgcttgaacctgggaggcggaggctgcagtgagccgagattgcgccactgcactccagcctgggcaagaagagcaaaactccgtctcaaaaaaaataaaaataaaaaataaaaacaccactggacatggaacatcaggtaaaaccacactgcctttatttggctaaagaacaaaatccaaaataactcagaacaaactaagaacagacaggaaaattacagactgaaccccacttgaggaagacttccccacggactcacactggtgatggggcgaacgttcaagacgaagccagcagtcctttccaagactcttttgtcttttagggatcctcaatacaaaacaacccaactaatccaggatatgtgttcaaaacagtcagttttccccctcaaaaggcgggaaggcccacttcaaacctccaggaacacaacccaagtcatcccagtgttaaacctggtgcttccgttttctgcctcaatccgagcgctaacataaaatcttggcagacaacaatctttcttcttcaagaaaattaacatttaatggtataatcccaagaacatgttctacttatttacttggaaaaatagaagctagggaccactctttatccgatggcagtctattctatgagagaaaacaagaacaatcattgttatgactttgaaaaatagaacctttaaaaatacttatattggtaagcttaaaaaaatatcatcagttaaaaacattaagggggctttctttttctacctgtattggttcaacttctggtgagaatgtgtgctgatagaaaatctagaagctatggcttttagggaattaaagaaaagcagcaaaatataattgatttggaaagattttggataagtgatctggaacaggattaaaaaggcaaagagctcttgaaaataagctacccatagtcaaaataatccaggaagggggaatgacgccctatgaaccactgtggaaagaacatctagagatggtctgaccagctgtgcagcctccaaaaaaaaatcactatcgctcaggtgcagccccccaaaaaccaccatcactcaggtacagcctccaaaaacaccaccatcactcaggtgcagcctaaggagtcatcagtgatcagaaagtggctaagtttccttagcctccctcatattttttctcttcttcaggattttcaacctcctcacatccctaactttcttacccaagcctcagcaatataatggtctttggctctagctatcagcaatagctgcaagagcacaaatgatcccttcctagtcctctaaagtgtcaacctccattcttcagtgcttctgaatctagcataagaccaagctttccgtccggcccaccggaaggcagtggctgcgccggcacctccccggctctggccttctaatgtctcacacacagaggctctgctctaaggccaacacttctggctctctcatcttggccacatttggcccacccatgttgactgctttctcgtgtgtgattcagggaaacagctccatagcctcaaacgttaatatctgaagatttagatcccaggcattgtggtggtgtgcacacctctaacctcatttaattaggcacagatgaccacattatgcaacttcccaacagctttctccatctacccgtgctagtccagcacctcagaccacatttaccccaaagtatctaacaggccacactataaaagattttagctttcagtcagacaaatagctttcagtcaaaacgattagactgaggtggtagaagctcaccaaaaggggaaagggagtttcccaataacatgtacgtttgctggccctagcagtctcagaggcctgtcagcctgcaggtcccgttccaagcacagggcatgccaagagcagcccactgagagcagaggaagagggctcaaacatttgggacccagacaatatatttaggaggtatggctccaatagggagggaggaggaaaaccacgttccgggcatctccctgtctatccaaatacacttgcataatgtgcacttggaggaaccaagcagatgggcttcagcacagacttcactgccacaccacaccagggagaataagttagacagaaacaggcagcattcccaaagagagaaggctgacgcagaaaagttcaaagatgagactatgtaacactgggtaacacaggaaaacactaacttcagctgtttcaaagacagacaggattccaagccaaagcttgtatgaccagatttaagagtaagaactgcgcttcaaagaagagttagaaatgtcgttgtcataggcgatcaggataacaagaggcttcattctccctcgcctctgtgacgctctttctgggtgatccaagttttgttttttttctagttgattatttctctttatttctgtatgtgtgtgtggtttttgttttgttttggagacagagtctcgctctgtcacccaggctggactgcagcggcaccatctctgctcactgcaacctccgcctcctgggttcaagggattctcctgcctcagcctcccaagtagctgggattacaggtgcccaccaccacgcctggctaatttttgtatttttagtagagatggggtttcaccacgttggtcaggctggtctcaaactcgtggcctcaagtgatccaccagcctcagtctcccaaagtgctgagatgacaggcgtgagccaccacgccttgcctgggtgatccaagttttaagaaccaaggtagtcctgctgtgcaggcaatgattctagcctctgaccctcaggcggaaaactaggtgttaccagaaagtgtttagggagtggactatgagatgctcacagtcctagcagaggcaaggaaagagaaaatgtggttttcttagctgaaaacactaaaattccacccccacaaggggtatttatgagtgacaggggtggggcctggacataagcaattttcccctggatctagccacaggattactgatgggtgatgatctgctaggccgcgtagctaagcagctaaggagacaggaggccagggctttaaaagttagagcatgctcaacagcaagtgctaagcattagcattctttgatttgaaagtcaagtgttgaatccccccgggcaagccaacaaggcagatggaaccacaaccaccaggcgtgtgtgaaaagtggggagaaaacctaccacactcttgtcacgtgagggtatgctctgtggcttgctggaggagcagcagagggaggtccctgccagctgcagctctcagaggaaaagaaagatgtggagcactggttccagggaagaatgttctgaagagggacagaggtcaaggtgataaggctgttgctttagaaaggaaggtgtttcctatgcttttgcctttacattctgtgcaaatctctctaatatggctatgaccaaaatggattaacatcaagttccaacagcagacatttacaaagtatcctttgtaaaaggctaggtaatattaatagcattcaaataggagtagcagggccaggcacttactcccagtaggaaactaatctcaatcgacttggtataggattgagtattgtcccgctcctctcctcatcattgtaactctaaaagtgttccttccttcgaaggtagatggcacgaaagagactgacaaaagctcccaaagaactgggtcacagagttttctgagaagatgaacacagcagaaacactgcagttgatgccatgggtctgcttccatccccatcagtgtcttcatggaccccattgggtccaacaagaaactcctcagggagtaagaaaagttaggttcagatctccttcccgcagccacaatgacactggtgacagcagtacgttcaggggatttgtgactgtaactctgcttttcgcttttccttaaggaaatcaaaattaagatatttctccacaaattacccatcagcgtggctcatttcgtgaaggacttggcaagccacatagcttcagaacggaaggcaaatgctatagtataccgggaagaaaaggcctctgcgtattacactacctccttcttctgcccactcctcaggggcaaaaaattagttctacatttgaaagacgaattttttaaaaaattaatgaaaatgacaatttccctgttgagatcacgtgaacataaacagtgaaacaaagcccttgggggggggtaaatggatgcagagcaggcttctaaggtgcagtccccctccttcgtgtgggtgagtgatgtcacttgcaggacaggctgtttgggttcccccagtcctaggtcttctttccccagttgtctttcctttgtagctgtccttaggtttagtgttggggtcacaatttggaattcaacagagagcttctgaaggtaatgggacagaaagggaggacaggaaaggagggaggaaacattagtcttcttcatcctcactgatatcataggctgcagccttgtgcctggagagatttgctggggagcaaggtggggaagtcttgccggagaagggccatcggaaagagggggagggggagcgctcgcgagtagggctgctgctggggctctgcttcgggctgatggcctgcagcatccggcccttcccctctttcagcatatgtttctgcagaaaccgaaaggaagagtcagaaaaacaccgtggatcctacttaatcatcactgaagcatctaggactgggatagtctatgctgtactatttatttaagggttctcccctgctgtcatcacccgggaaattccccattcttcctcaataatctagtctaggattattctaatttatccaaacaccttcacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaaggtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcactttcttctttactttgtcaaccctctcctgcaagtggtatttcttctcctagataaagaaataactcttctgagaaataatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaataaaaatataaaaaataagctgggtatggtggcctgtgcctgtagtcccagctactcaggaggctgagatgggaggagcacttgagcccggaggtcaaggctgcagtaagccaagattgcgccactgtactctggcctggatgactgagtgtgactctatctcaaaaaaagaaaaagaaaagtactctcaaaatttccagatcataaagagaaaagggattatgtttagaatttttaaacacctgatttttatgggaaaaataaagctatagtaagtaaattaacaagagctagggtttatctgcctagataaatcatatttagatgtaatcattttatccattcttatagcacaatttacagagatgggagtaggtcagggagcatggtaaactggttatgtagaagacattaaagttagcagctttcttctttttaaatcgattttattgaggtctaatttacatacaaaatgtatagtgttggctggatacggtggctcatgcctgtaatcccagcactttgcgaggccaagggggtccgatcgcttgaggccaggagtttgagaccagcctggcaaacatggcaaaaccccatctctgctaaaaaaaaaaaaaaaaaaaaaaaaaaaaaaaattagccaggcctggtggcacatgcctgtaatcacagctattcaggaggctaaggcaccaggagacagaggctgcagtgagccgagatcacgccactgcactccagcctcggtgacagagcgagaccctgtctcaaaaagaaagaaacactacatatatatatatttgcatgaatttttttagtttttttgtttgtctgtttgtttagagatggggtctcgctatgttgcccccagactggtctcaaactcctggcctcaagcagtcctcccgcctcagcctcccaaagtacaggcatgaactaccatgcccagaaaaatatatagagtttctaaaaggcaatattaagctaagataaacttaactttcgtcaatccaaatttaaaactcaggtctgtgtgggaagtggtgtgtcgggtgtcactatccacacgaggagggctcatagcctttcgcaggttcccaagacatcatccaaccgaagaagagagaggaagtttaagagacaccgttttccatttattgacagaaatactgcactatataaattactcatttatttagttggctgtatggctttatacgaatgtgttggtaccagaccgtaacggcagaaactgtctgtttcattctttttgtgaacagttaacatagtggtaattcattcactgaacttttgggagtgatcatcaaagccaactgcaaagccagttcagctgagatggagtgggaggtgatatgtctcctacagagtcagggaactctggggtaaggctggaactcacgttgataaagctgacattgagctcctttgctgtgtagcccctctgcaggttccgcctcgcatacacatcataatcccgcacaattcgggtgatgatgtctgatgtggagataccttctgtcctctgtgttggagcaaacatgcctaactcagaaacacatacagacaaacactgtgaggttctggttagctcaggtattaagactaaatggaaattgggggcaacattcctttcctttcctcaaaaagcagaatctgttattactaaatgaaactgaaagatactgatatacagaaggtagaccgaatcaaaggccagaggtaaggcaaagaagagttacatagccctaatattaagaaaaatatgagaaagggtttcctgaaattaagagagatatccaaagtagatgtttagaccaagaattgatggatgtcatgaactgacgacaaagaattgatgggtgctatgctcatctttaccttttatccaaaatgtggcctgaaagaggatgttgaatttctaatgtacacattttcctctgtaaagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaattagccaggcatggtggcgggcgcttgtagtcccagctacttgggaggctgaggcaggagaattgcttgaacccaggaggcagaggctacagtgagccaaaatcgcaccactgcactccagcctgggtgacaaagcaagactctgtctcaaaaaaaaaaaaagtatgagaaagaggttacttctttcttaactagtttctctcagtccgtgagaaaagagggaatataaaaatagcaaccacgagccctctgactggaatagatacatctattggcctgagaaatacaaaccgaaggccataagagaagttttctccctctcccctctcccttctcccctctcccctctccctctccccacggtctccctctccctctctttctatggtctccctctgatgccgagcggaagctggactgtactgccgccatctctgctcactgcaacctccctgcctgattctcctgcctcagcctgcccagtgcctgccattgcaggcgcacgccgccacgcctgactggttttcgtatttttttggtggagacagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaagttttatcctcaggatctatcatttcactacttttttttttttttttgagaccgagtctcgctctgtcgcccaggctggagtgtagtggcacagtctcggctcactgaaacctctgcctcctggattcaagcgattctcctgcctcagcctcccgagtagctgggactacaggcgcatgtcaccccgcctggttaatctttgcatttttagtagacagggtttcaccgtgttggccaggctggtcacgaactcctgacctcaagtgatccacctgacttggcctcccaaagtgctgggattacaggcgtgagccacagcgcctggccattttactgctatgaatatcctttgcaagggcaagaagagatgaatgatactggggatcaataatgttgttcggaggcgtgctaaacttcacttactccttcctgtatgggccaccagccttttgctgataattactaagatcactataccatccccgagagaccactgtagtgtgaagcatgttcattgggactatgtcagagactctcagccagcatctcaattactcatgaacaacttgtcagggatccataggcagcaaagtaaagaataggaggccgggtggatcacctgaggtcaggagttcaagaccagcctggccaaaacggcgaaacactgcctctactaaaaatacaagaaattagccgggcatggtggcgcgcacctgtaatcccagctactcgggaggctgaggcaggcgaatcacttgaacccgggaggcggaggttgcggtgatccgagatcacgccattgcactccagcctgggcaacagagcaaaactctgtctcaaaaaaaaaaaaaaaaagaatgggacaagcaaaactcaaggttgagtatatattgttaacaaagagaaaaggggagttagaaattcctctaacttcatacttctgtctgggcctgtgggctgtggtgctgagaataaacttgcttaccacctttggtgccactggctgctaggtgttgatgtagaaaagccagagaattataaaaggtctgtcctaatcctcaatagttttaataaatatcccctcttcaggcctacccacgtattgctttagaagcactttggctgccttcattctttctgcctcactgaacaatttacctacaacattccacgcgcccctgtagagaactgacaacatgcttgctatttcctcaggcttgggggcctctaacctggcctaatcaatccttctcatcttttgtacccaccttttgcaggaaacctgtggcttttttttttttaaagtagagacagggtctcggtatgttgcccaggctggtcttgagctcctgggctcaagcgatcctcccaccttggcctcccaaagtgcttggattacaggcgtgagccactgcacctggctgaaatctgttactttaatgtgggagaattaaaaggaggtaaggggttgataataacttactgagaaacagtgagaaatatccttgatttctgattccacccaatttctagcataagatcaaagccctgaaatgaaacttaagccaagaaaagtctatgttaatccgtcttatttcctggtaatgtgaccgtcttcagagttcacctggggctatggatattctcaggagactggcatgttctaagggtagatgtgcctatggtgtggggggaaggtctcgtaactggtgagttcagttcccagccctgccagtggtgtaacttgtggcgagttcagttcccagccctgccagtggtgtaatttgtggcgagttcagttcccagccctgccagtggtgtaacttgtggcgagttcagttcccagccctgccagtggtgtaacttgtggcgagttcagttcccagccctgccagtggtgtaacttgtggcgagttcagttcccagccctgccaatggtgtaacttggagcaggttatttggtttctctagcccttgttactcatatgtaaagcggaaatgacaaacacaccacaggattgctgtgggcagaaaatggaatagaatggatgtaaaagtgcttgcaaaccatccagccccatataaacgtcaggggtgactgttatcactagtaatatcactgtcatctcctacgaaacttacataagaggtagaagtaaaacacggctagtggaaaaccagcctacgtgccagcagctttgagagttgaggggattctgaaacaaggaatgggaatatgtgtccagtttcttacccggtgttcggccaggaactcgggtgtcagcgtccagggcgcattcctcaccacctcatccacgtagcggcagtgctggactgcgtcatagcgctcattctcgttcatcaccgtgaagcctttgaagttgtgtgtgagctcatcactgcaaactggttcaccacatcataaattgtgtgttggagtcctctttgcttagcacctcctcagccaccgacctctcccatcttctcccactgcttaggactgcaaccatcttccccaactggaaaaaagtcttctaaaggtggttgaacctgggtgataacgcttttcctaatgcagcgtataccttcaggagcaacactcactaaacagtatgttcatactttggagaagggacagtacaacaggtgaccaagatctttgactctgaaataaacctgctgtgcgtgtctgcatcaattaagtccttaaacatgttttcctgttttattcacactggactggaccacctaacatttccttggcagacttttgtactccagttaattcaaaatgataaactgaaatctaaagcaaatgttttaaagtggacaacggaagtcacggctgctcctgtgaccacagaaactcagctacaagcagtgaataaatgccagatggcacagtcgaggagcttgaagctcctctctccaggtttagtttgctggtacccatatacttcatgtgtgttagagaggctgtactacatccttcatttaaaaatggaaacaagagccagtgtactcagctgagaaagacagactgtactatcatctttttctgcacagcacctgaagtcaccaaatgttttcttacctcccacaatgaggtacgtattagggaaaaggttcttcgcttgcatcagagctcgggcgtgaccagagtgaaataagtcaaatattccatcggcataaactctcacaggtcgctcacctaaatccaaatgaaagaattgatcacaaaaatacctttttttttgtcatttttatttttatttttgaggccgagtctcactctgtcacccaggctggagtgcagtggcgtgatctcggctcactgcaacttccgcctcctgggttcaagtgattctcctgcctcagcctcccaagcagctgggattacaggtgcatgtcatcacgcctgcctaatttttgtgtttttagtagagatggggtttttccttgttggccaggctggtctcgaattcctggtctcaaatgacccgccagcctcagcctcccaaagtgctgggattacaggtgtgaaccaccatgccaagccacaaaaatacattgattcgatatcttgtacttggcaaatggaactggctctgtgtgacagttccatgactgtatactcctttctttttttttatttttttcttgagacggaatctcgctccatcacccagactggagtgcagtggcacgatctcggctcactacaacctgcaactcccggattcaagcgactctcctgcctccgcctcctgagtagctggaactacaggcgcccaccaccaagcccagctaattttttgtattattttttagtagagatggggtttcacagtgttagacaggatggtctcgatctcctgacctcgtgatccacccgcctaagcctcccaaagtgctgggattacaggtgtgagcaaccgcgcccggcccaactgcatactcctttctttaggtgttctctgggtattcaccctgattttaggggtaggttgggttatgaaaaatgactataaagaccttttcattttttttttgagacagggtctcactctgtcatccagcctggagtgcactgatgtggtcacagctcacggcagccttgacctcctgggctcaagtgatcctcccatctcagcctcccaagtagatgggaccacagatggacaccaccatgcccagctaattttttttttttttttttgtagagaccatgttgcccaggctggtctcgaactcctggactcaagcaatcccaccttggcctcccaaaatgctgggattccaggtgtgagccaccatgctcagcctataaagagatttttgacatcatcatctgcactaactgcctctgttagcctggttgtaccaaacttttcaggcacaacaaataacagagaactgtcaacttagaagccaggaaatgatttcccggggaacaagactaattccaaagtgaaataaacattaaaaacagaatcagcataatggtccatcatgctttaaataataaatctaaggagtccatgtaacttattccctttctgtgaataaaggaagagctattttactgcagcagaaactgacaggagcatttacatcatttgggaaagataggtcaaagtgtcatcagatacactatgctgaggttgaggatcagatacaccatgccgaggctgaggaccagatacactatgctgaggctgaggaccagatacactatgctgaggctgaggaccagatacactatgctgaggctgaggaccagatacactatgctgaggctgaggaccagatacactatactgaggctgaggaccagatacaccatgctgaggttgagtaccacatacactatgctgaggatcaggtacaccatgccgaggctgaggaccagatacaccatgccgaggctgaggaccagatacaccatgccgaggctgaggaccagatacaccatgccgaggctgaggaccaggtacaccatgccgaggctgaggaccaggtacaccatgccgaggctgaggaccaggtacaccatgccgaggctgaggaccaggtacaccatgccgaggcagaggaccaggtacaccatgccgaggctgaggaccaggtacaccatgccgaggctgaggaccagatacaccatgccgaggcgaggaccagatacactatgctgaggctgaggatcagatacactatgctgaggatcagatacactatgctgaggctgaggatcagatacactatgctgaggctgaggaccagatacactatgctgaggctgaggatcagatacactatgctgaggatcagatacactatgctgaggctgaggatcagatacactatgctgaggctgaggaccagatacactatgctgaggaccagatacactatgctgaggctgaggatcagatacactatgctgaggttgaggaccagatacactatgctgaggctgaggatcagatacactatgctgaggaccagatacactatgctgaggctgaggatcagatacactatgttgaggttgaggatcagatacaccatgctgaggttgaggatcagatacactatgctgaggctgaggatcagatacactatgctgaggctgaggatcagatatattatgccgaggttgaggaccagatacactatgctgaggatcagatacactatgctgaggttgaggaccagatacactatgctgaggatcagatacaccatgctgaggttgaggatcagatacactatgctgaggctgaggaccagatacaccatgctgaggctgaggaccagatacactatgctgaggatcagatacactatgctgaggttgaggaccagataccctatgctgaggctgaggaccagatacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagatacaccatgctgaggttgaggaccagatacaccatgctgaggttgaggatcagatacactatgctgaggctgaggaccagatacactatgctgaggctgaggatcagatacaccatgctgaggttgaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgcagtactgtttataatagcaacagtcaggaaacgacctacatttcaacggaagattgaatatagcataatacacccactaaaaggtgggaggatatataaacaatttacttagatattcacagaaatgggtaatattggtggcctgttatagggataccaggtggctgtgagacaggtcttgagagggagacattttactttatgccctttttgtattttatggatattaaactgtgggaatgtattgatttcacttgatttgattttttgagacagggtctggctctgtcaccctggctggagtgcagtggcatggtctcagatcactgaaacctccacctcccaggctcaaatgatcctcccgcctcagcctcccgagaagctgggactacagcgcacaccaccacgccccgctgactacagcgcaccccgccacgccccgcagactacagcgcaccccgccacgccccactggctacagtgcacaccgccacgccccactggctacagcgcacaccactacgctcagctgatttttgtattttttgtacagatggggtttcacatgttgcccaagctagttgtatttttatttatttatttatttgagatggagtcttgctctgttgcccaggctggagtgtggtgacatgatctaggctcactgcaacctctgcctcctgggttcaagtgactatcctgcctcagcctcccaagtcactgggattacaggcgaaagccaccaagccgggataatttttgtatttttatattcgtatcccatgttggccaggctggtctcaatttcctgacctcaagtgatctgcccgccttggcctcccgaagttctgggattacgggcgtgagccaccatgcccagcccaggctggttgtattgattttataatacaggaaataaaaattttaaattaaatataccaatccaatgaaaaactaagaattaattaatggatttaagagtcagaaaggtcatagctcaagctttgaccaagctttccaaccagctttcttcctctgtaaccttaacttccttatgcctcagttttctcatctatgagagaaagcaggctgggtacagtagctcacacctgtaattccagcaccttgggagaccaaggtaggaggactgcttgagcccaggagtctgagaccagcctgggcaacacagtgaaaccctatctctattaaaattattttttactgccagcatgtgtcaactaaaaaaaaagaagaaaaaaatatttttaaaaagataatttttaataagacaaagcaaaataaaacaaaatttgagcatataatcccccttctatgtcccagaaatcactgcattggctctatgcctattaaaaaataatacattaaaaagatttttgggccgggcacagtggctcacgcctgtaatcccagcactttgggaggccaaggcaggtggatcacctgaggtcagcagttgaggccagcctggccaacatggtgaaaccctgtgtctactaaaaatacaaaaattagctgggtatggtggtgggcgcctgtaatcccagctactcgggaggctgaggcaggagaatctcttgaacccaggaggcagaggttgcagtgagctgagatcgcgccactgcactccagcctgcgagacagagcaagactctgtctcaaaaaaaaaaaaaattgaagtatcccagaagtcacgtccatgaagtaactaacatagttccattttccctaaacaagtccagaggggctatgatctcacactattcgatcctgaaacacaagggatagaatatacaaatgaagactactttgttgtttctttgctactagacagcatacagcagggaaattttgctcaagaaacacattgcctggatggtggcaatagcacagaatgctgttgatcaagtggctgcttgcagcacagctaatcatcctatgttaggccaagtagatcactgaaccttttctcagaccaatcccagatgcgcctcttgctctctccagtgcttccccagcctaccaacatctcaactggccaccattccatcccaagtctttggcaaacccaggctgatatattaaccaaacggccagaaggggtcactgttgaactagtctgggaagaaagctagcgttagccattcttttaccaagtggctattggccaggataaacacacccctgatttaatgtatgttatagtatatataatcatatttatataaattatatacttttaatataatttttcctgtttctattatataatgtactatataatacatatttaatatcatttatatattatgcatatattacatatgtatatatgttatatagatagatagatagattttttttttttgagacggagtctcactctgtcgcccaggctagagtgcagtgacgtgacctaggctcactgcaacctctgcctcccaggctcaagtgattctcctgtctcagcctcctgaatagctgggattacaggtgtgtgccaccacgcctggctaattttttatatttttagtagagacggggtttcaccatgttagccaggatggtctcgatctcctgaccttatgatccacccacctcagctttccaaagtgctgggattacaggtgtgagtcactgtacctggcctatatatatatttttttaatttttatttatgtatttatttattttttaagatagggtctctgtcacccaggctgaagtgcagtggtgcaatcatgacttgccgtggtctagacctcctgggctcaaacaatcctctcacctcagcctcctgagtggctgggactatagatgcacaccaccacacctggctaattattaaaatttttgtagagatgggatctcactgtattgcccaggctggccttgaattcctagcctcaagcaatccttctgccttggcctcccaaagtgctgggattataggcatgagccaccacactcaacctctgtatattattaacagcaactccctttcatgctcaaaaccgtcctgatttggatgataaattatatggtttatgtgggttatgaattatacgctgcaccactggtgactaagtaaccatatgtcctcctttaggcagaagaaacctgggtttcagttaatgatctcttttgatagatttactctcccaaatacctaccaccgaaacattctgttcctaacatttccattgcccttcacactctcccttttccttcctttctctgagttaaacatattgctgatttttttcatctcccaaaagattcctagagctgaccttcttgtctctcaaatcatatttgtttttctctaagtagagaatcttctcctagattatacaacctccctcgtaaaaacctggggagcaggagggaggtgttgaaacttcactagagcaggtgcattctttattgctttattccttgtcctgcactggcatgaatgcagttacctacttggtgatttaacataaaacagtcagacaaaatgagatctaagagaaaaaccagagttcaaattaagctggcaaatttataggctaatttgtggctgtttgttccaccaaaaatacaattattttgctgaaggccttctattctaatgcttacaatgagtagcaccattcccgggtgaggtttgagctgcaattctattccactaatcatccgttttactgtaggggaagccttcgcttcttggttactatggaccttaattgctttatgtacttaatgaagaaactataaagtagataatcttgaaaatgacttatttgtaaaatcctataattctaaaattaaaaacaattataccagtcaggacttgttaattataagctttaaaacttggaaacaggcccggcacggtggctcactcctgtaatcccagctacttgggaggctgagatttgagaactgcttgaacccagaagggaaatgttgcagtgagctgagatcacaccaccgcactccagcctggttgacaagcgagactctgtctcaaaaacaaaacaaaacaaaagatcaacttggaaacagtacacatattttcaaattttatgtaccacaaatgatatatagacaaattagcaacaaactggataatgcaacccatcagatcaaatctaaatgaatagctgattgtaaatgtgtgtcattagagagtatgtaaaaagttcttgctttcaatagcctctactatcacatctgaatgtgaaccctgaactatcttctggcgttttgaagttagacctggctaccattacacaatccatagtctctggttttctttgtcattttaccctgcctccaggagcctacctattacccaaataagggaagccaaactcaaaaatcttatcatgaatcagaaggttgtgatcaatatgaactatatctacacattttttcaaaaggaaaggattctctggaattagcctcttttttgttgaggaccccaaacccacaatacatatacccaagataaggccaaaggataggtgttaaaattcccggcattggccggcgcggtggctcacgcctgcaatcccagcactttgggaggctgaggtgggtggatcacgaggtcaggagttcgaggccagcctggccaacatggtgaaaccccgtctctactaaaaatacaaaaattagccaggcgtggtggtgcacacctgtaatcccagctactcgggaggctggggcagaagaattgcttgaacccgggaggaggaggttgcactgagccaagattgtgccactgcatgccagcctgggcaacagagtgagactctgcctcaaaagaaaaaaaaatttcccagtatgacactgtacatcacttctatttgttttttgtttgtttgttttgagacagggtctcgctctgtcacccaggctggagtacagtggcatgatctcagctcactgcaatctctgcctcccaggttcacataattctcgtgccttagcctcccgagtagctgggactacaggtgcccaccaccacgcccagctaacttttgtatttttagtagagaaggggtttcaccatgttaaccaggctggtctcgaactcctgacatcaagtgatgatctgcccgccttggtgtccaaagtgctgggattacaggtgtgagccaccactcctggcccacttctatttgtatttcactgttcttcagttactacagagagcaaacataccaacacaattaagaagtaaccacaaatatactgtatatgctgcaaatgcacagatttgtggctataaatccctcttattccctggtgtctgtctgagtcttagttcagtcctatatttacagggtagagagaacacttagtaatcagaagaagtgaaaaaggattggaaaaaaagggagaattggggaatttacagagaagaaagaatatttgcctataggactttgtattcataacaaatgctcttggaagtttctttttataatgatctctaaaaccaattgccccacataagaaaagcatctcgaatatatattagtaatttatgtgtcaaaaactgctaattaattatgtaaattaagcatgcaaataaagagcaagggctttgaaaataaagtattttttaaaacctggaaaattataatatcagtaaaaataaaattaagtgacgagcatctcccaacttgggatatttttgtcctctatcaatcggcagcatcatagccagctgacagaacgtagagaggtggtggggaattctgaaggctatgaagaatgtgacaccctgacacatgatttggactttatagaaatagataagatcataactcagctcaagctaatataatatcatattgtttctgttttactgtatctcacagctacaacagcagcccaggaaacaggtgcataataataagaaaaaaaatgaaagtttatggagtggagttacccttctaaatagaacatcaagacaggtgagaagaaccccttcgctgctggcctttgcaagtaaacagagggcagtatatagagagcaggtgtgtatttgataaagacaatggaatgctaaaaacaatagtcaaacaacaaattaagaaggtatttacttacaaggagttcctctgctggcttcttccatagttaccctgacatagggcttactaaagtcaacttcaatttcatcagaaaaaggagctggttgccgtaagcccttaagaaatggaaagtgaaggaaaagaaagttcaactcaatggcatacactgtaatactaaaaaaaaaaaagatgagagaaaggagattgatctctctattatagatggcttcgtttaagagatttcgttattcccgcctgtaatcccagcactttgggaggccgaggtgggtggatcatgaggtcaggagattgagacaatcctggctaacatggtgaaaccaggtctctactaaagatacagaaaattagcctggtgtggtggcaggcacctgtaatcccagctactcaggaggctgaggcaggagaatcgcttgaacccgggaggcagaggttgcagtgagccaagatcagaccattgcactccagcctagcccacagggcaagactccacctcaaaaaaaaaaaaaaaagagtttttgttattcctatgtattttattctacttgatgctgttgtgaatggaattgttttctgaattttatttttggattgttccttgatattatgtaacagtgcaattgatttgtatttgtgtttgtgtaactgaaattttctgtatattgatcttatgtcctataactttgctaaagttaattatcagttctagtatccgttgttgtttcatggattccttagcattttctacatataatatcatgtcatctgtgaatatagttttgcttattcttttccaatctggatttttttttttttttgagagggtccagctctgttgcccaggctggagtgcactggcgccatttcagctcactgcaacctccaactccccgactcaagtgatcctcccacctcagcctcccgagtagctgggactacaggcatacactacccgacacccagctgattttttattcttgtagagacaaggtctcactacgtgcctaggctggtctcaaactcctggcctcaagcaatcattccaccttggcctcccaaagtgctgggattacaggcgtgagccaccgtgcccagcctctggcctgggatttttaactatagtttgtttcttgtgatgtttatgtctggctttgatatctggcctcacaaaataagttgtgaagtgttctctttaccttatttttgtgtaagattcgtattatttattccttaaatgtttttgtggtttttgtaaagacactctgtcaccgaggctagagtgcagcggcacgatcatagctctctgcagcctccaactctggggctcaagcaattctctcacctcagcttccctaatagctgggactacaggcatgcaccaccacacccagctaattttttaactttgggcctggacctgtctttgtgagaagatttttaatgactaattccttttttttcttttttaacttgatataagtctattaagattttctcctttgtcttggttagtttttgcaacttgtctctttctaggaaattgtctattacatttaaattgtcaaatttttggcatgaaattgctcccttataatccttctaatttctgtatggctgcagtgatgttccgttctaaaaagatcgtatcatgattgggctgaatccagagactgggaagatactgttttgttttcaggtaagtgtagattttcaaaattgttttaacattaaaacacgttttttttgtttgtttgtttgttttgttttgttttggccaggtgcagtagctcatgcctgtaatcccagcactttgggaggcccaggctggtggattgcttgagcccaggagttcaagaccagcctgggcaacatgacgaaaccctgtctctacaaaaaaatacaaacattagctgggcgtggtgacacatgcctgtagtcccagttacttgggaagctgaggtgggaggactgcttgagccagggaggcaggggttacagtgagctgagattgccccactgcactccagcctgggcaacagagcaagaccctgtctcaaaaaaaaaaaaatcacttatataagtttagtttaagatatacttaatgatataaatggaaacattctttttttttttttttttttttttttttttgaggcaaagtcttgctctgtcgcccaggctggagtgcagtggtgtgaactcagctcactgcaacctccacctctcaggttcaagcgattctcatgcctcagcctcccaactagctgggattgcaggcatgcaccaccacacctggctgatttttggatttttagtagagacagggtttcaccatgtcggccaggctggtcttgaactcctggcctcaagtgatccacccgcttcggcctcctaaagtgctggaattacaggcttgagccaccatgcccagccaagacattcatttttagatgtgtatgtgttattcttctttgaaatacttttaaaaatagaaccaaggacctagatattaatcaaaaacacaaggaaatactacttcatatcaaccaggatggctatgagcaaaaagacaggcaataacaaacagtcttggtaaggatgtgaagaagttagaaccatcatacattgctactgtgaatataaaataatgtgcagctttggaaaacagttcttcaaaatgttaaacatagaattaccatatgacccagaaattatactgctaggtatatacccaagataactgaaaacatatattaagaaaaaaacaactatgtcaggcacggtaactcacgcctgtaatcccagcactttgggaggccgaggcgggtagaccacctaggtcgggagttcgagaccagcctggccagcatggtaaaatcccatctctactaaaaatacaaaacttagccaggtggcgtggtgcatgcctgcaatcccagctacttgggaggctgaggcagaagaatcacttgaacccaggaggtggaggttgcagtgagctgagattgtgctaccgtactcgtctgggagatagagaaagactctgcctcaaaaaaacaaaacaaaacaaaaacaaaaacaaaaaacttatacatgaaaaatgttcacacttgcattactcgtaatagccaaaaagtagaaacaacccaaatgtccatcaatgaatggataaacaaatggtatgtccacacaatggaatattatttacccataaaaaggaataaagtactgatacatgctaccacttggatggatcttgaaaacattatgccaaaaaaggaagtcggacacaaaagtccacaagttgtatgatttcatttacattagatgttcagactaggcaaagctgtagagacagaaagcagattagtggttgccaggaggtagctggaggggtaatagggagtgactgctaatgaatacagggggtttctttttgtggtgatgaaatgttctggaattagatggttgtgatggttgtacaacagtatgactagactataaactactgacttatatactttaaaatggttaaaatagtgaattttatgttatgtgaattttacccaaattttaaaagatacattggccaggtgtggtggctcacacctgtaatcccagcactgggaggccgaggcaggcagatcatgaggtcaggagttcgagaccatcctgactaacacggtgaaaccccgtcactactaaaaatacaaaaattagccaggcgcagtggtgggcgcctgtaataccagcactttgggaggccgaggcgggtagaccaccttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttccaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtcttaagactatctggtagtgaggtataaatgaaagaacatggggttaggacttggaaaatttagatctaaatcccaactctatcatttaatacctgtgaaatcacagcaagtttctaaagctttcatttcatcttctacaaaatagaaaacaacaatacctgccctacaagtttactatgaggattaaacaaagtagcatccgcaaagtaattagcataatgtttcacaaaagtaggcactcgacgaatttgtcgttagctcatttcctcttgtattctatagaacacagatttcagcatgctaacaaaattaactcctattaatctaagaggttagcttctaaaatgctatataaactttccaaatgcatgcatctaaaagttataatggaaatcaacagtccccaaattatgaattgtctctgaatgcaatattgcttccataacaactttttccagactatattcacacacattatttcactattccttaaaatttcagtgaaaacaagagattctggcatccacactaacaggaaaatggacataattcaaataatatagactagaacttgatattgtcttcccagtacactttttactttctaaggattctttttttttttttttggcttttttttgtgagacagtctcaccctgtcgcccaggctagagtgcagtggcgcgatctcagctcactgcaacctctgccgcccaggatcaagcgattctcctgcctcagcctcccgagtagctgggattacaggcacccaccactgcgcctgcttaatttttttagttttagtagagacagggtttcgcgatgttggccaggctggttttgaactcccgacctcatgatccacccgcctcggcctcccaaagtgctgggattacaggcgtgagccaccgcatccaactctaaggattcttaaatatttttcagcaaaaagtttctgaatgccacagaaaaacatttatttccctttcacccaaacattctgtattaatgataaagggtcctcccgagatcccaattgtttctattttttttattttttaagagacagggtctcactgttgcccaggttggaatgcagcagtgcgatccatacctcactataaccttgacttcctaagctcaagagatcctcctgcctcatcttcctgagcagctaggaccacaggggcacatcaccatatccagttaatttttccattttttttgtagggacagtgtctctctataatgcattgcccaggctggtctcaaattcctggcctcaagggatccttccacctcccaaggcgcttggattttaggcatgagccactgtgcttggcccaattctttcaataatgccacgggaaacgctacagagtcaagaggaataccatgtggtatgagaaagaagggacaaagaacagagctgaaagattccaccccccggggatctgtttttttgttttgttttgttttgagacagagtcttgctctgtcgccaggctggagtacagtggcgcgatctcggctcactgcaagctccacctccagggttcaagcaattctcctgcctcagcctccggagtagctgggactacaggcacccaccaccacgcccggctaatttttgtgacttttagtagagacggggtttcaccatgttggccaggatggtctcgatcacttgacctcgtgatccaccctcctcggcctcccaaagtgttgggattacgggcatgagccactgcgcccagccaggatctggttttaaaaatgaaagaaaagcaatcattctccctgactcctattgccatttcagtgaatgtaaacaatgagctcatctgtccaattactatttggatgtcttataggccctctaaattgaacctgtactaagttaaactctttgtcttcctcctaaacctgcttttcctcctggtatttcttatctcaatgggaagtaccccatctacacaacgtacctaagactgaaacctaggagtcactcttaacaccttttgtccttcatatctcagtaatctccaagaactgtccattttacatcttttttaaaaattacaattttaatttaaaatagagacagggtctccctatattgcccaggctgctctcaaactcctgggctcaagggatcctcccaccttggcctcctgaagggctgcgattacaggcgtgaagccaccatgcccagccgattttaccttctagaaatgtgcaaagtttatctcgcactctctgtacctaatgtcatagtttaagccctacttcatgattctgaacttgtaccccatctcttgttcatttcttgaattccttgtatccttcaaagttcagctcagaaataacccttttgatgacgcttttcccaaaccactgcccctacctcttggtcaaagtcagtctcttgcttctcaagattattttggttgaaatgagattgggaggcctatacttagccataagcagaactatggccatcctgacccaccaacccaggcatctaatacctggtatccttcctactccttttttctcaagagattgactttgtaacttccgtctatttggcacttttcatacgtatcataatttcatactgtatcataattatttgctgctgtttctttctcttttttgtctgtgagttttccaagggcaaggtcatcttttcatccttgcatctccaatgcaactggcaagtagaggttctcgaaacattttggttgaaatgagattgtgaggcctactttgccataagcagaactatggccaatttcccccacagtttagatacttcatgactcattcatacatatgatattctttgtaagttattttattttatttattattatttttattttatttatttatttattttttttgagacagagtctcgctttgttgcccaggctggagtgcagtggtgtgatctcagctcactgcaacctctgcctcctgggttcaagccattctcctgcctcagtctcctgagtagctgggattacaggcgcacatcaccatgcccagctaatttttttttgtatttttagtagaaacggggtttcgccatgttggccaggctggtctcaaactcctgacctcgtgatctgcccttctcggcctcccaaagtgctaagattacaggcgtgagccacttgcgcccagcctgatatatattaagataagctaaacgtcttatgttttgtaaatacttttgtgatccttttgattgaacctttagaaacatctgtatcaataaatgatttatacttatcgacaaaatagccataaagtttttcctagtttttccttcttaactcctttgtctcttttctatccatttcatcctgacccaccaacccaggtatctactacttggtgatccttcctattcctttctttacatgcaaggaaagtactttttctaaagctaatgagctccaccgggtgtggtggctcacgcctgtcatctcagcacttagggaggcagaggtgggcggatagcttgagcccagggcaacagagcaagtccccctaccctttttttttcttttttgagacggagtctcgctctgtcgcccaagctggagtgcagtggcgcgatctcagctcacttgcaaactccgcctcctgggttcacgccattctcctgcttcagcctcctgagtagctgggactacaggcgcccaccactgcgcccagctaatttttgtatttttagtagagacgaggtttcgtcatgttggccagactggtctcgaactcctgacctcaggtgatccgcccacctcagcctcccgaagtgctgggatgacaggcgtgagccactgtgcctggcctgcaagtgcccattaaaaaaaaataaataaactaatgagctctaggctatagaattctactctatgctcacatctcataaaaggaaggtcttgtttatctttacacgtctaccacctactgccatactagcgcattgtaaatatgcaataaaggccaggtgcagtagctcacgcctgtaatcccagcactttgggaggtcgaggcgggcggatcacgaggtcaagagatcgagaccatcctggctaacacggtgaaaccccgtctctactaaaaaatacaaaaaattagccaggcttggtggcgggcgcctgtagtcccagccactcgggaggctgaggcaggaaaatggcgtgaacccaggaggcggagcttgcagtgagccgagatcaggccactgcactccagcctgggcgacagagcaagactccatctcaaaaaaataaataaataaaaatgcaagaaaatcttgcttactcaacccaaatgtcaactggagaatgaataactaaaaagtagtatgtgatatatgatggaatgttatttgtcaataaaaaaaaaatgaagtactggccggacgtggtggcccacacctgtaatcccagcacttcgggaggttgaggtgggcggatcacttgaggtcagaagtttgaaaccagcctgagcaacatggtaaaaccccatctctactaaaaatacaaaaattagccaggcgtggtggcggcgcatgcctgtagtcccagttactcaggaggctaaggcaggagaatcacttgaacctgggaggccgagatcacaccgctgcattccagcctgggcaacagagtgagactctgtctcaaaaaaaaaaattgccgggcacggtggctcacgcctataatcccagtactttgggaggccgaggcgggcggattacctgaggtcaggagatcgagaccatcctggctaacatggtgaaaccccgtctctaccaaaaataaaaattaaaaaaaatcagccggatgtggtggctggcgcctgtaatcccagctacccgggagggtgagacaggagaatcacttgaacccaggaggcggaggttgcagtgagccgagattgcgccactgcactccagcttgggcgacagagcgagactcagtctcaaaaaaaaaaaaaaaaaaaattaagtacttgtacatgttgcagtacgaatgaatcttcaaaacaagctcagtgaaagaagccagccccaaagaccacataccgtatgatgtcatttgtatgaatgtccagaacaggcaaatccacagaatcagaaagcagattagtggcttccagaggctggagagactggggggaaatggggagtgactgctaatgagtacaggccttctttctggggtgataaaaatatcccaggccaggcatggtggctcacacctgtaatcccacactgtggcaggctgaggcaggagaatcgcttgatccaggagactgagaccagtctgggtaacatagtgagaccccatccctacaaaaacaaatttaaaaattagccaagcatggtgatgtgcacctatattcccagctacttgggaggctgaggtgagaggactgtttgagcccagaaagttgaggctgcagtgaactatgatcacaccactgcactgcagcctgggtaacagaccaagaccctgtctcaaaaaaaaaaagaaaaaaattctaaaattggtcatggtgatggttgcacaactctgtgaataaactgaaaaccactgaattgtatactgtaaatgatatgtcaattataactcaataaagctgttaaaaaaagaaaaaagtcttgcttgcttttgttatagagttcaaaggagattcagagctagaaagtacaggtgtacagtgagatggcagaaagtttactagcagacattcctcctcactaaggtgggccaggctgttgggtggatctctgaccattcacctatgccaaatagtctgtgtgtttcagggaggaatgtggaataggtagcagcaagtcactgaactgatttcacatgaatatatgaagcaaagtaatttaaagcattaagactccccagaagaatttaaaaaaaaaaaagattcccagagtctaaagaccaagaaatttaagttttctcagagctcattccactgaaaagactggcttcctttgctttattcctagctacagtgattggctgattagctgacagtatcacctatttggttataacttgttcctactccaagtgatgttgctgaattggtacacaccaccatttctttaatctgaattatctaagaaatattcagaaactaacaatgccctgttttgttgattgctgagtcactttctgagcttatttgctgtagtatgcagaataatgcccccctgcagatggccacacccattccctggagcctgtgactgttttaccatacatggcaaaagagactctgcaggccaggcacagtggctcacgcctggtaatcctagcactctgggaggccgagataggaagactacttgagctcaggagttcaagaccagcctgggcaacatagcaagacccttactctaaaaataaaaataaaaataaaaatagtaagccaggcatggtggtgggcacctgcaatcccagccacttgggaggctgaggcagggaaatcacttgaacccaagaggcagacgttgcagtgaaccgggaccgcaccactgcactccagcctgggtgacaaagcgagactctgtctcaaaaatacaaataaaaataaataaaaataaaaatagtaaagaggctttgcagatatgattaaataaaggaagattattctggtttatctgggtataccgaacgtaatcacaagagtccttgtaagtgaaaaggggaagtaggaggttcagaatcagagcaggagacatggcagaagcaatcgtcagagtgatgtgagcactggctggtgccaagcactaagcaatgtgggaaccctctagaagctggaaaaggcaagaagatggactttcccctggaccctccagctctgccaacaccctgattttagccctctgagacccatttcagatttctgatatccagaactgtaagataattcatttgtatatttgtattatggtaatttgttacaaatgcaacaggaaacaaatatatatacttgcccttatgatcaatatcagccctgcaggcacttgtctatttgtagggtattatttgcttttattgctcaagacagagcattcatttggaataagtattaactgtttcagaatagatttttccctttgggctgggaagctctagaactaagcagtggaaactgagtttgatcaatggctaatagtcaatataggtaaagaaacatacaattctgtcactgggattttgaaacacagatttcataataatattaacaacagtagcttcaattgtgtgtaagtgttctctgacatgtttttattatggaaagttttaggaagggtagcaagctgagacaggataggcagtgtggaggaaagctttaggaagggtagcaagctgagatgggataggcagtgtggaatggggtctttcatctaaggtttggcaataattaggaaatacaaagataattttccagagataaaggagcataaggtaggcataaacggaaaaaggttctcatctaagatacaactagtaacaggatggaggaatgatagagggagaaaaaacagcagaaaagacgcactagacaccatgagatgatacgaagatcaaatcactgcctagagccccaatttttctatttcattagttttatttatttgtttatttactttttatttttatttttgagatagggtctgtctctgttgcccaggctggaatgcaatggtgcaatctcggctcaccgcatcctccgcctcccgagttcaagcaattctcatgcctcagcctcccaagcagctgagattacaggcatgcgccaccacgcccggctaattttgtatttttagtaaagacagggtttcaccaggctggtctcaaactcctgacctcaggtgatcctcccacctcagcctcccaaagtgtgggattacaggtatgagtcaccgcacctggccatatttcaatagtttcagcctaatacacatgcaacttccatattttcctaacacttctttttctaaacccaatgtaaagcttctacaactgagctgtgagtcataatccagtaaaaaggcagcagatttccagtgactgtgaaaatacacttactattccttcttttcattatttcagaagacatgtaacactgatatcatcaatgtcatatcggtttctaccctccccctgccaggttaatctccacttaccactgcacagcgctgcactttggaaggaaccccatcttcttctgttgccccgttgggtccgggcgcctcttttctcctcttccttgcattgaccttggctgaacactgtgcatccatcttcttttaactggtcatagaaagtgaaaacaaaaattttctcattggggtgggaaaaagtttgtcaccagtatttcagagacgttgacgtggatacactcagcaaaataccaattctacagctgcacttcaccaagatgagccaatggcatctggcaaaaccagcgaagcttcacaaaacacaggctctagtagaaatactgaaacgcctctctgtgcaacaatggccacagtgaattgcctgaagtcggaagtcattccccctcacagtgcagcctacatactaactgctcattttaaatcctgattgcatgcaaaagattggaataatttggctgagaaagatagttacacagactctcccactatcctccgcatcatcgatatgacaggtataaggcaatgtgaaggtatgactggtgcaggtagagaaaagagccttttgtaaacggatggctctcaccaagtcctggattaacaaaacacggatttcttaactctaattttttttaagacggggtctcactctgttgcccaggctggggtgcagtggtatgatcttgcctcactgcagcttcaacctcgttagctcaagcgatcctcttgccccagcctcccaagtagttgggactacaggcacatgccaccacacctagttatttttttttttaagagacaggcctcgctatgttgcccaggctggtcttgaattcctggcctcaagtgatcctcccaactcaaactcccaaagacttgggatgacaggcatgaaccacatcactgagtgaatttcttaactctaaaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccataatcatagcacactgtagcctcaaactcctgagcttaagcaatcctcccatctgagcctccagaatagctaggaccagcataatgtattttttaaatgtccttctccttctttcctttttttttttttgagaaagagtctcactgtgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactccgtcaccctggctagagtgcagtggcaccatctcggctcactacaacctccgcctcccaggttcaagcgattctcctgcctcagcctcctgagtaggtgggattacaggcacccaccaccacgcctggctaattttttgtatttttagtagagacagggtttccctatgttggccaggctggtctcgaacacctgacctcgtgatccacctgcctcgtcctccaaaagtgctgaaattacaggcgtgagccatggcgcctagccaatttttgtatttttagtagagacagggttttgtcatgttggccaggctggtcttgaactcctgacctcaggtgatccacccacctcgacctcccaaagtgctggaattacaggtgtgaaccactgcacctggcccttccccttcttttctcagtactcatttccctttcctctttcagggtcttaacacctcaagcttgttcacagtttccagctattaaaaccccctcagggattctccttcccccaaaggaacttatttattattgtctcatttagcagagagtttctagcaactagctattacagcaaagttctgaatattctgtatttcatgtttaagtcacagaatacttggggtgtcacttcgctagccagaaacctctgtggccagtggcacctttgcctgagttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcgaggcgccagctccctgagaggctgcagctgaaccaggcgtactacaagcagcttccactgcaggcactggggaacatggtgctgcccagaagcttggagaggccaggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccaccatttggcagatcccgagttcttgtcccacgtccaggaagaatgaggtatatggacaactggaggacgagcaaggtgaagaggtgctttattgagcaacacaacagccctcaggagaccccaagcgggtagctcctttccgcagcaggtcgtcccagcatctgtgcagccctcagcggagaggagacccagagtggatagctcctatctgcaggcaggtcatcctgacgtctctgcagccctcagtggagaggagacctggagtgggaagctcctatccgcaggcaggtcatcccatcaagtatggctgagtccagggtttctacgggcttcagcgggcaggaagtgcatgctgattggtccatgggcagccacaggcagcccggaaaaagcatcgtaagttctcattccagtccacagaactggcagcctgggccccaggcttcaggccatccctggcttgaaggtggggcttcaccagggacccgcccatttccgcctaggagcctgtctgcctcctgctgtcatcaacctgctgtccacagcgcccaggctattcacgaaggggcgcctgcaggcctgaatggagctgctctcagctccgccttggcgtcccctcctgtgctgctggacacccaaaatccagagggggccaaggcagaagggggctggcatgtcagcactgcccctagcacacgcaaacccagccaggtcatgacagtgcccaggcttggcctcaactttgctccaaaatcagagcaggcaccaggagcaaggagaggccaggcagtgggagcaggcacttcaagcctgcaggggcaggggaggttcctgggcccccaaaagcacagggaagcccgggtatgtagccacggctgctcccgccctgccaacttggaaacgggcagggcttccacctactcccagctcccagtggctccatggagcgtgcagcacagaccatgcctccccgactgcagccggcatcatggcagcagcccatccagacaggccaccgctgccatcatttagatgttggcttttcagccccctgcagggatagttgcgtttttcttaagtaacacaatttgtacaaataaattactttcttgatactgatgaaattttaggaatcagccagaaattgggggtaggggaaactctatgataaactgtcatctctgcacaagatacggttcagagaaaaatcttcagaacaggtggaaaaccaatgccagacagaatgaggacagtctgctctgccctactgcctctcataagcctgactgagatgttcgtctaaacaactgcaactgtgccttactttctttcctccggctcaactccgagtggcaatatgacaagatctacaagaaactggcctaattcttagaagctgaaggtgacaccccatgagtcatggccaacatgaaaaaatgtcagagtcgaaagtgaaagatgagcaccacctagaaacttcctttcatcacaaatgcaaattaaaatggaagaagggttctatacatttcactccgagttctttcagtgatgatgatcagagcttgtcttcactattgttcttaatgattccttcataatattcagaggtcaatactctcatctcagtggtctgagtgaactactcaaaatgcctaatccatccaattaatgattgttttctaatttgcacagtactcttctgtaagtatctgctcaattcttctaagtgtagagagacaaaatccactatgagaaatataatcagcaatttggcatctggcaagtcaataatatcaggcagtcaaaaatatgagtacttactgcttacaaagtactgtatcataatttttaagtacaaactgaacctggaggacattatgctaagtgaaataagccagacgagaaagacaaataccacaaatgacctcacttatttgtggaatctaaaagagtggaactcacagaagtacagaatggaatggtggttacaagagatggacagaagagggtggagagcaaaaagggagatgtcgagtacaaaaattcagttttgaaaggagaaacaggctgggcacagtggctcacgcctgtaatctcagcctttgggaggctgaggcgggtggatcacgaggtcaagagatcgagaccatcctggccaacatggtgaaaccccatctctactaaaagtacaaaaaatagctgggtgtggtggcgcatatctgtaatcccagctactcgggaggctgaggcagaagaatcccttgaacccaggagacagaggttgcagtgagctgagatcgcaccactgcactccagcctggcaacagagtaagactctgtctcaacaaaaaagaaaaaaaaaaagaatggagaaataagctttagtgatctattgcacagaatggtgactataataaataataatgcagccaggcacggtggctcacacctgtaatcccagcactttgggacgccaaggcaggcggatcacaaggtcaggagattgagaacatcctggctaacacagtgaaaccctgtctctactaaaaatacaaaaaattagccaggcgtggtggcgggcacctgtagtcccagctgctggggaggctgaggcaggagaatggtgtgaacccgggaggcagagcttgcagtgagccgagatcgtgccactgcactccagtctgggcgccagagtgagactccgtctccaaaaaaaaaaaaaaccaaaacaaaataaataataatgcattttatatttcaaaattgctaaaagagtagattttaaatgttttcaccacaaaaaaataagtatataaggcaaggaatttgttaattagcttgatttaatcattccacatgtaaacatatatcgaagtatcacattgtatcccataaatataaacaactattatttatcaatttaaaaaattaaaggccaggcacaatggctcacgcctgcaatcccagcactttgggaggctgaggtgggcagctcacctcaggtcaggagtttgagaccagcctgtgcaacatggtgaaactccatctctacaaaaatacaaaaattagccagacttggtggtgcattcctgtaatcccagctactcaggagactgaggcgggaggatcacttgaatctgggaggcaaaggttgcagtcagccgagatcgcaccactgcactccagcctgggcaacagagtgagactccgtctcaaaaaatgaaaaaaaaaaaaaaattaagtacaaactattttctcaaggaagcttcaattaaggcatggaaaacacacacagagctccacctcaaaaatgcttatgatataaaaatgctctacaggattctaaaaccatggggtgaaagtttgctgaggaataggatatttgcagttacgaaaaattgaccaggtgtagtggcacatgcctgtagtcccagctactcgggaggccgaggtgggaggactacttgagaacagcaagtcaaggctgcactgagccatgatcatgccactacactccagcctggacagcaaagtgagaccctttctcaaaaaaaaaaaaggccacatgcagtggttcatgcctgtaatcctggcactttgagaggccaaggcaggcgaatcacctgaggtctggagttcaagaccagcctggccaacatggtgaaaccccgtttctactaaaaatataaaaattagccaggtgtggtggcgggcacctgtaatcccagctacttgggaggctgaggcaggagaattgcttaaacccaggaggcagaggttgcagtgagccaagatcatgccattgcactccagcctgggtgacaagagtgagactccatttcaaaaaaatatatatatttttttctttacctgcttacactattatgtgtttatactattccttatctgcttacatacagttcttctattttctaaagatgacttttgggttttacattatattctacactgttctttaaactgaagtctttagatccttcggatttaaaataaaacacacccactgctttttgggttttagtgtaagacacttctttatctcatccacttctcaggagatggaaaacatctgggtcacagatattccataatgataaccctaaaagaatttagaaattatgcaaagattactcctcatgactttcctctagaactactgctgtttaaacttttactctgggctgggcgcggtggctcatgcctgtaatcccagcactttgggagaccaaggtgggtggatcacatgaggtcaggagttcgcaaccagcctggccaacatggtgaaaccccatctctactaaaaatacaaaaattagctgagcgtggtggcatgcacctgtaatcccagctacttgggaggctaaggcaggaggatcacttgatccctggaggtggaggttgcagtgagcctaaatcgcacgccactgcgctccagcctgggcgacagagcgagactttgtctcaaaataataataacaataataaacttttactctgtaggtctcacaagtttttttcattttttcccggccttcttatgccatcccaatgttctctcacatctactaacttataaccgcagcaccaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagccctactaggatgggccaacacttcctgtttgtttagtggttcatcctccagaacactttctttgtcaaaaaggctataacagcccagtacagtggctcatgcctataatcccagcactttgggagaccaaggcggatggattgcttgagcccaggagttcaagaccagcctggccaacatggcgaaaccccatctctactaaaaagacaaataattagccaggagtggtggcacatgcttgtagtcccagctacttgggagtctgtggtggcagaatcgcttgaacccaggatgcagaggttgcagtgagccaagatcgttccactgtactcccgcctgggtgacagagcaagacctcatctcaaaaaaaaaaaaaaaaaaaaagctaggccaggtgtggtggctcacacttgtaatcccaacactttgagaggccaaggcgggaggatcacctgaggtcaggagttcgagaccagcctggccaacatggtgaagcccggtctctactaaaactacaaaaataagctgggcgtggtggcaggtgcctgtaatcccagctacccaggagactgaggcaggagaatcatttgaacccaagagacggaggctgcagtgagccatgatcataccactgcactccaacctgggtgacaagagtgaaactctatcaaaaaaaaaaaaaaaaagggctgacagccagaatacagcaattgttaagacctgatctttccaactgctgcctattcactccctagataagtcaccttatcttaatcactgaaatttgagcacagactctaaatatggacataaaaacccatcccccaacaccctgcctgctaagtacattagtgtctccaaagtgccctcgaaatacagaatgcagtatctgtgcctgtgatttttactccgactcacaaagacctggtttggtttctgctgactcacctaccagtacacactgcttgccttgttcctccacgttccaacacatgcctgctgaggcacatcagctttgctagacaagtggaagatgtgtttgtggagggaggggtggcactgaggagacactaaggatacagctagtcatatttttccaatgtgaatgtcctgaaggagacagaatctaggtgctggcatgtctatgcttgagtctgaaagatgataggctcctacaagtagttttagggactcctatccagtcctttctttttttttttttttttttttttttgagacagagtttcactcctgttgcccaggctggagtacaatggcacgatctcagctcaccacaacctccacctcccgggttcaagcaattctcctgcctcagcctcccgagtagctgggattacaggcatgcaccaccacgcctggctaattttgtatttttagtagagatggggtttctccatgttgaggctggtcttgaactcctgacctcaggtgatctgcccgcctcagtctcccaaagtgctgggattacaggcgtgagccaccgcacccggcctatccaatcctttctattcaacttccttattgcaaacagacctaccaagggaaagaggagttggactttgcttcctgaactatgtaacaatctaaatatagcagagtcctctcttatccacaggggaaatgtttcaagacgccagcagatgcctgaacccctagagagtatggaccctatatggacagttgtccctcagaatctgcagggcactggttccaggatctcctgcagatgccaaaatccacagatgctcaaaagtcccttatatatataaaacggtgtcgaatttgcatataatctataccccctatatactttcaatcttctctacattacttacaacacctaatacaatgtaaatactatgtaaccagttattatacaatattggttttttatttgtactgttttttattgttgtattggtatttttattgtttttttttttttttttttctgaatattttcgatccaagtttggctgaatctgcggatgtggagcccatggccacgaagggctgactctactttgttttctccctatatacacagagctatgataaagttttatttataaattaagcacagtaagagattaacaggaataactaataataaaacaattataacaatatactgtaataaatgttatctgaatgtggctgttctctctcactctcaaaatatcttactacatcatactcacctattttctgaccgtggctgactgtgggtaactgaaaccacggaaagtaaaactgcgactaagggtgagctcttgtagtagcaagttgcaattacatatgctattccacatttcaaaaatctaactcaaacttgaccaattactacaaggaactatttgcaaaaagatgaggcataatttttcctttgcactctattcctgccttccccatctctaggcctacattatcttccccactaaaacccaatgcccagtatttttctatcagcatatcaatgcccagttccaaagccgagtgcgcaagcagactttacatttgggatgtttctctgcttctaccgtggtggtgcttaatgagctggtgctctaagaggcaagctctggaaactcaagggttaaagtgcatctaatattcctggcattcattaatcctatcatcttgctgtacactcaggtctttctggagataacagtgtaaggacattgccccctatgtaaaggcctttgaagcttgaaggagtatatggctaagcgaaagtagggaaaagagctggactcaagaaccagaaaatctagatcaggggtcagcaaactacagctagctggccaaagatggcccactacctgtttttgtaattaaaattcgatcagaacacagccatgttcactcactgatgtgtttattgtccatggctgcttttgtgctacaacagcagagctgagtagtcacagatactgtgtgacctgcaaaccctaaactatttacaatctggcccgttactgaaaaagtttgctacctctcatcctagatgaaatcaggaccagctttattaataatttggtggcaaattctacctaaatttacccaatctaaagtgaaaaacagtgttagaaatagaattatttcgagtacagtggtgcaatcatggctcactgcagcctcgaactgctgggcttaagtgatcctcctgcctcaccctcccaagtagctaggactacaggcacatgccactacacccagctaattttttgtagagatgggggtctcactttgctgcccaggttggtctcaaactcctggcctcaagcaatcctcccacctcagcctcccaaagtgctgggattataggtatgaactatcacaccaggctgagaacttataaatgtaaaagtgaatttcaaaacatgagcttctctgacagattagttctaaactaaagttcaacgttacttgtcatgagccctataaactgtcacatttaagaccttagctttgaactggatctcttccctctaatttcgtcagagaaacccttattcaacaaacactgagcggcacttactctgtgccagaccctgggttagccactggcacacataataaagcttatacttcttcggcctggacatgtagtagaatatttcaggaaagaaaaaaccatgagggacacatgtaatagttcttacagttgaacaattttactctgccactattctaccagaatatttggtgagtaaactcttgtgtttagaatgtgatcttcctagagtgggttatggaactcatatctctgaggcagggtctatgatagaattcaggaagtctgtgaatttggatgaaaaagactgtatctttattttcacttcagtgatgaacataagctacagcagtaatagcagacttattagacaaatggatttgttaccagtagaaatcatggatattttcataccatatcatacttcttaaattttgataactatatatcaatataattcaatataactggttttctttatagttctatgtattttatttttgcatataaaaacatattccaaaaaggaactctaaaagctttcaccacactgccaaaggagtccataacacaaaaaagattaagattcctgttctacggtcaaaaaataaagaaacataatcacatttagggtaattttctgtatataaaaaaactacctgttttttattaagggtcatatgctcattttctatagagcagggaccatatgtcattatttttggcagccttcacttcaaaactggtttgcaagtagttgtgaatgtgatataacagcctagcagattcatgggttcccctggctcactggcagtcatcctagtccaaacatagaaagcctcaaactaatataactttcaacttgtggtacaagagaattcccaaaagaaagcaaggggcaaggcacagtggctcacgcctgtaatcccaacactttgggaggccgaggcggatggatcacttgaggtctggagtttaagaccagcctggcccacatgatgaaaccccgtctctactaaaatacaaaaattagctgggcgtggtggcgggcacctgtaatcccagctgaggcaggagatcgcttgaacccaggaggcagagtttgcagtgagctaagattgcaccactgcattctagcctgggcaacaaggcaagacttggtctcaaaaaataaataaataaataaatagaaagaaaggagggaaaagacacacacagaaagcctgctattaatatatatctattaacctggtttacgaatggtaaaatacaggtaattcaattatttacattaatgaataaggtaggtaacaaacctaaaagaatgccaaatatgagactcatttctttttatcttctgaggtggcgcttcggcacatgctgcaaacgtaaaaaggtacattccttgaatttactggctaaattgtagaaaggaattaggatttaaattctgccacaaataatccacaaagcaattaacaaaacaaatcacagatgaaacatgtgtttaagtactcatttgacaggaatactgtgaaaagagaggtttaggactaaaaacagaaaggtttacgcttaggaaagaggttcaaggacttagggaaaaggagatgccagaagctgccaagcagataagcaggagggttgacaaggcctaaagtgctgatcccctcactctcccaagtcacccctttttctaatatgcttgatgtgtgataatgtcaaagatgtacaagcagccagccacaatcttgagcaaaaaagggactctcacagtcctgtgataattggcaagtgccctgactttagggtttctccaactggaaacaaatccaagaaaaaaatgacttttacaaaaatgtattctttccaatctatttcaaggtaacacaaactttgatgtaagggagacctatttctgcttgattcagaaagggaaatttctattagtagaaaaatcagaaggtctgcttcagatcagttatgtaaatacttagaaaagcatgatgcttaagtaagaactctactattattagcagatattttgctattatccatcattaataacaatggaaaattatgctttttatttgagcatttcaaaaactaattctcatcagcacttataacatctctaggagaggttattcagctccctagggaaatactgtctaacttaaaggccagacagctctgaattataaatggagtcagatggtttacaaactctatgaaattacatacaaaatttggtaagttcacatatatttcagattattaaagggctgtttaatcataagaagagttacctctggccatggttagaaaatctacaacaagagaaagcaataatgctttccatacatagtcacagggcgagtaaatgttaacatcggagaaagtcaccagggactgctaagtccaggctctatctgacgaggtcattcttcttaagggatcacatatccaaaaagcaggtccccagggaaaataaaaccccactgcttatgggaggagagtcatagactgagggggaatgaagctcattctttatcaaccaggccatcatgctagttttcaaagggaatttgcaaagcaaatcttttgtcctacaaaaagattcatttcattcagcaaagaaaaaagaccctagagggagtactgctgaatcccaagcctcttccacagtctgttaccttgaagcatagatgctgttctagaagaaacccctgggtagttccttttagctatgtagaatgtaagtcaagtaaacatctaatgtgctagaaaaaggtgtaactaaccaatttatttagccaagaaaaggctatcccccaccattctcaactcattcccattcaagaacctatctgaactctattcccctattacagagtgtagggggcaggagtggttatcagattaatacactgtacgataaattaaatgacctcatacttctcctattataaaaagcactggtggcacaatcaatagcaccttctaaaaagagctgtaaggccaggcgtggtggtcacacctgtaatcccagcactttgggaggctgaggttagtagatcacctaagctcggaagtttgagaccagcctggccaacgtggtgaaaccctgtctctactaaaaatacaaaaattagccaggcatggtggcacatgcctgtagtcccagctattcaggaggctgaggtaggagaatcgctttgaaccaggaggcggaggttgcagcgagctgggatcgtgccagcacactccagcctgggcaacagagtgagactctgtctcaaaaataaataaataaataaataaaataaaaagggctgtaagagagaaggaagtagtaacattcactttaatttcatctacatcactcacagccctaaagaaagggaatgtgtaggaaataaagtcagcagctaaagcttcatttacattacccatagtgtggtatcattcctagcatgccaggcttggcctcagtgtacaaatcattgaattagagagctaagtacattgaagtctctcccatgtggcatcccaatcaccattattgacactgcgagtgtcatcattttgtccccctttctttctcatcatggtcatagtttactgctattactgcactaaatcccattctcaatgtctttttactagcaattctctgtacttgccaaatcactaaatatcaagataaataggctctggaggtcatatctgccttcctacttccattttattgttggcagattattttctgcccctatcttgagtttccttcccaacccttgttcctacgctcaaagcttcccgttcctcatgagcagtttctcataccacaaacccctaaatcctcactgcctctataaatatcacaaataccactgtccctttttttttttttttttttgagacagagtctccctctgtcacccgggctggagtgcagtctcacaatctcaactcactgcaaccaccgcctcctgggttcaagcaatcctcccacctcagcctccccagtagctgggattccaggcatgcgccaccacacccgcccagtgtccctatttcaatataatttctggttctcccaactgagatgccgagtttcagctctcacagctagtcacctcaattacattcaggaagcctcctccagttaggccaggctaatacagcctgttcccaattgcatctttgtacttccaaagagttccctattcatagaatcattacattttagaaccaaaagaaaactcagaaatcatccggtccaatgtttttcaaacttttaaagtacattttgcttcttacactttgagatgtacaaaatctattttacatcataatctcatacacacataactcaaacaaatcacatgaaacaatacttacccttactatgtaaacacactgaaagtttctattctattccactttttaaaagaaaagtacaggttcaggccaggcgcggtggctcacactgtaatcccagcattttgggaggcctaggcgggtggatcacctgaggtcagcagttcaagaccagcctggccaacatggagaatccccatctctactaaaaatacaaaaattagccgggcgtggtggcgcatgcctgtaatcccagctactagggaggctgagacaagagaatcgcttgaaccagggaggcggaggttgcggtgagctgagatcgcgccactgcgctccagcctgggcaacaagagcgaaactgtctcaaaaaaagaaaaagaaaaaaagtacaggttccatccactaaattggtttcacagctcaatactaggaagaaacccatagtgtgggaggcattaaactagtccaaacttcccattcactgatgaagaaactgtaactcagtggtgaagtttgtccgtaaaaattaaactcaggcctgttaagttccagaccagtgttctttccactaaagaccttctctgcccagtcacggccaatcacaccccgtgcccaaacacaaccctacagcgccatcgcccatcacggatgccatcctcttctccaagtcagcccctcgaagtcactgctctgggtcggagtcccctcgcggccgctgctcgtgttcccttaggtccggatcccccacagtcactaccaatcgatcagagtctccttggagtccttgccccttgatcatagtcccttgcagtcactgcctcatacttcctcggtccaagtgccgtcgcagccccggcctcgcgctctccgaggtcaccgtgtttcgcattcactgctcctgggtcacagtcccctcgctgtcactggccctcggtcacagtagcctcccagcccctggctcccactgccctcgctgtcacttaccactcttcctcagtcacagtcacctcgcggtcccagccccacagtttgtcctctcaaacagagacgcaaagataggcacacacctgcaactcacgctcccccgagcccggtccggtcggatttctggccggcgccgcgtcactgactagggaagttgaggaggttgcggggagacgcccggggaaggcagctgatggaagagccagccggaagttccgcctacttcccctacctctgtcaatccgaccacgacttctccttgaaaaccacgactcctgacacagtagttccgcctcctcagaggcccccgggatgaagtgacccagcagaaataccagagaccggagacggaatggcccagggtcagcctccacccggaaccggaggatgcagcgaagacgtctccttgaagtgggatacggatgtgaaccggcccaagtgctcgccggtccgtcaagacgcgctgcccggctgctcccgtgtccaactcgggctgtgtccgcccaggcgggcctgtgcgcggaggtcctaccgctgcacctccgcgcctaccgcagcccgcacccccgcacccgggcagccaacgtgcaggaggcccgggcgccttcagcggagacgccccgaccgcggctgcctcgccgcagcgttagcttttacctacgtggggaagtaaggggaatttgcgaccgccagcccagtccgctgaaaacctgtggctgacccaccctcttcctttttctgacccacgttggctccaaaaaaaaaaatccctagggatccactgggagccagttgagcaggagtggattaagacacgtgtcgcagggtgtatggtggaaagaaacgttttcctttgctagaatgaaccttgggaaggatcccttttgattccgtagatgtaagaggctacacaatattatggaagaaggatgtaaaaaaaatgtattattattttttagttaccaactggactgaagtaaaagaccttttaaacttatttacttattcttttatttttttaaaagacggagcctcgctctgtcgcccgggctggagtgcagtggcgcgatctcagctcactgcagcctccgcctccagggttcaagggattctcgtgcctcatcccgagtagctgggattacaggcatgcgccaccacgcccggctaatttttgtatttttagtagagtcggggtttcaccatgatggtcaggctggtctcgaactcgtgacctcaagtgatctgcccgcctcagcctcccgaagtgttgggatcacaggccaccgcgcccagtcaactttttgttgctattgttgttgctttgctttttttattttattttgctttttttgtctacatcaagggtatccaatcttttggcttccctggggcacattggtagaagaggaattgtcttgggccacacataaagtacactaacagtaacaatagctgatgacttaaaaaaaaaaatcgcaaaaaaaaaaaaaacctcatgtgttttagaagtttacaaatgtgtgttgggccgcatgcaaagctgttctgggccgcggcttggacaagcttggtctacatgcttaacttgaaagtggctgagaagaaagaggatgggtataactgcatctgctgaggagtttccagggggaaaaaggatttaaacctgaatttcaaatatgtctttgaacatggcggttagactaaggtaccccaaataaggacagttagctggagaagacaccgcggcctctaaggggaacatcactacaaaaatagagttgagatagtaaccaacatcagaatctcagtcttaagggaggatgaatttcataagaccctgacactgtggacaaagaaaatggatgggtgtttaggctaataagctatgtaagacataggatggcaagagctgagcaaaaacactgtgtgagaaagatgaaggcaacaattcaaaatgtaggaaaaagcagccaggcatggtgtttcatgcctgtactcccagcatattgggaggctaaagcaggaggatcacttgaggccaggagttcaacactagcctgggcaacatagcaaggcctcatctctataaaaaataaaattactgttgggagggcaacatgggcggatcacaaggtcaggagttcgagaccagcctggccaacatggtgaaaccctgcctctactaaaaatacaaaattagccaggcgtgggggcgcatgcctgtaatcccagctacttgggaggctgaggcaggagaatctcttgaacctgggaggctgaggtttcagtgagccaagatggcgccactgcactccagcctgggtgacaaagcaagactctgtctcaaaaactaaataaataaaataaaattactggccaggtgtggtggctcacacctgtaattccagcactttgggaggccaaggcaggcagatcacttgaagccacaagtttgagaccagcctggccaatgtggcaaaaccccatctgtacaaaaaaaaatacaaaaattaggtgggcatggtggtgcctgcttgtaatcccagctactcgggaggcaggagaatctcttgaacccagaaggcagaggttagtgagccgagatcgtaccactgcactccagcctgggcaacagagcaacactctgtctcaataaataaaaaaataaaaataaacattttttaaaaatagccatgtgtgttggcatgcctgtagtcccagctactcaggaggctgaggtggcaggatcacttgagcctaagagttcaaggctgcagcaagttacagtcccgctactgtgccccagcctgggcaacagaacaaggcccattctctgaaaataaaaataaataaattcaaaagttattttaaagatgtaggaaaaagctttatgcacaaataaagccatgtctttattttttataatagtgaaaaatcagaaataagcagaccctcaataaggaactggcaaaaataacaatatggtataacctattgaaataaatgccgctattaagtcatgcatcttaaaatcataatgcaaataaaatgacataaaaactgttcataacatcatgagaaatgaaaaatgagggtacaaaattatatgttttttaaaccttggaaataaaaaacattggtagaaaatataccaaaatttttaccattggttatgtttgaacaattgaaatggcttttcccctacttttttctctgtgttccagtgtaacaagaatatagtagggccgggcgcagtagttcacacctgtaatcccaacactttgggaggctgaaatggatggatcatgaggtcaggagtttgagaccagtctggccaatatggtgaaaccccgtctctagtaaaaatacaaaaattagccaagcgtggtggcacttgcctgtagtcccagctacttgggaggctgaggcagaagaatcacttgaacccaagaggcggaggttgcagtgggccgagattgtgccactgcactccagcctgggcgacagagagagactctgtctcaaaaaaaaaaagaaagaaagagagaaagagagagagagggagagagagagagagacagagagagagagaggaaggaaggaaagaaagaaggaaggaaagaaagaaacagaacatagtgtaacaaaatcaaaacattaaaaatataaggcctaaaacacaacagattcagttgtcaaactactaacatctttattttgtcaagatatttaacaatattaaaaagttcagatttcttcatggtcatgtcttttaccagcttttcaaagattcattcagtagtagaaacagccaaatgctgctacaacgcagaataaactgtcctaaaaaataaatacaacacacacacacatccagaatgttagtactaaagagggaatgagagcagcacaggcaactgaaactaacaccatctcagatctttccaattttttttttcttttttgagacagggtgtcactctatcacccaggctggagtgcagtggtgtgatctcagctcactgcagcctcgacctcctacactcaggcaatccttctacctcagcctccagagtagctaggaccacaggtgcctgccaccataccaggctaattttgtttattttttgtaaagatgaggtctcactatgttgcccaggctgttcttgaactcctgggatcaagcaatccacccatgttggtctccaaaagtgctgggatcataggcgtgagccacctcacccagccaccaattttcaatcaggaagactttttccttcttcaagaagtgaagggtttccagagtatagctacactattgcttgcctgagggtgactacaaaattgcttgctaaaaggttaggatgggtaaagaattagattttctgaatgcaaaaataaaatgtgaactaatgaactttaggtaatacatattcataaaataattattcacatatttcctgatttatcacagaaataatgtatgaaatgctttgagtttcttggagtaaactccattactcatcccaagaaaccatattataagtatcactgataataagaacaacaggaccttgtcataaattctggataagagaaatagtctctgggtgtttgttcttaattgataaaatttacttgtccatcttttagttcagaatcacaaaatgctttccagagcccagtcaaattgcttaaaacatttttaggcatttattacaagatttccacctgcctcagcaactcctgcaccactaacctcacctccagcctggtaatgatgggattaaaacaattccaactcaagtacctgatgattaaccaaaagcaaaattctttggtttagcccagctccctggctccttgggtggataactctgaactgtgttctacgacagtgctgtgataaaggacctgctttgtttttaacttccggtccttcatggaaggatgcttttgtaaaatgcaataaaaataggtaactcagaacatgaaatgaaaaaaaggaacatacaaatacagccccaatttttttcttagattcactgcacagaagattactttgtcaaattgctgtaagagtttctaaaccaacccttatactcagtgtattgtttacctcatcatggacctgtaacaaacaggtcacagagccgtgctggtctgtgcaccccactgtgagtggccctgttctacagcaccacccagagttctccaacaggactgagccctgtcatccagcagttttccgctcaataccacatgattttccctcctttctcatttcctctgcctctactaatgtttcctggaatctcccaaataaagtgctttttttttgagacagagtcttgccctctcgcccaggctggagtgcagtggcacaatcttggctcactgcaacctccgccctctgggttcaagcaattctcctgcctcagcctcccaagtagctgggactacaggcgcccgccaccttgcccggctagtttttgtatttttagtagagatggggtttcaccatgttggccaggctggtcttgaactcctgacctcaggtgatccacccgcctcggcctcccagagtgctgggattacaggcgtgagccaccacacccagcctaaagttttttattacatatttgttcatttgagtattgagtggcccccactggatgttaataggcagaaaccatgcctgtcttattcatcattttgtccctagcccctcaggtgcagaagctgacacataataggagctcagaactatttgttgaatgaatgaattgtatcatctaaagatgcattttttggccaggcccagtggctcatgcctgtaatcccagcactttgggaggccaaagcaggcagatcacctgaggtcaggagttggagaccagcctgaccaaatagtgaaaccttgtctctactaaaaaatacaaaaattagccgagcgtggtggcatgcacctgtagtcccagctactcgggaggctggggcaggagaattacttgaacctgggaggcagaggttgcagtgagccgtgatggcaccaccactctccagcctaggtgacagagtgagactccgtctcaaaacaaacaaacaagatgcatttttttttttttttttgagacagagtctcgctctgtctccaggctggagtacagtggcacaatctcgcctcactgcaacctctgcctcccaggttcaagcaattctcctgcctcagcctcccgagtagctgggattacaggcacccaacaccacacctggctaatttttgtatttttagtagagacggggtttcagcatgttggccaggatggtctcaatctcttgacctcatgatccgcccgcctcggcctcccagagtgctgggattacaggcatgagccaccgtgcctggcaaaaaaaaccatcttcttagcttgactattcccccaaagatagctgataaattaagatttacatagtacttcccactgtccagcccctgatccctagggtagttaagcataaaataaaactttggtggggctgggcgcagtggctcacgcctataatcccagaactctgggaggccgaggcgggccgatcacctgaggtcgggagctccagaccaacctaaccgacatggagaaaccctgtctctactaaaattacaaaattagccaggtgtggtggtgcatgcctgtaatcccagctactcggaaggctgaggcaggacacttcaacccgggaggtggaggttgtggtgagctgagattgtgccattgcactccatcctgggcaacaagagcaaaattctgtctcaaaaaataataaaaataaaaataaaaccttggtgagaccatagaattttagagctaaaagctaccttaaaatcatctacataagcagtgtccatatctggcagtcagcagaatcatggggaactttttaaatattctgattcactgatctaacccctggcctatttgatcagaatctatttgaatagggacccagcgtctatattttaaacaacttcccagatgatccttaggcagtcacagccagtctttgggaaaatgtacttcagcttcctaatgtcactgatacaatgtgagaaaaatccaatgacttacctgaagtcattcaattagaaagtgacagaactggagatggaatccccctcttatttctttttacttttttcttttttctttttttaatttttgagacagagtcttgctctgctgcccaggctggaatgcagtggtgcgatctcagctcactggaacctccgccaccaggttcaagcaattctcctgcctcagcctcccaagtagctgggattacaggcgtgcaccaccacacccggctaattttttgtgtgtgtgtttttagcagagaagaggtttcacaatgttggccaggctgctctcaaactcttgacctcaagtgatccacatgcctcggcctcccaaagtgctgagattacaagcgtgagccaccccacctggcctcactctcttaatttactcaatctagtttctgttctactctaactctgactctatgtattcacaacctgggagtagacgaatagaggatgcaatcctttctggagtaaatataaaataataacttcaatgaaacctcttttatgtgtgtgtgtgtgtcacccaggctggaatacagtggcacaatctcagctcactgcaacctctgcctccggggttcaagcgattctcctgcctcagcctcctgagtagctgggattacaggtgcccgccaccatgctcggctaatttttatatttttagtagagacaggctttcaccatgttggccaggctggtcttgaactcctgacctcaggtgatccgccctccttggcctcccaaagtgctgggattataggcatgagccaccgcgcctggcctgaaacatctttttaaagattcctctttatttttgcttaattttaataaatggctttaagataaagtaataaattttactactaaaaaaaaatgacctttgctcatggaatccctgccatccacatttgtttgcaacttagcaaagtgtgattggttcaaatgaacaaataagtgattttaaaattttagttataaattattactttaataaggattatcaggattgagttttagaacactgatttatggaggaagtggctaaaaataatgtttaaataatatgctaactaaataatatgctattcagaaattcaaacccatgaaaaattatgtcatatgtaaacatgtaagtttccttgcctataagcagcactctaggtttctgctttagtaacacaaaaactaacagtaaaatcatttcattcacaagtcaaagatgaatgactaagacagcagtgtctttccatcccaatcaacagtaaatagtttgatttgcggtgcccacgttcttagaaagggaaaagaggtttccaaatacacttacattcatgaaaacatcatgagtatagttgtcagtgtcagcatcccagaaacagcgagaagccatgctaaaaaatccaagaatgaagaattatcaacaatctaacaaggacctaaacgacacatatctgccacgagaaacagtgttccttaatacattctcatagatctgtacttccaaacctttcacaggtaggtacccacagagtattgtatttgtaccagagagtatactgggtaaaccggagaaactagagtcagatgaagctgcttgcaactagaggtgaccagccaggtactctgacagcctcagaccctacctgatggctacagggatcaatactagagatttgtgtgtgacttttaatgagctcagctcctgcacaataacaggacgaggaaggcacagaaagagcccaacagatttagtccaacctgatcattttatagagtcccagaaaaaggagcaaactctgaactagaattcagtcttctaacgaattataactccaaaaatatctctacagaatgctaaactaccttgaaattggctattctcctctctgcaattcttggataagaaaaaaatattagtcaaaataaaagccaattaaaaatggaaacaacttaaatgcccaataggactggattggtaaatgaaattatggtatttctcaggatctgggagaattttttaaaaaaagaaaaaagaaataatgatgttttctggcaatgaaattctatgtagaccttaaagaaaagttttgcaagacacagtgacgtgtccctgtagtcccagcaactcaggaggctgagacagggagtatcatttgagcccaggagttcagggatgtagtatgtgaagatcacacctgtgaacagccactgcacttcagcctgggagacacagcaggaccctggctcttaaaaaaaaaacaattctgcactttgggaggccaaggcgggcagatcacgaggtcgggggatcgagaccatcctggctaacacggtgaaaccccatctctactaaaaatacaaaaaattagccaggcgtggcggcaggcaccagtagtcccagctactcaggaggctggtgtgaacctgggaggcggagcttgcagtgacctgagatagcaccactgcactccagcctgggagacacagcaggaccctggctcttaaaaaaaaaattccaagaacatgaaaagctattcacaatataatgttgagtgaaaaaaataggctgggcatggtggctcacacctgtaatcccagcactttgggaggctgaggtgggcgaatcacctgaggtcaggagttcgagaccagcctgcccaacatggtgaaaccccatctctactaaaaatacaaaaattggctgggcatcgtggcacacgcctgtaatcccagctactcgggaggctgaggcaggagaatcacttgaacccaggaggtggaggctgcagtgagccaagattgtgccactgcactccagccttggcgacagagtgagactctgtctcaaaaactaataataaataataataataagtgaaaaaaaaattacaaatgttttacatttctattaaacgtatgtgtatgatttatcatgcaaacacttattgagcacttactttgtgccattcactagtctaagtgttttacgtgtattaactcactgaatcctatgaggtactataattttacccatttagtgaatgtgacaaatgaggattagagaaattaagtgtacaaggtcatacaactaggtaacaaagcttggctttgcacccaggcagttcacaacccatacccacagagaaacatacacatataccttatattatattggttcttttttttcctgaaacaaaaggtctcacatatttattactgaacccagcctactatcgcagggcatataagcaaagagaaaaaatatattcccaataaaacacgtccaactgttcagacagtggtgacgttttcagcttgctatagtaagatggccgtgaccttgatacagcgtgaatatgtgtgccagctcacgtgcagttccttatagacccagcttggctgttctgcaatgtctcctttccagttgtgcctgattttattaccagttttcaaccagatccactggagaatgggacgatttggcttttgtttcttggccaggaatcgcttactcttaaaagacttgtgagaagacatgacaagaagcagaatcaagcacacaccacaagagagagttgtttgttttttgagacaaaaatataaaatagtgagaccccaattgttttatttatttatattttatttttattttttgagagggagtctcactctgtcaaccaggctagagtgcagtggcacaatctcagctcactacaacctccacctcccgggttcaatgattctcctgcctcagccttccgagtagctgggactacacacgtgcattaccacgcctggctaatttttatattttttgtagagacagggtttcaccatgtgggccaggctggtctcaaactcctgagctcaagcaatcggcccacctcagcctcccaaagtgctgggattacaggtgtgacttggaaaaagtgtaatggtacagtttgtagcaggctaataatgctcccaccaagaacagtaagaaaagctggataaaatgaatcagggagctgccaaagcaaacaggcctagaggagccaaaattccagaaagaggtgaactctaggaggtaagctgatattccgcagcagatttttttcctggaggatttgccaattcagggcacagggctagatgctgagaatctgggccttgctcaggtaaagaacaaattactgagggaaaatttaactagtaggagagttggcagtctttactttttaaaatttttttatttattaattttactttgagacagagtcttgctctgtcacccaggctggagtgcagtggcacgatctcagctcactgcaacctctgcctccccaggccaagcacttctcatgtctcagcctcccgagtagctgggataacaggcatgcaccaccatgcctggctaatttttttttttcttttttttttttgagatggagtttcactctgttgcccaggctggagtgcagtggcacaatcttggctcactgcaaccacaacctcccgggttgaagcaattatcctacctcagcctcccaagtagctgggactacaggcacccaccaccacgcccggctaatttttgtatttttagtagagacggggtttcaccatgttgggcaggctggtctcgaattcttgacctcaagtgatccaccggcctcggcctcccaaagtgctgggattacaggcatgagccactgtgcttggccctaattttttgtatttttggtagagacggggtttcaccatattgcccaggttggtctccaactcctgagctcaggcaatctgcccgccttggccttcgaaagtggtaggattacaggagtgagccactgtgcccagcagagtcggcagtcttaacaaagctaaggaggtaaaatcagattctggagggaagatcccataaaaaaggagaaagtagaactgagcgtatcacatggtaggttttcttttcaagacatgctgaattcaggccgggcacagtggctcgcgcctgtaatcccagcactttgggaggctgaggcaggcggatcacgaggtcaggagatcgagaccatcctggctaacgtggtgaaaccccgtctctactaaaaatacaaaaaattagccgggtgtggtggcgggcgcctgtagtcccagctactcgggaggctgaggcaggagaatggcgtgaacccaggaggcggagcttgcagtgagccgagatggcaccactgcactccagcctgggcaacagagtgagactctttctcaaaaatagaataaaataaaataaagtaactagtatgactaaatcacaagggtccttacaaaagaaagagggagtaggtgggtcagagtcagagagttgaagatgctgtgctgctggctttgaaattggaggaaacggcttatgggctaaggagttcaggggcctctaactggaacagacgaggaaatggattcagtcttagagcctccagaaggaatgcagccctgctgacatcttcattttagttcaatgaaacccattttggatttctgatctccagaactgtaaagtaatatatttgtgccattttcagcactgagtttgtgataatttgttacggcagcaacaggaaactagtacactaaggaaaaagcctctgacatgaagagcaaagttttatgctgaggagacaagatctgaaagtcagcacctgttggaggtagaggcctgcagaggcctaatgaacattcgaggttcttggttgaaagacttggagggctacaattaagaaacaagggggccaggcacagtggctcacgcccataatcccagcagtttgggaggccaaagtgggtggatcacctgaggtcaggagtttgagaccagcctggccaacatggtgaaaccccatctctactgaaatacagaaattagccgggcgtggtggcgtgcgtctctaatcccggttactcaggaggctgaggcaggagaatcacttgaacccgggaggctgaggttgtggtgagccaagatcatgccattgcactccagcctgggcaacaagaatgaaactctgtctccaaaaaaaaaaaaaaaaaaaaaatagaaacaagggtgaggctgggtgtggtggctcacacctataatcctagcacttgggcacttggggaggccaaggcaggagaatcacttgagccaaggacttcaagaccagcctgggcaacatggtgaaaccccatctcaacaaaaacatacaaaaattagttgggcgtggtggctcatgcctacggtcccagctacttgggaggctgaagcaggaggatcacttgagcccaggagccagaggttgcagtgagctgagatcgcaccactgcactccagcctgggcaacagagttgagactctgtctcaaaaaagaaaaaaaaaagggatgaatttaagatagggcctttttaaaaccacaactctcagatgagttggcacaagaaaagaaaattttttaaaaagataaaactgtaacccaacctcaattcagctcagtacctgaagctaagcggccaatactcttcctgcacagcagaagagagagttaagtcctttctggaagaaaataatatcatctggaggtctataattcttttaagcaatatctaagattcaaactaggcatgccaagagacaaagccatatacatgattatcaagaaaaatacaatggaaacaaactcacacatgacccagataccagagtaagcatataacaacataaaaataactactgtggctgggcgcagtggctcatgcctgtaatcccaacactctgggaggctgagcggggcagatcacttgagatcaggagttccagataagcctggtcaacatggtgaaatcctgtcactactaaaaatacaaaaactaggcgggtgtggtggtgggcaccagtaatcccaattactcgggaggctgaggcaggagaattgcttgaacctggaaggtggaggctgcagtgagcagagatggcgccactgcactccagcctgggtgacagagtgagactctgtctcaaaaataaaataaaataaaataattagtatgactaaaatgtaaaaatagagtggggagggttaaaaaagattgaaggataaagccttttactagataactgaaatctataaaaactaaatgtaaattcccaaactgaaagatacaataactgaaattaagaactcaggttatgggtttaactgcagatcagatgcaacagaaaagaggatgattgacctaaaaggccaatagaaaaatatacaaattggccaggcacggtggctcacgcctgtagtctctgctacttgggaggctgaagcacgagaatcgcttaaacccaggaggtgaaggttgcgatgagtcgagatcacaccactgcactccagcctgggtgacagagcgagactccgtctgaaaaaagaaaaaatatataaactgaagcacagagaggaaatagaaaaatcagaaaaaagcataagagacatgtggaatactgagaaaagaccaaacatacatgtaacctaaatcctaaaaagagagcggagtggaaggggcagcagcagtgttttaaaagagaacggctacctctagggccccaagcttagtttctaatgccattctccaacacattgaacaggggctccttggagaaatggctgaattgtagggctggggtagggaatgaacacagtggagcttctgatagtgctggaaagtaaggaagtgctcaaagaaacccacaatagtagagtcagtgggacacaggaatccactgaaagctctcaatggccaagctggaacaattagaactacaaaataaataaagtagtattgaataatcatccaaagtataaaatatccatgagtccatgttgaaataaatgacagaatacataaataaatgggagaggagagacaaatttcctgtgctgaaaattccaaagaatttacgcagatacgatgcccttgaggaggtgggtcataactccctgctctttcagtgtgggctgcacacgatgatttcctcctaatgagtacaggatgaacacggaggaaatgaaaccgcctttgcaaaatgatgactgagacagtgaaagagatccaacctaaccgactccatcttgcgtctaacctccaagctgcccttgttcattcctgggcgtaggctgaactaacttggggggaaacttaatttatagtttaaaacaaagacggtaacagccctttcccaaagcagacctccttcttgccgggggactagactaacattagtcacaagattagaaatgatggtttaggagccatgcagctggaggctacaagattctgaccctccctacactgctcctaagatcagcgcttgagatattttgcagaccctgcacttgatggatcagctggcaccacccagatggataaactggctcatctgatcttgtggccccgacccaggaactgactcagcacaagaagacagctgactccctgtgattccatccctgatcaatcagcactcccggctcactggctctccacacccaccaagctgtccttaaaaactctgctccccgaatgctgggagagactgatttgagtaataataaaactccggtctcccgcacagccggctgtgcgtgaattactttttctctatggcaattcccctgtcatgatgaatcggctctgtctaggcagcgggcaagtgaacccactgagcagttatagaaagagtaagtttatagtaaagaaacctgagaagcattagctcaggcagggaggcaaagttcatatgaacagtaacatgtcatgttgacagtatgtaccattgatatgatatgacgagaatggcgtcttacctctgtgatcttccttccaaaaacctgtaacctcagactaatcattagcagaaaaatcccagtgaaggaacattctacaaaacacctaaccagtactcctcaaaaaagtcaaggtgatgaaaaacaagaaagtctgagaaactgttaccgccaagaagagcccaaagagacatttaatgtggtatcctagatagaatcctaaagcagaaaaaggacattaggaacaaactagaaatcagaacaaagctttatttgataacactgtatcaatattgtttcattaattataataaatgttccatactatgtagatgttaaccatagggagtccgggtgcggtagatgatgcctgtaaccccagtgttttgggaagccgaggcaggaggactggttaagcccaagaggtcaaagctgcagtgagccacggttgcaccactgcactccagcgtgggcgacagagcaagaactgtctcaatagcataattactattcttacagtaacagggaaactgggtgtggagtatacgctaactctgcaacttttctataaatctaaaactattttaaaataaaaacttggtttttttatttttttattttttgagatagagtttcactctgttccccaggctggagtgcagtggcgtgatctcagctcactgcaacctccacctcccaggttcaagcaattctcctgcctcagcctccaagtggctggggttacaggtgtgcaccaccatgcccggctaattttttgtaattttagtagagacagggtttcgccaggttggccaggctggtctcgaactcctgacctcaagtgatccacccacctcggtcccccaaagggctgagattacaggtgggagccactgcacctggccaaaaactgttttttttaaacaaaggtaatggctaagaattttcccaaactgataaaaaaaatcaacctggctgggtgcagtggctcacactggtaatcccaggactttagaaggccgagcatggtgttggcacctatactcccagctactcgggaggctgaggcaggagaatctcttgaacctgggaggcagagcttgcagtgagccaagatcgcaccattgcactacagcctgggagacaaaagcgaaactccatctcaaaaaaaaaacaacaaaaaaatcaatccatagattcaagagactctgagtgctctaagcagaataaatacaaagaaagtaatagtggctagagaggacataccatcttaaattgaataataaaacttacagctgacttctcaacagaaacaatggaaactagaagacaaggtaagcacttatctacctacctacctacctacctatctgaggcagggtctcactctgtcacccaggctggagtacagtggcacaatcacggcttactgcagtctcaaccttcctgggctcaagaggtcctcccacctcagtctctcaagtagctgggaccacaggcgtgtgccaccatgcccggctaatttttgtatttttttgtagagacagagttttgctgtgttgcccaggctggtctggaactcctgggctcaagtgatcctcctgcctcagcttcccaaagtgctgggattacaggtgtgagccaccacgcccggccctgatgggaaactttataatagatggatccatctgacaatatctgaactccatgatcaaccttaacaaagcaaaaagagatgaccagctattttgtaccttctgagaagatgcaataggatgtatagaaaacagtatttccccaacctcaaacctatggctaattaagactagatctaactacttattttcaagaagtacaggaaatagaagacatattaaacaataccataggtatataatcagcaactgccagaatataggaaactctacaggacaaacaaaccaatttcttcaacaaataaatggcaggaaaaaataaataaataaataactgacagggcacagtggctcacgcctgcaatcccagcactttgggaggccaaggtgggtggatcacctgaggtcaggagttggagaccaacctggccaacatggtgaaaccccatctctactaaaaatacaaaaattacctgggcgtggtggtgagcgcctgtaatcccagctactcaggaggctgaggcaggagaatcacttgaacccggcaggcagaggttgcagtgagccgagatcatgccactgcactccagcctgggtgaggaagcaagactgtcataaaaataaaatcaaatggcaggattaaaagaagaaagagagaaatgaggcagcaaaaacaacacattgaagtaaatttaaagccagatgctgtggtgtgcacctatagtcccagctacctggcaggctgaggtgggaggatcacttgagcccaggagttctagtctgtagtgtgttatgatcacatctgtgaatagccactgcactccagcctgggcaagatagcaagatcttacgtcttaaaaaaaaatcctaatttacatattaaccaaatgcaatgtgtggaccttgtttgaatcttaatttgaaaaaattgtaaaaagaaaataataggtctggcatggtggttcaagcctataagtccaccactttaggaggccaaggctggtgaattgcctgagcccaggagtttaagaccagactggccaacagagtgtgacccatctctgcaaaaaaaaaaaaaaaaaagaaagaaagaaaattagccaggtgtggtggtgcacacctgcagtcccagctactcaggaggctgaggcaggaggatcacttgagcccaggaggccaaggctgcagtgagttgtgatagtgccattgcacaccaacctgggtgacaaaatgagaccctgtctctttaaacaaaaaaaaaagaaaagaaagaaaacacatacatacatatatgaggcatatctgaataataacagcatattttatgatattaaggactgacaatattttagagataataaagatattttatttatttatttttgagacagagtcttactctgtcacccaggctggagtgcaatgacacgatcttggctcactgcaacctccacctcctgcgttgaagtgattctcctgcctcagcctcctgagtagctgggactacaagcgcacgccatcacacccggctaatttttagtagagacggggtttcgccatgttggccaggctggtcttgaactcctgacctcaggtgatccacccgcctcagcctcccaaagtgctgagattacaggtgtgacccatcacacccggcccttctcactcttgtaaaggcactcttactgaattgtccaaaggacagatacctcataagaaatatagatgactaaaacaagaaggaaaatccagctactcacaatactccttcacctctttgttctccaatcactacttgcaccaccattttgtatcggtcaaatcccatttctagaaagaaaaaataaggttatttataagcaaatatgtagtaaaattacttattgaagacaaatttgcccagaaatggacataaacattcaatccacaagtacttaatgaatatggtggtaagcttgggggtcaggaggacgtgaaggcagatcctaactataactcagcaagtgtataacctcagaaagtaatttaacttttcagtttaagtctcccttattaaacaggaatatcagtacctacctcccaagattgttataaggttaggtaagatatagtagtatcttttttttgttttgtttttgagatggattctcactctgttgcccaggctggagtacagtggcacgatctcagctcaccggcaacctctgcctccagggttcaagtgattctcctacctcagcctcctcagtagctgggactacaggtatgcatcaccacacctggctaatttttgtatttttagtagaaaaggtgtttcaccatgttgcccaggctggtctcgaactcctgacctcaggtgatccactcaccttggcctcccaaagtgctgggattacaggcgtgagccaccgcgcccggtcagatatagtaatatctaaagcatctaaacagtgctgttaaatactagtccttcaataaaccttagcttccttcctttttcccctactataagtcagctagtgagctgaaccttcaagatagagaaataaataagacgtttttcttgccttaaagaactcacagtaataaagaactcaaaggaaaatagaaaaataggccgggcacggtggctcacgcctgtaatcccagcactctcagaaggtgaggccagtggatcacctgaggtcaggagtttgagacaagcctggccaacatggttaagccccgtctctactaaaaaatataaaaattagccaggcatggtggcagatccctgtaaccccagctactcgggaggctgaggcaggagaattgcttgaacctgggaggcggaggttgcagtgagctgagatcgcaccattgcacactagcctgggtaacaagagcaaaactccatctcgaaaaaaaaaaaaaaaaagaaaatagaaaaataaattataaattgagtatgcttataattcaaggagtggcatgtatgatgtacatcaggaacacagagccagtgggggcagttcctctgtttgtctgggcagtggcaagaaatcactggaaaagacttcttggaagatgtggccggccaataaactgagtcttgagggctgagtaagaggggaccaggtcagccccatctccccacacgtccgagaacgaggggcatgtgcacagcaggagagcatgggatctccaagaaactgtaagctgttcagtaagacagacaagaaaaaaaatgaagattccagagcaaaacgaggtgatccagcaccatttagctgtttactccagaaactacgttgctaaagcagcaaaatcctgaaaattctcactaacaccaagtctgaagagaaaaaaatggaatgggcatttttgaatctttctacttttttgaccaaggaatagtggaaagagttttaaaaaaacaaaagaagtgaaataagcgaagctgaaagagccagctctctctgatgaacgtgcaggttccaagattacactgtaaacgggacaatctgaagactacaggcaatctcccatgtggggcatgaacctgattcagagtgtgtaaagacagagtccaagttatttttaaaaaacactgcacacaactcagctgagcttcctcctttctctaaccaatcccaaattatacagaaatgtgtctagaataatactcagcccttaaatcacggttctgaggggaaaataaaatagtctcagatatggtggggaggggaacttaaaaaaaaaacccacaccatatcagagcaattaaaaatcccccacatcatatcagagcaattaaaaatcccccacatcatatcagagcaattaaaaatcccccacattatatcagagcaattatgatgtatgggcacaacaaaatgaaatgcagccaaatggcaataaacaaagatgcaatagcaaaaacaaaagagtaacaaagaagaacaaagcttctgctgggtgccatggctcacgcctgtaatcccagcaattttggaggctgaggcgggaggatctcttaaggccagaagttcaagaccagcctaggcagcatgacaagaccaccatctccacaaaacaatttttctttttttcttttttttgagatggagtttcactcttgttgcccaggctgaagtgcaatggcgtgatctcaggtcaccacaaactctgcctcctgggttcaagcaatcttcctgcctcagactcccgagtagctgggattacaggcatgaaccaccacacttggctacttttgtatttttagtagagatggggtttctccatgttggtcaggttgttctcgaactcctgacctcaggtgatccatctgcctcggcctcccaaagtgctgggattacggacgtgagccaccacacctggtccacaaaacaatttttcaaaaaatattgaagaaaagaaagaaacttccagtggaaggaaggaagaaggaaggaaagaaggaaggaaggagctgtgtaagagaaaaaatttggctgggcacggtggcccacacctgtaatcccactttgggaggctgaggcgggtggatcacttgaggtgaggagtttgagaccagcctgaacaacatggagaaatcccatctctactaaaaatacattagcagggcgtggtggtgcacgcctgtaatcccagctacttgggaggctgagcaggagaatcgcttgaacctgggaggtggaggttaaggtgagccaagattgcgccattgcactccagcttgtgcaacaagaccgaaactcagtccaaaaaaaaaaagaaaagaaaagaaagaaaaaaatcaacctaggaagtaatacaaatcaaggaacgaagagttattcctcacaattaattcacaatactagaacaatgtaagcttataaactcaatgaaataagtactcaatcaggttatcaaattttttaactttttttttggagacagagtttcgctcttctgcccagggtggagtgcaatggcaagatctaggctcactgcaacctccacctcccagattcaagcaattctcatgcttcagcctcccaagtagttgggattataggcatgcgccatcacgctcggctaatttttttttttttttgcatttttagtagagacgggatttcaccatcttggtcaggctggtctcgaactcctgacctcaggtgatccacctacctcggcctcccaaagtgctgggattacaggcgtgagccaccgcacctggccaggttatgattttgtttgatttggtttggttttttgagagggaatctcgctctgtcgctcaggctggagtgcagtgggatgatctcaactcactgcaacctccacctcctgggttcaagcgattctcccacctgagccttctgagtagctgggattacaggcacgcaccaccatacctggctaaattttatattttagtagagacacggtttcaccatgttgcccaggctggtctggaactcctgacctcaagtgatccacctgcttctgcctcccaaagttctgggattacaggcgtgagccacctcacctggcctgttttgttttgtttttgtttttttggagatagggtctccctctgtcacccaggctggaatgcagtggggcgatctcggctcactgcaacctccgccttctgggttcaagtgattctcctgcctcagcctcccaagtagctggaaccataggcgtgcaccaccacgcctggctaattctttgtatttcagtagagacgaggtttcaccatgttgcccagggtggtcatgaactcctgagctcaggcaatccacccgcctcggcctcccaaagtgctgggattacaggtgtgagccacggcacccagcctcaatcaggttattaagcaacataaagagatgaaaagaaagaccacggccctagggaacaaacagaatacccagaaaagatcattccagaactaataaattcaaaatggcaagaaaaaagacacaaatgaaaacaattactggtttaagaaaatcacaagtaaatggcaataaaaaaggaagaagcctgggcaaaatggcaaaaccccgtctctacaaaaaatacaaaaattagccgggtgtggtggcaggcgcctgtagtcccagctacttgggaggcggagatgggaggattgcttgaggctgcagtgagccaagactgcgccactgcattccagcctggccaacagagtgagaccctgtctcaaaaaaaaaaaaagaagaagaaagaaattatgggaaagaaaaactaataaatatagaagacaaagatggctcaacataacaatatttggtgtcctgaagaaaaggaagtaacgaatggaataggaaacatattcagagatataaggaaatttcctttatatggaaagaataaagtctgcagattgaaagctataaaatgctcattagaaagtcagaatctttagaaaagctactgagcataaaggtgaagatgaggattattttatttatttatttatttatttatttatttatttattttgagacagagtctcgctctgttgcccaggctggagtgcactggcacgatcccagctcactgcaacctccttcaccccccaggttcaagcaattctcctgtctcagcctcccaagaaatcccagcactttgggaggccgagacgggtgggtcacctgaggtcaggagtttgggactagcaagcccggctaatttttgttttgtttttttgagacagagtttcgcccttgttggccaggcttgagtgcaatggtgcaatcttggctcactgcaacctctgcctcctgggttcaagctattctcctgtctcagcctgggattacaggcatgcgccaccacgcctggctaattttgtatctttagtagagacagggtttctccatgttggtcagcctggtttcgaactcacaacctcaagtgatccgcccgcctcggcctccctaagtgctgggattacaggcgtgagccaccatgcccagcccctaaattttgtatttttactagagacggggtttcaccatattgttcagggtggtctcaaactcctgacctcaggtaactcacctgtcttggcctcccaaagtgctgggaatacaggcgtgagccaccacgtccagccaaaggtgaggattccttaagcagagaacatcaagctgggctcagatttcttgacaacaagttaccactgaatgtcagagggcaatgaagcacaagggtcaagaaaataaattattacctcaaaactatgtatattctacttttgggggtggaggggcgggggatggagtctcgctctgtcgcccaggctggagtgcagtggcactatctcggctcactgcagactctgcctcctgggttcaagtgattcccctgcctcagcctcccaagtagctgggattacagatgcccactaccacgcccggctaatttttgtatttttcgtagagacggggtttcaccatgttggcaaggctggtctcaaactcctgacctcgggtgatccacccggctccgcctcccacagtgcctggattgcaggcgtgagccaccgcgcctggcccatagtatattctactttaaaggcaaaaggcaggcattctcaaacacaaaagaatccagggaatacggcatttctgagtcctttctgaaaacaacttacaacaaaatctcatcatctaggagttgaaataaggaactcttcccagctaattgagaggctgaggcaggagaatcacttgagcccgggaggttgaggctgcagtgatctgaaatcacaccgctgcactccagcctgggtgacgaagaccctgtctcaaaaaaagaaaataaggaactcaacaatgaaaatgacatggtcaaggaactaaacaggaggcaactgatccagttacagaatgaatatgacatgactatgggaaacaggtctacaatatcccattgtcatttgtccatgtatatggacatgtagaagtctgttgtaatgtttgcctagtattaatgattttttttttttttttgagacagagtctcactctgttgcccaggttgcagcacagtggcataatcttggctcactgcaatctccgtccctgggctcaggtgatcctcctgcctcagccacccgaatagctgggactacagatgcacaccaccagcccggctaatttttgtatttttctaagagacagggttttgccatgttggccaggatggtctcgaactcctgggctcaagagatccgcccgcctcaacctccaaaagtgctggaattacaggcgtgagccactgtgcctggccaatattaatgattgtttattggtggtggcattcaggtgatttttctcattttatttttctagtgtttaaattttgtataatgaatgtgtaccattttttacaaaaaatcttaacgatgaaccttcattaaaaagtctaaaaacaaaaatgctaatatactaacagcagttaattctgggtgatagaaatacacaggattgctattctttgtacttttctgtattttttaatttcttaaactaaaaacaaattcagaaaaaaacaataaacacaaatattaaatagtaactgcctttggttaatattttaaaactttaaggggccaggcacagtggctcacgcctgtaattccaccactttgggaggccgaggcggacggatcacctgaggtcaggagttcgagatcagcctgaccaacatggagaaaccccgtctctactaaaaacacaaaaattagccgggcatggtggcacttgcctgtaatcccagctactcaggaggctgaggcaggagaatcgcttgaacccaggaggcggagattgcagtgagccaagatcatgccattggactccagcctgggcaacaacagcaaaactccatctcaaaaaaaaaccttatggatacttttttgtattgtctaggtttattacaacgagcatgtattacttttatgaagatattctttctcttcaaaaaatgatgtcttctaagaagagcagatggaaataggccgggcacggtggctcacatctgtaatcccagcatgttgggaggccaaggcttgcagatctcttgagggtcaggagttcaagacaaaattagccacgtgtggtggcgcatgcttgaaattccaactgcttgggaggctgaggcgggaggatcacttgagcccaggaggaggaggttgcagtgagctgagatcacaccactgcactccagcctgggaaacagagcgagactctgtctcaaaaagaaaaaaaaaaaaaaaaagaacttttcagatcagacggtataacattattaacaaaagagagagaccaggcgcagtggctcacacctgcaatcccagcagtttgcgaggcctaggtgggagaatcacttgaggccaggagctcaagatcagccagggcaacatggcaagacaccatctctacagaaaaatttaaaaattaaaaaattagccaagcacggtggcacaagcctgtagacccagctacttgggaggctgagatgggaggatcgcttgagccaggaggtcaaggctgcagtgagccatgttcacaccactgcactccaccctggacaaaacagcaagaccctatttcaaaaacaaaacaaaacaaaaaaaaacaaaacaatcagagagacaaagagaacagggtaggaaaagcacaaaatatgctctacagatgtagtttggtaggggtcgagggttgagtaagggaagtagctaaggattagggaggagagatggactgcaggtactaaatgccaggctgaggacttgacagcttgggggaagaaacaaccaagaaatacaggggaaaggagtccctgtactttctggtctttctgaatactaagattttttggacagtgttttatttcacatcttcactcttttcccccatctgcaaaaacttacatgagtaaaagtcaccaaataattagagaagacaagacactgaagaaaaagttgtctttaatagaatccacagctaacattctatttacgtttttttaatagagatgttttatttttttattttgcttttttttttttttgagacagagtctcactctgtcacccaggctggagtgcagtgacgcgatctcagctcactgcaacctccacctcctgggttcaagtgattctcctgcctcagcctcccaagcagctgggactgcaggcgtgtgccaccacacccagctattttttgtatttttagtagagacagggtttcatcgtgttagccaggatggtctcaatctcctgacctcgtgatccacccgcctcagcctcccaaagtgctgcgattacaggcgtgagccactgcgcccggcctttattttgctttttaatacacatgaggtcggctgggcgcggtggctcatgtctgtaatcccagcaccttgagaggccgaggcgggtggattacctgaggtcaggagtttgagaccagcctgaccaacatggagaaaccccgtctctactaaaaatacaaaattagccaggcgtgatggtgcatgcctgtaatcccaactactcaggaggctgaggcagaagaatcacttgaacccgggaggcggagtttgcagtgagccaagatcatgccattgcactccagcctgggcaacaagagtgaaactccatctcaaaaaaaagaaaaatagacatgaggcctcaccatgttgcctaggctggtactgaactccagagctcaagcaatcttcctgccttggcatgctaaagtgttgggattgtaggcgtgagccaccacacctggccccaatgtcctttgtttaaagatggagagggggcaaatgggtaatactgactctgtgaagagaatgagtcatttccagttatcaccatgattaccttttaatttatctttaatgttttctgataaatgttttgtaagctgaggcatttcttctggagaatattcagcatttgccagttcctccttgagcacagcatggatacagtctttaaccacagagggcctgaacctgaatggaacaatttgtgaacatccagtcggtgactccacaaccccagcttaccttcataccgcaacttctcccatctttttgtcattagtaccacttaatccttctttttcatattttttattataaaatataaacaaattaagacaaatcataggccacatgtgtatcttcaacctggacctgcactgaacttcaacacattccaactcatgctccatatgaatgtttattaggcaactcaatacatccaataatgagcttctcatactcccctctcccccaaaacaaaatatatacttgttgttaattttgttctgcacgctttcacaaaataaaataaaataaaataaaataaaaaaatacggctgaatggcattctgggcattcagaaccttttaccaagataactgagggtatctttctctgtgttcattctacccaagggaaaaatcctgtatgaaatttgtatcactttttctgtgagttaccaagagaataaaaataaacaaagaaatttgtatcacattataatcaaaattcctgttttccatatttgccaagcaaatatggggtgtgtgtgtgtgtgtaaagttagtgatcttacaaacctagctgagtaccctctgctctggcccgtgagcctgacatttttttcagtgtgtgtgtgtgtgtgttgtgtggtgtgtgtgtgtgttgtgtggtgtgtgtgtgtgtgtgtaaagttagtgatctcacaaacctagctgagtaccctctgctctggcccgtgagcctgacatttttttcagtgtgtgtgtgtgtgtgtgtgtgttgtgtggtgtgtgtgtggtgtgtgtgtgtgtgtgtgtgtgtgtaaagttagtgatcttacaaacctgagtaccctctgctctggcccgtgagcctgacattttttttcagtgtgtgtgtgtgtgtgtgtgtgtgtgttgtgtgtgtgtgtgtaaagttagtgatcttacaaacctagctgagtaccctctgctctggcccgtgagcctgacattttttttcagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgtaaagttagtgatctcacaaacctagctgagtaccctctgctctggcccgtgagcctgatatttttttcagtgtgtgtgtgtgtgtgtgtgtgtgtgtgtaaagttagtgatctcacaaacctagctgagtaccctctgctctggcccgtgagccttaatcctagcgagggctcgctgcggtggtctaagggcctccagatcccacccgggtaggacttcgcacagatgcagctcccgcgccgggagtgagcccatcctggcacccgtgtgcacagtcaccctcgaatcacggctgaacggcatccgacgcgagtggcttcctgcctctattctacccatctccttactcaggacgccatcgcgggtttcccagggccaaccattcccgccgcgccaccctaagacgcgcccggcgcccaaacactgaggaagcgggtggggtcccctgcggcccctgcagcgggaggggcgcccggacgtcacagcagggccgcccgcccgcctcgcggcctcccgcctcccgccccgcggaccccgcgcgtcccccgcgctccttccgtggcccaggtcccaggcgagctccgcccctcagaccagcgcgctcgaggtcgccccgccacagcccgtcctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgccctccctgcccgcgcctgcgcaccggctgctgggcgggaactggtcgcgtccggacgcgcgacagcttccacccgcctcaggcagtatcagccgcgccgcagtcggaggaaatagacgcggggcctgaggctcctggacttgaggtattaggctggtgcagaagtaattgcggcggccgggtgcgggggctcaggcctgcaatcccagcactttgggaggccgaggcgggcggatcacctgagtcaggaagagttcaagaccatcctggccgacatggtgaaaccccatctctactgaaaatacaaaaattagccgggcgtggtggcgcgtgcctgtaaccccagctgctctggaggctgaggcagaataatctattgaacccaggaggccgaggttgcagtgagccgagatcgcgccactgcactccagcctggcgacagagcgagactgcgtctcaaaaaaagaaaaaaaaaaaaaaaggaaggaaggaaagagacttaggctgcattccccgcttttaaaaatatatatttatttttatttttttaaacgaagtctcgctctgtcactcaggctggagtgcagaggcgcgatctcggctcactgcaacctccacctcccaggttcaagcaattctgcctcagcctcccaagcagcagggattacaggcgcgccccaccacgaccggctaattttttttgtatttttattagagacggggtttcaccatattggccaggctggtctccaactcctgacctcaggtgatcgcccacctcggtctcccgaagtgctgggatgacaggcgtgagccatcgtactctgccgcattccctgcttataagcaccagtccctggtcctgttttagaaggctgttgtatcttggcctctgctagcttcaaaaactaaggcccgatgaggtagctcgtgcctgtaatccctgtttacaggagaggctgaaagggcagggattcctttttttttttttcccacttgagacagggtcttgctctgtttctcaggctggagtgcagtggcacactcaccgctcacttcagcctcgacctcttggactcaagcagtcctcccacctcagcctctggagtacctggaactacaggcgaatgccaccgcgcgtggctaatctttttaatttttgtagagataggatctggctatgctgcccaggctactattgaactcttgggctcaagtgattatcccacctcagccttccgaagtgctgggactacaggcatgagccatcacagccagctgggatattgtttttcgaatcgctgtcatgttctgtactatatgcagttcctgaaagaatggaggcaagaaggagtcagctaaccactgtgaactgtcttagtgccaaggacccacccttctctccttggggtcctgctgacccatcagaatagggctgagccaggatggggcttgtggagatgatgtgtat
